United States Patent 9,205,144 (IDENTIFICATION OF CONSERVED PEPTIDE BLOCKS IN HOMOLOGOUS POLYPEPTIDES) - sequence listing, part 7

SEQ ID NO: 237422 - protein, 11 aa, Japanese encephalitis virus
REAIIEVDRTE

SEQ ID NO: 237423 - protein, 11 aa, Japanese encephalitis virus
EAIIEVDRTEA

SEQ ID NO: 237424 - protein, 11 aa, Japanese encephalitis virus
AIIEVDRTEAR

SEQ ID NO: 237425 - protein, 11 aa, Japanese encephalitis virus
IIEVDRTEARR

SEQ ID NO: 237426 - protein, 11 aa, Japanese encephalitis virus
IEVDRTEARRA

SEQ ID NO: 237427 - protein, 11 aa, Japanese encephalitis virus
EVDRTEARRAR

SEQ ID NO: 237428 - protein, 11 aa, Japanese encephalitis virus
VDRTEARRARR

SEQ ID NO: 237429 - protein, 11 aa, Japanese encephalitis virus
DRTEARRARRE

SEQ ID NO: 237430 - protein, 11 aa, Japanese encephalitis virus
RTEARRARREN

SEQ ID NO: 237431 - protein, 11 aa, Japanese encephalitis virus
TEARRARRENN

SEQ ID NO: 237432 - protein, 11 aa, Japanese encephalitis virus
EARRARRENNI

SEQ ID NO: 237433 - protein, 11 aa, Japanese encephalitis virus
ARRARRENNIV

SEQ ID NO: 237434 - protein, 11 aa, Japanese encephalitis virus
RRARRENNIVG

SEQ ID NO: 237435 - protein, 11 aa, Japanese encephalitis virus
RARRENNIVGG

SEQ ID NO: 237436 - protein, 11 aa, Japanese encephalitis virus
ARRENNIVGGH

SEQ ID NO: 237437 - protein, 11 aa, Japanese encephalitis virus
RRENNIVGGHP

SEQ ID NO: 237438 - protein, 11 aa, Japanese encephalitis virus
RENNIVGGHPV

SEQ ID NO: 237439 - protein, 11 aa, Japanese encephalitis virus
ENNIVGGHPVS

SEQ ID NO: 237440 - protein, 11 aa, Japanese encephalitis virus
NNIVGGHPVSR

SEQ ID NO: 237441 - protein, 11 aa, Japanese encephalitis virus
NIVGGHPVSRG

SEQ ID NO: 237442 - protein, 11 aa, Japanese encephalitis virus
IVGGHPVSRGS

SEQ ID NO: 237443 - protein, 11 aa, Japanese encephalitis virus
VGGHPVSRGSA

SEQ ID NO: 237444 - protein, 11 aa, Japanese encephalitis virus
GGHPVSRGSAK

SEQ ID NO: 237445 - protein, 11 aa, Japanese encephalitis virus
GHPVSRGSAKL

SEQ ID NO: 237446 - protein, 11 aa, Japanese encephalitis virus
HPVSRGSAKLR

SEQ ID NO: 237447 - protein, 11 aa, Japanese encephalitis virus
PVSRGSAKLRW

SEQ ID NO: 237448 - protein, 11 aa, Japanese encephalitis virus
VSRGSAKLRWL

SEQ ID NO: 237449 - protein, 11 aa, Japanese encephalitis virus
SRGSAKLRWLV

SEQ ID NO: 237450 - protein, 11 aa, Japanese encephalitis virus
RGSAKLRWLVE

SEQ ID NO: 237451 - protein, 11 aa, Japanese encephalitis virus
GSAKLRWLVEK

SEQ ID NO: 237452 - protein, 11 aa, Japanese encephalitis virus
SAKLRWLVEKG

SEQ ID NO: 237453 - protein, 11 aa, Japanese encephalitis virus
AKLRWLVEKGF

SEQ ID NO: 237454 - protein, 11 aa, Japanese encephalitis virus
KLRWLVEKGFV

SEQ ID NO: 237455 - protein, 11 aa, Japanese encephalitis virus
LRWLVEKGFVS

SEQ ID NO: 237456 - protein, 11 aa, Japanese encephalitis virus
RWLVEKGFVSP

SEQ ID NO: 237457 - protein, 11 aa, Japanese encephalitis virus
WLVEKGFVSPI

SEQ ID NO: 237458 - protein, 11 aa, Japanese encephalitis virus
LVEKGFVSPIG

SEQ ID NO: 237459 - protein, 11 aa, Japanese encephalitis virus
VEKGFVSPIGK

SEQ ID NO: 237460 - protein, 11 aa, Japanese encephalitis virus
EKGFVSPIGKV

SEQ ID NO: 237461 - protein, 11 aa, Japanese encephalitis virus
KGFVSPIGKVI

SEQ ID NO: 237462 - protein, 11 aa, Japanese encephalitis virus
GFVSPIGKVID

SEQ ID NO: 237463 - protein, 11 aa, Japanese encephalitis virus
FVSPIGKVIDL

SEQ ID NO: 237464 - protein, 11 aa, Japanese encephalitis virus
VSPIGKVIDLG

SEQ ID NO: 237465 - protein, 11 aa, Japanese encephalitis virus
SPIGKVIDLGC

SEQ ID NO: 237466 - protein, 11 aa, Japanese encephalitis virus
PIGKVIDLGCG

SEQ ID NO: 237467 - protein, 11 aa, Japanese encephalitis virus
IGKVIDLGCGR

SEQ ID NO: 237468 - protein, 11 aa, Japanese encephalitis virus
GKVIDLGCGRG

SEQ ID NO: 237469 - protein, 11 aa, Japanese encephalitis virus
KVIDLGCGRGG

SEQ ID NO: 237470 - protein, 11 aa, Japanese encephalitis virus
VIDLGCGRGGW

SEQ ID NO: 237471 - protein, 11 aa, Japanese encephalitis virus
IDLGCGRGGWS

SEQ ID NO: 237472 - protein, 11 aa, Japanese encephalitis virus
DLGCGRGGWSY

SEQ ID NO: 237473 - protein, 11 aa, Japanese encephalitis virus
LGCGRGGWSYY

SEQ ID NO: 237474 - protein, 11 aa, Japanese encephalitis virus
GCGRGGWSYYA

SEQ ID NO: 237475 - protein, 11 aa, Japanese encephalitis virus
CGRGGWSYYAA

SEQ ID NO: 237476 - protein, 11 aa, Japanese encephalitis virus
GRGGWSYYAAT

SEQ ID NO: 237477 - protein, 11 aa, Japanese encephalitis virus
RGGWSYYAATL

SEQ ID NO: 237478 - protein, 11 aa, Japanese encephalitis virus
GGWSYYAATLK

SEQ ID NO: 237479 - protein, 11 aa, Japanese encephalitis virus
GWSYYAATLKK

SEQ ID NO: 237480 - protein, 11 aa, Japanese encephalitis virus
WSYYAATLKKV

SEQ ID NO: 237481 - protein, 11 aa, Japanese encephalitis virus
SYYAATLKKVQ

SEQ ID NO: 237482 - protein, 11 aa, Japanese encephalitis virus
YYAATLKKVQE

SEQ ID NO: 237483 - protein, 11 aa, Japanese encephalitis virus
YAATLKKVQEV

SEQ ID NO: 237484 - protein, 11 aa, Japanese encephalitis virus
AATLKKVQEVR

SEQ ID NO: 237485 - protein, 11 aa, Japanese encephalitis virus
ATLKKVQEVRG

SEQ ID NO: 237486 - protein, 11 aa, Japanese encephalitis virus
TLKKVQEVRGY

SEQ ID NO: 237487 - protein, 11 aa, Japanese encephalitis virus
LKKVQEVRGYT

SEQ ID NO: 237488 - protein, 11 aa, Japanese encephalitis virus
KKVQEVRGYTK

SEQ ID NO: 237489 - protein, 11 aa, Japanese encephalitis virus
KVQEVRGYTKG

SEQ ID NO: 237490 - protein, 11 aa, Japanese encephalitis virus
VQEVRGYTKGG

SEQ ID NO: 237491 - protein, 11 aa, Japanese encephalitis virus
QEVRGYTKGGA

SEQ ID NO: 237492 - protein, 11 aa, Japanese encephalitis virus
EVRGYTKGGAG

SEQ ID NO: 237493 - protein, 11 aa, Japanese encephalitis virus
VRGYTKGGAGH

SEQ ID NO: 237494 - protein, 11 aa, Japanese encephalitis virus
RGYTKGGAGHE

SEQ ID NO: 237495 - protein, 11 aa, Japanese encephalitis virus
GYTKGGAGHEE

SEQ ID NO: 237496 - protein, 11 aa, Japanese encephalitis virus
YTKGGAGHEEP

SEQ ID NO: 237497 - protein, 11 aa, Japanese encephalitis virus
TKGGAGHEEPM

SEQ ID NO: 237498 - protein, 11 aa, Japanese encephalitis virus
KGGAGHEEPML

SEQ ID NO: 237499 - protein, 11 aa, Japanese encephalitis virus
GGAGHEEPMLM

SEQ ID NO: 237500 - protein, 11 aa, Japanese encephalitis virus
GAGHEEPMLMQ

SEQ ID NO: 237501 - protein, 11 aa, Japanese encephalitis virus
AGHEEPMLMQS

SEQ ID NO: 237502 - protein, 11 aa, Japanese encephalitis virus
GHEEPMLMQSY

SEQ ID NO: 237503 - protein, 11 aa, Japanese encephalitis virus
HEEPMLMQSYG

SEQ ID NO: 237504 - protein, 11 aa, Japanese encephalitis virus
EEPMLMQSYGW

SEQ ID NO: 237505 - protein, 11 aa, Japanese encephalitis virus
EPMLMQSYGWN

SEQ ID NO: 237506 - protein, 11 aa, Japanese encephalitis virus
PMLMQSYGWNL

SEQ ID NO: 237507 - protein, 11 aa, Japanese encephalitis virus
MLMQSYGWNLV

SEQ ID NO: 237508 - protein, 11 aa, Japanese encephalitis virus
LMQSYGWNLVS

SEQ ID NO: 237509 - protein, 11 aa, Japanese encephalitis virus
MQSYGWNLVSL

SEQ ID NO: 237510 - protein, 11 aa, Japanese encephalitis virus
QSYGWNLVSLK

SEQ ID NO: 237511 - protein, 11 aa, Japanese encephalitis virus
SYGWNLVSLKS

SEQ ID NO: 237512 - protein, 11 aa, Japanese encephalitis virus
YGWNLVSLKSG

SEQ ID NO: 237513 - protein, 11 aa, Japanese encephalitis virus
GWNLVSLKSGV

SEQ ID NO: 237514 - protein, 11 aa, Japanese encephalitis virus
WNLVSLKSGVD

SEQ ID NO: 237515 - protein, 11 aa, Japanese encephalitis virus
NLVSLKSGVDV

SEQ ID NO: 237516 - protein, 11 aa, Japanese encephalitis virus
LVSLKSGVDVF

SEQ ID NO: 237517 - protein, 11 aa, Japanese encephalitis virus
VSLKSGVDVFY

SEQ ID NO: 237518 - protein, 11 aa, Japanese encephalitis virus
SLKSGVDVFYK

SEQ ID NO: 237519 - protein, 11 aa, Japanese encephalitis virus
LKSGVDVFYKP

SEQ ID NO: 237520 - protein, 11 aa, Japanese encephalitis virus
KSGVDVFYKPS

SEQ ID NO: 237521 - protein, 11 aa, Japanese encephalitis virus
SGVDVFYKPSE

SEQ ID NO: 237522 - protein, 11 aa, Japanese encephalitis virus
GVDVFYKPSEP

SEQ ID NO: 237523 - protein, 11 aa, Japanese encephalitis virus
VDVFYKPSEPS

SEQ ID NO: 237524 - protein, 11 aa, Japanese encephalitis virus
DVFYKPSEPSD

SEQ ID NO: 237525 - protein, 11 aa, Japanese encephalitis virus
VFYKPSEPSDT

SEQ ID NO: 237526 - protein, 11 aa, Japanese encephalitis virus
FYKPSEPSDTL

SEQ ID NO: 237527 - protein, 11 aa, Japanese encephalitis virus
YKPSEPSDTLF

SEQ ID NO: 237528 - protein, 11 aa, Japanese encephalitis virus
KPSEPSDTLFC

SEQ ID NO: 237529 - protein, 11 aa, Japanese encephalitis virus
PSEPSDTLFCD

SEQ ID NO: 237530 - protein, 11 aa, Japanese encephalitis virus
SEPSDTLFCDI

SEQ ID NO: 237531 - protein, 11 aa, Japanese encephalitis virus
EPSDTLFCDIG

SEQ ID NO: 237532 - protein, 11 aa, Japanese encephalitis virus
PSDTLFCDIGE

SEQ ID NO: 237533 - protein, 11 aa, Japanese encephalitis virus
SDTLFCDIGES

SEQ ID NO: 237534 - protein, 11 aa, Japanese encephalitis virus
DTLFCDIGESS

SEQ ID NO: 237535 - protein, 11 aa, Japanese encephalitis virus
TLFCDIGESSP

SEQ ID NO: 237536 - protein, 11 aa, Japanese encephalitis virus
LFCDIGESSPS

SEQ ID NO: 237537 - protein, 11 aa, Japanese encephalitis virus
FCDIGESSPSP

SEQ ID NO: 237538 - protein, 11 aa, Japanese encephalitis virus
CDIGESSPSPE

SEQ ID NO: 237539 - protein, 11 aa, Japanese encephalitis virus
DIGESSPSPEV

SEQ ID NO: 237540 - protein, 11 aa, Japanese encephalitis virus
IGESSPSPEVE

SEQ ID NO: 237541 - protein, 11 aa, Japanese encephalitis virus
GESSPSPEVEE

SEQ ID NO: 237542 - protein, 11 aa, Japanese encephalitis virus
ESSPSPEVEEQ

SEQ ID NO: 237543 - protein, 11 aa, Japanese encephalitis virus
SSPSPEVEEQR

SEQ ID NO: 237544 - protein, 11 aa, Japanese encephalitis virus
SPSPEVEEQRT

SEQ ID NO: 237545 - protein, 11 aa, Japanese encephalitis virus
PSPEVEEQRTL

SEQ ID NO: 237546 - protein, 11 aa, Japanese encephalitis virus
SPEVEEQRTLR

SEQ ID NO: 237547 - protein, 11 aa, Japanese encephalitis virus
PEVEEQRTLRV

SEQ ID NO: 237548 - protein, 11 aa, Japanese encephalitis virus
EVEEQRTLRVL

SEQ ID NO: 237549 - protein, 11 aa, Japanese encephalitis virus
VEEQRTLRVLE

SEQ ID NO: 237550 - protein, 11 aa, Japanese encephalitis virus
EEQRTLRVLEM

SEQ ID NO: 237551 - protein, 11 aa, Japanese encephalitis virus
EQRTLRVLEMT

SEQ ID NO: 237552 - protein, 11 aa, Japanese encephalitis virus
QRTLRVLEMTS

SEQ ID NO: 237553 - protein, 11 aa, Japanese encephalitis virus
RTLRVLEMTSD

SEQ ID NO: 237554 - protein, 11 aa, Japanese encephalitis virus
TLRVLEMTSDW

SEQ ID NO: 237555 - protein, 11 aa, Japanese encephalitis virus
LRVLEMTSDWL

SEQ ID NO: 237556 - protein, 11 aa, Japanese encephalitis virus
RVLEMTSDWLH

SEQ ID NO: 237557 - protein, 11 aa, Japanese encephalitis virus
VLEMTSDWLHR

SEQ ID NO: 237558 - protein, 11 aa, Japanese encephalitis virus
LEMTSDWLHRG

SEQ ID NO: 237559 - protein, 11 aa, Japanese encephalitis virus
EMTSDWLHRGP

SEQ ID NO: 237560 - protein, 11 aa, Japanese encephalitis virus
MTSDWLHRGPR

SEQ ID NO: 237561 - protein, 11 aa, Japanese encephalitis virus
TSDWLHRGPRE

SEQ ID NO: 237562 - protein, 11 aa, Japanese encephalitis virus
SDWLHRGPREF

SEQ ID NO: 237563 - protein, 11 aa, Japanese encephalitis virus
DWLHRGPREFC

SEQ ID NO: 237564 - protein, 11 aa, Japanese encephalitis virus
WLHRGPREFCI

SEQ ID NO: 237565 - protein, 11 aa, Japanese encephalitis virus
LHRGPREFCIK

SEQ ID NO: 237566 - protein, 11 aa, Japanese encephalitis virus
HRGPREFCIKV

SEQ ID NO: 237567 - protein, 11 aa, Japanese encephalitis virus
RGPREFCIKVL

SEQ ID NO: 237568 - protein, 11 aa, Japanese encephalitis virus
GPREFCIKVLC

SEQ ID NO: 237569 - protein, 11 aa, Japanese encephalitis virus
PREFCIKVLCP

SEQ ID NO: 237570 - protein, 11 aa, Japanese encephalitis virus
REFCIKVLCPY

SEQ ID NO: 237571 - protein, 11 aa, Japanese encephalitis virus
EFCIKVLCPYM

SEQ ID NO: 237572 - protein, 11 aa, Japanese encephalitis virus
FCIKVLCPYMP

SEQ ID NO: 237573 - protein, 11 aa, Japanese encephalitis virus
CIKVLCPYMPK

SEQ ID NO: 237574 - protein, 11 aa, Japanese encephalitis virus
IKVLCPYMPKV

SEQ ID NO: 237575 - protein, 11 aa, Japanese encephalitis virus
KVLCPYMPKVI

SEQ ID NO: 237576 - protein, 11 aa, Japanese encephalitis virus
VLCPYMPKVIE

SEQ ID NO: 237577 - protein, 11 aa, Japanese encephalitis virus
LCPYMPKVIEK

SEQ ID NO: 237578 - protein, 11 aa, Japanese encephalitis virus
CPYMPKVIEKM

SEQ ID NO: 237579 - protein, 11 aa, Japanese encephalitis virus
PYMPKVIEKME

SEQ ID NO: 237580 - protein, 11 aa, Japanese encephalitis virus
YMPKVIEKMEV

SEQ ID NO: 237581 - protein, 11 aa, Japanese encephalitis virus
MPKVIEKMEVL

SEQ ID NO: 237582 - protein, 11 aa, Japanese encephalitis virus
PKVIEKMEVLQ

SEQ ID NO: 237583 - protein, 11 aa, Japanese encephalitis virus
KVIEKMEVLQR

SEQ ID NO: 237584 - protein, 11 aa, Japanese encephalitis virus
VIEKMEVLQRR

SEQ ID NO: 237585 - protein, 11 aa, Japanese encephalitis virus
IEKMEVLQRRF

SEQ ID NO: 237586 - protein, 11 aa, Japanese encephalitis virus
EKMEVLQRRFG

SEQ ID NO: 237587 - protein, 11 aa, Japanese encephalitis virus
KMEVLQRRFGG

SEQ ID NO: 237588 - protein, 11 aa, Japanese encephalitis virus
MEVLQRRFGGG

SEQ ID NO: 237589 - protein, 11 aa, Japanese encephalitis virus
EVLQRRFGGGL

SEQ ID NO: 237590 - protein, 11 aa, Japanese encephalitis virus
VLQRRFGGGLV

SEQ ID NO: 237591 - protein, 11 aa, Japanese encephalitis virus
LQRRFGGGLVR

SEQ ID NO: 237592 - protein, 11 aa, Japanese encephalitis virus
QRRFGGGLVRL

SEQ ID NO: 237593 - protein, 11 aa, Japanese encephalitis virus
RRFGGGLVRLP

SEQ ID NO: 237594 - protein, 11 aa, Japanese encephalitis virus
RFGGGLVRLPL

SEQ ID NO: 237595 - protein, 11 aa, Japanese encephalitis virus
FGGGLVRLPLS

SEQ ID NO: 237596 - protein, 11 aa, Japanese encephalitis virus
GGGLVRLPLSR

SEQ ID NO: 237597 - protein, 11 aa, Japanese encephalitis virus
GGLVRLPLSRN

SEQ ID NO: 237598 - protein, 11 aa, Japanese encephalitis virus
GLVRLPLSRNS

SEQ ID NO: 237599 - protein, 11 aa, Japanese encephalitis virus
LVRLPLSRNSN

SEQ ID NO: 237600 - protein, 11 aa, Japanese encephalitis virus
VRLPLSRNSNH

SEQ ID NO: 237601 - protein, 11 aa, Japanese encephalitis virus
RLPLSRNSNHE

SEQ ID NO: 237602 - protein, 11 aa, Japanese encephalitis virus
LPLSRNSNHEM

SEQ ID NO: 237603 - protein, 11 aa, Japanese encephalitis virus
PLSRNSNHEMY

SEQ ID NO: 237604 - protein, 11 aa, Japanese encephalitis virus
LSRNSNHEMYW

SEQ ID NO: 237605 - protein, 11 aa, Japanese encephalitis virus
SRNSNHEMYWV

SEQ ID NO: 237606 - protein, 11 aa, Japanese encephalitis virus
RNSNHEMYWVS

SEQ ID NO: 237607 - protein, 11 aa, Japanese encephalitis virus
NSNHEMYWVSG

SEQ ID NO: 237608 - protein, 11 aa, Japanese encephalitis virus
SNHEMYWVSGA

SEQ ID NO: 237609 - protein, 11 aa, Japanese encephalitis virus
NHEMYWVSGAA

SEQ ID NO: 237610 - protein, 11 aa, Japanese encephalitis virus
HEMYWVSGAAG

SEQ ID NO: 237611 - protein, 11 aa, Japanese encephalitis virus
EMYWVSGAAGN

SEQ ID NO: 237612 - protein, 11 aa, Japanese encephalitis virus
MYWVSGAAGNV

SEQ ID NO: 237613 - protein, 11 aa, Japanese encephalitis virus
YWVSGAAGNVV

SEQ ID NO: 237614 - protein, 11 aa, Japanese encephalitis virus
WVSGAAGNVVH

SEQ ID NO: 237615 - protein, 11 aa, Japanese encephalitis virus
VSGAAGNVVHA

SEQ ID NO: 237616 - protein, 11 aa, Japanese encephalitis virus
SGAAGNVVHAV

SEQ ID NO: 237617 - protein, 11 aa, Japanese encephalitis virus
GAAGNVVHAVN

SEQ ID NO: 237618 - protein, 11 aa, Japanese encephalitis virus
AAGNVVHAVNM

SEQ ID NO: 237619 - protein, 11 aa, Japanese encephalitis virus
AGNVVHAVNMT

SEQ ID NO: 237620 - protein, 11 aa, Japanese encephalitis virus
GNVVHAVNMTS

SEQ ID NO: 237621 - protein, 11 aa, Japanese encephalitis virus
NVVHAVNMTSQ

SEQ ID NO: 237622 - protein, 11 aa, Japanese encephalitis virus
VVHAVNMTSQV

SEQ ID NO: 237623 - protein, 11 aa, Japanese encephalitis virus
VHAVNMTSQVL

SEQ ID NO: 237624 - protein, 11 aa, Japanese encephalitis virus
HAVNMTSQVLL

SEQ ID NO: 237625 - protein, 11 aa, Japanese encephalitis virus
AVNMTSQVLLG

SEQ ID NO: 237626 - protein, 11 aa, Japanese encephalitis virus
VNMTSQVLLGR

SEQ ID NO: 237627 - protein, 11 aa, Japanese encephalitis virus
NMTSQVLLGRM

SEQ ID NO: 237628 - protein, 11 aa, Japanese encephalitis virus
MTSQVLLGRMD

SEQ ID NO: 237629 - protein, 11 aa, Japanese encephalitis virus
TSQVLLGRMDR

SEQ ID NO: 237630 - protein, 11 aa, Japanese encephalitis virus
SQVLLGRMDRT

SEQ ID NO: 237631 - protein, 11 aa, Japanese encephalitis virus
QVLLGRMDRTV

SEQ ID NO: 237632 - protein, 11 aa, Japanese encephalitis virus
VLLGRMDRTVW

SEQ ID NO: 237633 - protein, 11 aa, Japanese encephalitis virus
LLGRMDRTVWR

SEQ ID NO: 237634 - protein, 11 aa, Japanese encephalitis virus
LGRMDRTVWRG

SEQ ID NO: 237635 - protein, 11 aa, Japanese encephalitis virus
GRMDRTVWRGP

SEQ ID NO: 237636 - protein, 11 aa, Japanese encephalitis virus
RMDRTVWRGPK

SEQ ID NO: 237637 - protein, 11 aa, Japanese encephalitis virus
MDRTVWRGPKY

SEQ ID NO: 237638 - protein, 11 aa, Japanese encephalitis virus
DRTVWRGPKYE

SEQ ID NO: 237639 - protein, 11 aa, Japanese encephalitis virus
RTVWRGPKYEE

SEQ ID NO: 237640 - protein, 11 aa, Japanese encephalitis virus
TVWRGPKYEED

SEQ ID NO: 237641 - protein, 11 aa, Japanese encephalitis virus
VWRGPKYEEDV

SEQ ID NO: 237642 - protein, 11 aa, Japanese encephalitis virus
WRGPKYEEDVN

SEQ ID NO: 237643 - protein, 11 aa, Japanese encephalitis virus
RGPKYEEDVNL

SEQ ID NO: 237644 - protein, 11 aa, Japanese encephalitis virus
GPKYEEDVNLG

SEQ ID NO: 237645 - protein, 11 aa, Japanese encephalitis virus
PKYEEDVNLGS

SEQ ID NO: 237646 - protein, 11 aa, Japanese encephalitis virus
KYEEDVNLGSG

SEQ ID NO: 237647 - protein, 11 aa, Japanese encephalitis virus
YEEDVNLGSGT

SEQ ID NO: 237648 - protein, 11 aa, Japanese encephalitis virus
EEDVNLGSGTR

SEQ ID NO: 237649 - protein, 11 aa, Japanese encephalitis virus
EDVNLGSGTRA

SEQ ID NO: 237650 - protein, 11 aa, Japanese encephalitis virus
DVNLGSGTRAV

SEQ ID NO: 237651 - protein, 11 aa, Japanese encephalitis virus
VNLGSGTRAVG

SEQ ID NO: 237652 - protein, 11 aa, Japanese encephalitis virus
NLGSGTRAVGK

SEQ ID NO: 237653 - protein, 11 aa, Japanese encephalitis virus
LGSGTRAVGKG

SEQ ID NO: 237654 - protein, 11 aa, Japanese encephalitis virus
GSGTRAVGKGE

SEQ ID NO: 237655 - protein, 11 aa, Japanese encephalitis virus
SGTRAVGKGEV

SEQ ID NO: 237656 - protein, 11 aa, Japanese encephalitis virus
GTRAVGKGEVH

SEQ ID NO: 237657 - protein, 11 aa, Japanese encephalitis virus
TRAVGKGEVHS

SEQ ID NO: 237658 - protein, 11 aa, Japanese encephalitis virus
RAVGKGEVHSN

SEQ ID NO: 237659 - protein, 11 aa, Japanese encephalitis virus
AVGKGEVHSNQ

SEQ ID NO: 237660 - protein, 11 aa, Japanese encephalitis virus
KIKKRIQKLKE

SEQ ID NO: 237661 - protein, 11 aa, Japanese encephalitis virus
KRIQKLKEEFA

SEQ ID NO: 237662 - protein, 11 aa, Japanese encephalitis virus
RIQKLKEEFAT

SEQ ID NO: 237663 - protein, 11 aa, Japanese encephalitis virus
IQKLKEEFATT

SEQ ID NO: 237664 - protein, 11 aa, Japanese encephalitis virus
QKLKEEFATTW

SEQ ID NO: 237665 - protein, 11 aa, Japanese encephalitis virus
KLKEEFATTWH

SEQ ID NO: 237666 - protein, 11 aa, Japanese encephalitis virus
KEEFATTWHKD

SEQ ID NO: 237667 - protein, 11 aa, Japanese encephalitis virus
EEFATTWHKDP

SEQ ID NO: 237668 - protein, 11 aa, Japanese encephalitis virus
EFATTWHKDPE

SEQ ID NO: 237669 - protein, 11 aa, Japanese encephalitis virus
FATTWHKDPEH

SEQ ID NO: 237670 - protein, 11 aa, Japanese encephalitis virus
ATTWHKDPEHP

SEQ ID NO: 237671 - protein, 11 aa, Japanese encephalitis virus
TTWHKDPEHPY

SEQ ID NO: 237672 - protein, 11 aa, Japanese encephalitis virus
TWHKDPEHPYR

SEQ ID NO: 237673 - protein, 11 aa, Japanese encephalitis virus
WHKDPEHPYRT

SEQ ID NO: 237674 - protein, 11 aa, Japanese encephalitis virus
HKDPEHPYRTW

SEQ ID NO: 237675 - protein, 11 aa, Japanese encephalitis virus
KDPEHPYRTWT

SEQ ID NO: 237676 - protein, 11 aa, Japanese encephalitis virus
DPEHPYRTWTY

SEQ ID NO: 237677 - protein, 11 aa, Japanese encephalitis virus
PEHPYRTWTYH

SEQ ID NO: 237678 - protein, 11 aa, Japanese encephalitis virus
EHPYRTWTYHG

SEQ ID NO: 237679 - protein, 11 aa, Japanese encephalitis virus
HPYRTWTYHGS

SEQ ID NO: 237680 - protein, 11 aa, Japanese encephalitis virus
PYRTWTYHGSY

SEQ ID NO: 237681 - protein, 11 aa, Japanese encephalitis virus
YRTWTYHGSYE

SEQ ID NO: 237682 - protein, 11 aa, Japanese encephalitis virus
RTWTYHGSYEV

SEQ ID NO: 237683 - protein, 11 aa, Japanese encephalitis virus
TWTYHGSYEVK

SEQ ID NO: 237684 - protein, 11 aa, Japanese encephalitis virus
WTYHGSYEVKA

SEQ ID NO: 237685 - protein, 11 aa, Japanese encephalitis virus
TYHGSYEVKAT

SEQ ID NO: 237686 - protein, 11 aa, Japanese encephalitis virus
YHGSYEVKATG

SEQ ID NO: 237687 - protein, 11 aa, Japanese encephalitis virus
HGSYEVKATGS

SEQ ID NO: 237688 - protein, 11 aa, Japanese encephalitis virus
GSYEVKATGSA

SEQ ID NO: 237689 - protein, 11 aa, Japanese encephalitis virus
SYEVKATGSAS

SEQ ID NO: 237690 - protein, 11 aa, Japanese encephalitis virus
YEVKATGSASS

SEQ ID NO: 237691 - protein, 11 aa, Japanese encephalitis virus
EVKATGSASSL

SEQ ID NO: 237692 - protein, 11 aa, Japanese encephalitis virus
VKATGSASSLV

SEQ ID NO: 237693 - protein, 11 aa, Japanese encephalitis virus
KATGSASSLVN

SEQ ID NO: 237694 - protein, 11 aa, Japanese encephalitis virus
ATGSASSLVNG

SEQ ID NO: 237695 - protein, 11 aa, Japanese encephalitis virus
TGSASSLVNGV

SEQ ID NO: 237696 - protein, 11 aa, Japanese encephalitis virus
GSASSLVNGVV

SEQ ID NO: 237697 - protein, 11 aa, Japanese encephalitis virus
SASSLVNGVVK

SEQ ID NO: 237698 - protein, 11 aa, Japanese encephalitis virus
ASSLVNGVVKL

SEQ ID NO: 237699 - protein, 11 aa, Japanese encephalitis virus
SSLVNGVVKLM

SEQ ID NO: 237700 - protein, 11 aa, Japanese encephalitis virus
SLVNGVVKLMS

SEQ ID NO: 237701 - protein, 11 aa, Japanese encephalitis virus
LVNGVVKLMSK

SEQ ID NO: 237702 - protein, 11 aa, Japanese encephalitis virus
VNGVVKLMSKP

SEQ ID NO: 237703 - protein, 11 aa, Japanese encephalitis virus
NGVVKLMSKPW

SEQ ID NO: 237704 - protein, 11 aa, Japanese encephalitis virus
GVVKLMSKPWD

SEQ ID NO: 237705 - protein, 11 aa, Japanese encephalitis virus
VVKLMSKPWDA

SEQ ID NO: 237706 - protein, 11 aa, Japanese encephalitis virus
VKLMSKPWDAI

SEQ ID NO: 237707 - protein, 11 aa, Japanese encephalitis virus
KLMSKPWDAIA

SEQ ID NO: 237708 - protein, 11 aa, Japanese encephalitis virus
LMSKPWDAIAN

SEQ ID NO: 237709 - protein, 11 aa, Japanese encephalitis virus
MSKPWDAIANV

SEQ ID NO: 237710 - protein, 11 aa, Japanese encephalitis virus
SKPWDAIANVT

SEQ ID NO: 237711 - protein, 11 aa, Japanese encephalitis virus
KPWDAIANVTT

SEQ ID NO: 237712 - protein, 11 aa, Japanese encephalitis virus
PWDAIANVTTM

SEQ ID NO: 237713 - protein, 11 aa, Japanese encephalitis virus
WDAIANVTTMA

SEQ ID NO: 237714 - protein, 11 aa, Japanese encephalitis virus
DAIANVTTMAM

SEQ ID NO: 237715 - protein, 11 aa, Japanese encephalitis virus
AIANVTTMAMT

SEQ ID NO: 237716 - protein, 11 aa, Japanese encephalitis virus
IANVTTMAMTD

SEQ ID NO: 237717 - protein, 11 aa, Japanese encephalitis virus
ANVTTMAMTDT

SEQ ID NO: 237718 - protein, 11 aa, Japanese encephalitis virus
NVTTMAMTDTT

SEQ ID NO: 237719 - protein, 11 aa, Japanese encephalitis virus
VTTMAMTDTTP

SEQ ID NO: 237720 - protein, 11 aa, Japanese encephalitis virus
TTMAMTDTTPF

SEQ ID NO: 237721 - protein, 11 aa, Japanese encephalitis virus
TMAMTDTTPFG

SEQ ID NO: 237722 - protein, 11 aa, Japanese encephalitis virus
MAMTDTTPFGQ

SEQ ID NO: 237723 - protein, 11 aa, Japanese encephalitis virus
AMTDTTPFGQQ

SEQ ID NO: 237724 - protein, 11 aa, Japanese encephalitis virus
MTDTTPFGQQR

SEQ ID NO: 237725 - protein, 11 aa, Japanese encephalitis virus
TDTTPFGQQRV

SEQ ID NO: 237726 - protein, 11 aa, Japanese encephalitis virus
DTTPFGQQRVF

SEQ ID NO: 237727 - protein, 11 aa, Japanese encephalitis virus
TTPFGQQRVFK

SEQ ID NO: 237728 - protein, 11 aa, Japanese encephalitis virus
TPFGQQRVFKE

SEQ ID NO: 237729 - protein, 11 aa, Japanese encephalitis virus
PFGQQRVFKEK

SEQ ID NO: 237730 - protein, 11 aa, Japanese encephalitis virus
FGQQRVFKEKV

SEQ ID NO: 237731 - protein, 11 aa, Japanese encephalitis virus
GQQRVFKEKVD

SEQ ID NO: 237732 - protein, 11 aa, Japanese encephalitis virus
QQRVFKEKVDT

SEQ ID NO: 237733 - protein, 11 aa, Japanese encephalitis virus
QRVFKEKVDTK

SEQ ID NO: 237734 - protein, 11 aa, Japanese encephalitis virus
RVFKEKVDTKA

SEQ ID NO: 237735 - protein, 11 aa, Japanese encephalitis virus
VFKEKVDTKAP

SEQ ID NO: 237736 - protein, 11 aa, Japanese encephalitis virus
FKEKVDTKAPE

SEQ ID NO: 237737 - protein, 11 aa, Japanese encephalitis virus
KEKVDTKAPEP

SEQ ID NO: 237738 - protein, 11 aa, Japanese encephalitis virus
EKVDTKAPEPP

SEQ ID NO: 237739 - protein, 11 aa, Japanese encephalitis virus
GAKEVLNETTN

SEQ ID NO: 237740 - protein, 11 aa, Japanese encephalitis virus
AKEVLNETTNW

SEQ ID NO: 237741 - protein, 11 aa, Japanese encephalitis virus
KEVLNETTNWL

SEQ ID NO: 237742 - protein, 11 aa, Japanese encephalitis virus
EVLNETTNWLW

SEQ ID NO: 237743 - protein, 11 aa, Japanese encephalitis virus
VLNETTNWLWA

SEQ ID NO: 237744 - protein, 11 aa, Japanese encephalitis virus
LNETTNWLWAH

SEQ ID NO: 237745 - protein, 11 aa, Japanese encephalitis virus
NETTNWLWAHL

SEQ ID NO: 237746 - protein, 11 aa, Japanese encephalitis virus
ETTNWLWAHLS

SEQ ID NO: 237747 - protein, 11 aa, Japanese encephalitis virus
TTNWLWAHLSR

SEQ ID NO: 237748 - protein, 11 aa, Japanese encephalitis virus
TNWLWAHLSRE

SEQ ID NO: 237749 - protein, 11 aa, Japanese encephalitis virus
NWLWAHLSREK

SEQ ID NO: 237750 - protein, 11 aa, Japanese encephalitis virus
WLWAHLSREKR

SEQ ID NO: 237751 - protein, 11 aa, Japanese encephalitis virus
LWAHLSREKRP

SEQ ID NO: 237752 - protein, 11 aa, Japanese encephalitis virus
WAHLSREKRPR

SEQ ID NO: 237753 - protein, 11 aa, Japanese encephalitis virus
AHLSREKRPRL

SEQ ID NO: 237754 - protein, 11 aa, Japanese encephalitis virus
HLSREKRPRLC

SEQ ID NO: 237755 - protein, 11 aa, Japanese encephalitis virus
LSREKRPRLCT

SEQ ID NO: 237756 - protein, 11 aa, Japanese encephalitis virus
SREKRPRLCTK

SEQ ID NO: 237757 - protein, 11 aa, Japanese encephalitis virus
REKRPRLCTKE

SEQ ID NO: 237758 - protein, 11 aa, Japanese encephalitis virus
EKRPRLCTKEE

SEQ ID NO: 237759 - protein, 11 aa, Japanese encephalitis virus
KRPRLCTKEEF

SEQ ID NO: 237760 - protein, 11 aa, Japanese encephalitis virus
RPRLCTKEEFI

SEQ ID NO: 237761 - protein, 11 aa, Japanese encephalitis virus
PRLCTKEEFIK

SEQ ID NO: 237762 - protein, 11 aa, Japanese encephalitis virus
RLCTKEEFIKK

SEQ ID NO: 237763 - protein, 11 aa, Japanese encephalitis virus
LCTKEEFIKKV

SEQ ID NO: 237764 - protein, 11 aa, Japanese encephalitis virus
CTKEEFIKKVN

SEQ ID NO: 237765 - protein, 11 aa, Japanese encephalitis virus
TKEEFIKKVNS

SEQ ID NO: 237766 - protein, 11 aa, Japanese encephalitis virus
KEEFIKKVNSN

SEQ ID NO: 237767 - protein, 11 aa, Japanese encephalitis virus
EEFIKKVNSNA

SEQ ID NO: 237768 - protein, 11 aa, Japanese encephalitis virus
KVNSNAALGAV

SEQ ID NO: 237769 - protein, 11 aa, Japanese encephalitis virus
VNSNAALGAVF

SEQ ID NO: 237770 - protein, 11 aa, Japanese encephalitis virus
NSNAALGAVFA

SEQ ID NO: 237771 - protein, 11 aa, Japanese encephalitis virus
SNAALGAVFAE

SEQ ID NO: 237772 - protein, 11 aa, Japanese encephalitis virus
NAALGAVFAEQ

SEQ ID NO: 237773 - protein, 11 aa, Japanese encephalitis virus
AALGAVFAEQN

SEQ ID NO: 237774 - protein, 11 aa, Japanese encephalitis virus
ALGAVFAEQNQ

SEQ ID NO: 237775 - protein, 11 aa, Japanese encephalitis virus
LGAVFAEQNQW

SEQ ID NO: 237776 - protein, 11 aa, Japanese encephalitis virus
GAVFAEQNQWS

SEQ ID NO: 237777 - protein, 11 aa, Japanese encephalitis virus
AVFAEQNQWST

SEQ ID NO: 237778 - protein, 11 aa, Japanese encephalitis virus
VFAEQNQWSTA

SEQ ID NO: 237779 - protein, 11 aa, Japanese encephalitis virus
FAEQNQWSTAR

SEQ ID NO: 237780 - protein, 11 aa, Japanese encephalitis virus
AEQNQWSTARE

SEQ ID NO: 237781 - protein, 11 aa, Japanese encephalitis virus
EQNQWSTAREA

SEQ ID NO: 237782 - protein, 11 aa, Japanese encephalitis virus
QNQWSTAREAV

SEQ ID NO: 237783 - protein, 11 aa, Japanese encephalitis virus
NQWSTAREAVD

SEQ ID NO: 237784 - protein, 11 aa, Japanese encephalitis virus
QWSTAREAVDD

SEQ ID NO: 237785 - protein, 11 aa, Japanese encephalitis virus
WSTAREAVDDP

SEQ ID NO: 237786 - protein, 11 aa, Japanese encephalitis virus
FWEMVDEEREN

SEQ ID NO: 237787 - protein, 11 aa, Japanese encephalitis virus
WEMVDEERENH

SEQ ID NO: 237788 - protein, 11 aa, Japanese encephalitis virus
EMVDEERENHL

SEQ ID NO: 237789 - protein, 11 aa, Japanese encephalitis virus
MVDEERENHLR

SEQ ID NO: 237790 - protein, 11 aa, Japanese encephalitis virus
VDEERENHLRG

SEQ ID NO: 237791 - protein, 11 aa, Japanese encephalitis virus
DEERENHLRGE

SEQ ID NO: 237792 - protein, 11 aa, Japanese encephalitis virus
EERENHLRGEC

SEQ ID NO: 237793 - protein, 11 aa, Japanese encephalitis virus
ERENHLRGECH

SEQ ID NO: 237794 - protein, 11 aa, Japanese encephalitis virus
RENHLRGECHT

SEQ ID NO: 237795 - protein, 11 aa, Japanese encephalitis virus
ENHLRGECHTC

SEQ ID NO: 237796 - protein, 11 aa, Japanese encephalitis virus
NHLRGECHTCI

SEQ ID NO: 237797 - protein, 11 aa, Japanese encephalitis virus
HLRGECHTCIY

SEQ ID NO: 237798 - protein, 11 aa, Japanese encephalitis virus
LRGECHTCIYN

SEQ ID NO: 237799 - protein, 11 aa, Japanese encephalitis virus
RGECHTCIYNM

SEQ ID NO: 237800 - protein, 11 aa, Japanese encephalitis virus
GECHTCIYNMM

SEQ ID NO: 237801 - protein, 11 aa, Japanese encephalitis virus
ECHTCIYNMMG

SEQ ID NO: 237802 - protein, 11 aa, Japanese encephalitis virus
CHTCIYNMMGK

SEQ ID NO: 237803 - protein, 11 aa, Japanese encephalitis virus
HTCIYNMMGKR

SEQ ID NO: 237804 - protein, 11 aa, Japanese encephalitis virus
TCIYNMMGKRE

SEQ ID NO: 237805 - protein, 11 aa, Japanese encephalitis virus
CIYNMMGKREK

SEQ ID NO: 237806 - protein, 11 aa, Japanese encephalitis virus
IYNMMGKREKK

SEQ ID NO: 237807 - protein, 11 aa, Japanese encephalitis virus
YNMMGKREKKP

SEQ ID NO: 237808 - protein, 11 aa, Japanese encephalitis virus
NMMGKREKKPG

SEQ ID NO: 237809 - protein, 11 aa, Japanese encephalitis virus
MMGKREKKPGE

SEQ ID NO: 237810 - protein, 11 aa, Japanese encephalitis virus
MGKREKKPGEF

SEQ ID NO: 237811 - protein, 11 aa, Japanese encephalitis virus
GKREKKPGEFG

SEQ ID NO: 237812 - protein, 11 aa, Japanese encephalitis virus
KREKKPGEFGK

SEQ ID NO: 237813 - protein, 11 aa, Japanese encephalitis virus
REKKPGEFGKA

SEQ ID NO: 237814 - protein, 11 aa, Japanese encephalitis virus
EKKPGEFGKAK

SEQ ID NO: 237815 - protein, 11 aa, Japanese encephalitis virus
KKPGEFGKAKG

SEQ ID NO: 237816 - protein, 11 aa, Japanese encephalitis virus
KPGEFGKAKGS

SEQ ID NO: 237817 - protein, 11 aa, Japanese encephalitis virus
PGEFGKAKGSR

SEQ ID NO: 237818 - protein, 11 aa, Japanese encephalitis virus
GEFGKAKGSRA

SEQ ID NO: 237819 - protein, 11 aa, Japanese encephalitis virus
EFGKAKGSRAI

SEQ ID NO: 237820 - protein, 11 aa, Japanese encephalitis virus
FGKAKGSRAIW

SEQ ID NO: 237821 - protein, 11 aa, Japanese encephalitis virus
GKAKGSRAIWF

SEQ ID NO: 237822 - protein, 11 aa, Japanese encephalitis virus
KAKGSRAIWFM

SEQ ID NO: 237823 - protein, 11 aa, Japanese encephalitis virus
AKGSRAIWFMW

SEQ ID NO: 237824 - protein, 11 aa, Japanese encephalitis virus
KGSRAIWFMWL

SEQ ID NO: 237825 - protein, 11 aa, Japanese encephalitis virus
GSRAIWFMWLG

SEQ ID NO: 237826 - protein, 11 aa, Japanese encephalitis virus
SRAIWFMWLGA

SEQ ID NO: 237827 - protein, 11 aa, Japanese encephalitis virus
RAIWFMWLGAR

SEQ ID NO: 237828 - protein, 11 aa, Japanese encephalitis virus
AIWFMWLGARY

SEQ ID NO: 237829 - protein, 11 aa, Japanese encephalitis virus
IWFMWLGARYL

SEQ ID NO: 237830 - protein, 11 aa, Japanese encephalitis virus
WFMWLGARYLE

SEQ ID NO: 237831 - protein, 11 aa, Japanese encephalitis virus
FMWLGARYLEF

SEQ ID NO: 237832 - protein, 11 aa, Japanese encephalitis virus
MWLGARYLEFE

SEQ ID NO: 237833 - protein, 11 aa, Japanese encephalitis virus
WLGARYLEFEA

SEQ ID NO: 237834 - protein, 11 aa, Japanese encephalitis virus
LGARYLEFEAL

SEQ ID NO: 237835 - protein, 11 aa, Japanese encephalitis virus
GARYLEFEALG

SEQ ID NO: 237836 - protein, 11 aa, Japanese encephalitis virus
ARYLEFEALGF

SEQ ID NO: 237837 - protein, 11 aa, Japanese encephalitis virus
RYLEFEALGFL

SEQ ID NO: 237838 - protein, 11 aa, Japanese encephalitis virus
YLEFEALGFLN

SEQ ID NO: 237839 - protein, 11 aa, Japanese encephalitis virus
LEFEALGFLNE

SEQ ID NO: 237840 - protein, 11 aa, Japanese encephalitis virus
EFEALGFLNED

SEQ ID NO: 237841 - protein, 11 aa, Japanese encephalitis virus
FEALGFLNEDH

SEQ ID NO: 237842 - protein, 11 aa, Japanese encephalitis virus
EALGFLNEDHW

SEQ ID NO: 237843 - protein, 11 aa, Japanese encephalitis virus
ALGFLNEDHWL

SEQ ID NO: 237844 - protein, 11 aa, Japanese encephalitis virus
LGFLNEDHWLS

SEQ ID NO: 237845 - protein, 11 aa, Japanese encephalitis virus
GFLNEDHWLSR

SEQ ID NO: 237846 - protein, 11 aa, Japanese encephalitis virus
FLNEDHWLSRE

SEQ ID NO: 237847 - protein, 11 aa, Japanese encephalitis virus
LNEDHWLSREN

SEQ ID NO: 237848 - protein, 11 aa, Japanese encephalitis virus
NEDHWLSRENS

SEQ ID NO: 237849 - protein, 11 aa, Japanese encephalitis virus
EDHWLSRENSG

SEQ ID NO: 237850 - protein, 11 aa, Japanese encephalitis virus
DHWLSRENSGG

SEQ ID NO: 237851 - protein, 11 aa, Japanese encephalitis virus
HWLSRENSGGG

SEQ ID NO: 237852 - protein, 11 aa, Japanese encephalitis virus
WLSRENSGGGV

SEQ ID NO: 237853 - protein, 11 aa, Japanese encephalitis virus
LSRENSGGGVE

SEQ ID NO: 237854 - protein, 11 aa, Japanese encephalitis virus
SRENSGGGVEG

SEQ ID NO: 237855 - protein, 11 aa, Japanese encephalitis virus
RENSGGGVEGS

SEQ ID NO: 237856 - protein, 11 aa, Japanese encephalitis virus
NSGGGVEGSGV

SEQ ID NO: 237857 - protein, 11 aa, Japanese encephalitis virus
SGGGVEGSGVQ

SEQ ID NO: 237858 - protein, 11 aa, Japanese encephalitis virus
GGGVEGSGVQK

SEQ ID NO: 237859 - protein, 11 aa, Japanese encephalitis virus
GGVEGSGVQKL

SEQ ID NO: 237860 - protein, 11 aa, Japanese encephalitis virus
GVEGSGVQKLG

SEQ ID NO: 237861 - protein, 11 aa, Japanese encephalitis virus
VEGSGVQKLGY

SEQ ID NO: 237862 - protein, 11 aa, Japanese encephalitis virus
EGSGVQKLGYI

SEQ ID NO: 237863 - protein, 11 aa, Japanese encephalitis virus
GVQKLGYILRD

SEQ ID NO: 237864 - protein, 11 aa, Japanese encephalitis virus
VQKLGYILRDI

SEQ ID NO: 237865 - protein, 11 aa, Japanese encephalitis virus
QKLGYILRDIA

SEQ ID NO: 237866 - protein, 11 aa, Japanese encephalitis virus
RDIAGKQGGKM

SEQ ID NO: 237867 - protein, 11 aa, Japanese encephalitis virus
DIAGKQGGKMY

SEQ ID NO: 237868 - protein, 11 aa, Japanese encephalitis virus
IAGKQGGKMYA

SEQ ID NO: 237869 - protein, 11 aa, Japanese encephalitis virus
AGKQGGKMYAD

SEQ ID NO: 237870 - protein, 11 aa, Japanese encephalitis virus
GKQGGKMYADD

SEQ ID NO: 237871 - protein, 11 aa, Japanese encephalitis virus
KQGGKMYADDT

SEQ ID NO: 237872 - protein, 11 aa, Japanese encephalitis virus
QGGKMYADDTA

SEQ ID NO: 237873 - protein, 11 aa, Japanese encephalitis virus
GGKMYADDTAG

SEQ ID NO: 237874 - protein, 11 aa, Japanese encephalitis virus
GKMYADDTAGW

SEQ ID NO: 237875 - protein, 11 aa, Japanese encephalitis virus
KMYADDTAGWD

SEQ ID NO: 237876 - protein, 11 aa, Japanese encephalitis virus
MYADDTAGWDT

SEQ ID NO: 237877 - protein, 11 aa, Japanese encephalitis virus
YADDTAGWDTR

SEQ ID NO: 237878 - protein, 11 aa, Japanese encephalitis virus
ADDTAGWDTRI

SEQ ID NO: 237879 - protein, 11 aa, Japanese encephalitis virus
DDTAGWDTRIT

SEQ ID NO: 237880 - protein, 11 aa, Japanese encephalitis virus
DTAGWDTRITR

SEQ ID NO: 237881 - protein, 11 aa, Japanese encephalitis virus
TAGWDTRITRT

SEQ ID NO: 237882 - protein, 11 aa, Japanese encephalitis virus
AGWDTRITRTD

SEQ ID NO: 237883 - protein, 11 aa, Japanese encephalitis virus
GWDTRITRTDL

SEQ ID NO: 237884 - protein, 11 aa, Japanese encephalitis virus
WDTRITRTDLE

SEQ ID NO: 237885 - protein, 11 aa, Japanese encephalitis virus
DTRITRTDLEN

SEQ ID NO: 237886 - protein, 11 aa, Japanese encephalitis virus
TRITRTDLENE

SEQ ID NO: 237887 - protein, 11 aa, Japanese encephalitis virus
RITRTDLENEA

SEQ ID NO: 237888 - protein, 11 aa, Japanese encephalitis virus
ITRTDLENEAK

SEQ ID NO: 237889 - protein, 11 aa, Japanese encephalitis virus
TRTDLENEAKV

SEQ ID NO: 237890 - protein, 11 aa, Japanese encephalitis virus
RTDLENEAKVL

SEQ ID NO: 237891 - protein, 11 aa, Japanese encephalitis virus
TDLENEAKVLE

SEQ ID NO: 237892 - protein, 11 aa, Japanese encephalitis virus
DLENEAKVLEL

SEQ ID NO: 237893 - protein, 11 aa, Japanese encephalitis virus
LENEAKVLELL

SEQ ID NO: 237894 - protein, 11 aa, Japanese encephalitis virus
ENEAKVLELLD

SEQ ID NO: 237895 - protein, 11 aa, Japanese encephalitis virus
NEAKVLELLDG

SEQ ID NO: 237896 - protein, 11 aa, Japanese encephalitis virus
EAKVLELLDGE

SEQ ID NO: 237897 - protein, 11 aa, Japanese encephalitis virus
AKVLELLDGEH

SEQ ID NO: 237898 - protein, 11 aa, Japanese encephalitis virus
KVLELLDGEHR

SEQ ID NO: 237899 - protein, 11 aa, Japanese encephalitis virus
VLELLDGEHRM

SEQ ID NO: 237900 - protein, 11 aa, Japanese encephalitis virus
LELLDGEHRML

SEQ ID NO: 237901 - protein, 11 aa, Japanese encephalitis virus
ELLDGEHRMLA

SEQ ID NO: 237902 - protein, 11 aa, Japanese encephalitis virus
LLDGEHRMLAR

SEQ ID NO: 237903 - protein, 11 aa, Japanese encephalitis virus
LDGEHRMLARA

SEQ ID NO: 237904 - protein, 11 aa, Japanese encephalitis virus
DGEHRMLARAI

SEQ ID NO: 237905 - protein, 11 aa, Japanese encephalitis virus
GEHRMLARAII

SEQ ID NO: 237906 - protein, 11 aa, Japanese encephalitis virus
EHRMLARAIIE

SEQ ID NO: 237907 - protein, 11 aa, Japanese encephalitis virus
HRMLARAIIEL

SEQ ID NO: 237908 - protein, 11 aa, Japanese encephalitis virus
RMLARAIIELT

SEQ ID NO: 237909 - protein, 11 aa, Japanese encephalitis virus
MLARAIIELTY

SEQ ID NO: 237910 - protein, 11 aa, Japanese encephalitis virus
LARAIIELTYR

SEQ ID NO: 237911 - protein, 11 aa, Japanese encephalitis virus
ARAIIELTYRH

SEQ ID NO: 237912 - protein, 11 aa, Japanese encephalitis virus
RAIIELTYRHK

SEQ ID NO: 237913 - protein, 11 aa, Japanese encephalitis virus
AIIELTYRHKV

SEQ ID NO: 237914 - protein, 11 aa, Japanese encephalitis virus
IIELTYRHKVV

SEQ ID NO: 237915 - protein, 11 aa, Japanese encephalitis virus
IELTYRHKVVK

SEQ ID NO: 237916 - protein, 11 aa, Japanese encephalitis virus
ELTYRHKVVKV

SEQ ID NO: 237917 - protein, 11 aa, Japanese encephalitis virus
LTYRHKVVKVM

SEQ ID NO: 237918 - protein, 11 aa, Japanese encephalitis virus
TYRHKVVKVMR

SEQ ID NO: 237919 - protein, 11 aa, Japanese encephalitis virus
YRHKVVKVMRP

SEQ ID NO: 237920 - protein, 11 aa, Japanese encephalitis virus
RHKVVKVMRPA

SEQ ID NO: 237921 - protein, 11 aa, Japanese encephalitis virus
HKVVKVMRPAA

SEQ ID NO: 237922 - protein, 11 aa, Japanese encephalitis virus
KVMRPAAEGKT

SEQ ID NO: 237923 - protein, 11 aa, Japanese encephalitis virus
VMRPAAEGKTV

SEQ ID NO: 237924 - protein, 11 aa, Japanese encephalitis virus
MRPAAEGKTVM

SEQ ID NO: 237925 - protein, 11 aa, Japanese encephalitis virus
EGKTVMDVISR

SEQ ID NO: 237926 - protein, 11 aa, Japanese encephalitis virus
GKTVMDVISRE

SEQ ID NO: 237927 - protein, 11 aa, Japanese encephalitis virus
KTVMDVISRED

SEQ ID NO: 237928 - protein, 11 aa, Japanese encephalitis virus
TVMDVISREDQ

SEQ ID NO: 237929 - protein, 11 aa, Japanese encephalitis virus
VMDVISREDQR

SEQ ID NO: 237930 - protein, 11 aa, Japanese encephalitis virus
MDVISREDQRG

SEQ ID NO: 237931 - protein, 11 aa, Japanese encephalitis virus
DVISREDQRGS

SEQ ID NO: 237932 - protein, 11 aa, Japanese encephalitis virus
VISREDQRGSG

SEQ ID NO: 237933 - protein, 11 aa, Japanese encephalitis virus
ISREDQRGSGQ

SEQ ID NO: 237934 - protein, 11 aa, Japanese encephalitis virus
SREDQRGSGQV

SEQ ID NO: 237935 - protein, 11 aa, Japanese encephalitis virus
REDQRGSGQVV

SEQ ID NO: 237936 - protein, 11 aa, Japanese encephalitis virus
EDQRGSGQVVT

SEQ ID NO: 237937 - protein, 11 aa, Japanese encephalitis virus
DQRGSGQVVTY

SEQ ID NO: 237938 - protein, 11 aa, Japanese encephalitis virus
QRGSGQVVTYA

SEQ ID NO: 237939 - protein, 11 aa, Japanese encephalitis virus
RGSGQVVTYAL

SEQ ID NO: 237940 - protein, 11 aa, Japanese encephalitis virus
GSGQVVTYALN

SEQ ID NO: 237941 - protein, 11 aa, Japanese encephalitis virus
SGQVVTYALNT

SEQ ID NO: 237942 - protein, 11 aa, Japanese encephalitis virus
GQVVTYALNTF

SEQ ID NO: 237943 - protein, 11 aa, Japanese encephalitis virus
QVVTYALNTFT

SEQ ID NO: 237944 - protein, 11 aa, Japanese encephalitis virus
VVTYALNTFTN

SEQ ID NO: 237945 - protein, 11 aa, Japanese encephalitis virus
VTYALNTFTNI

SEQ ID NO: 237946 - protein, 11 aa, Japanese encephalitis virus
TYALNTFTNIA

SEQ ID NO: 237947 - protein, 11 aa, Japanese encephalitis virus
YALNTFTNIAV

SEQ ID NO: 237948 - protein, 11 aa, Japanese encephalitis virus
ALNTFTNIAVQ

SEQ ID NO: 237949 - protein, 11 aa, Japanese encephalitis virus
LNTFTNIAVQL

SEQ ID NO: 237950 - protein, 11 aa, Japanese encephalitis virus
NTFTNIAVQLV

SEQ ID NO: 237951 - protein, 11 aa, Japanese encephalitis virus
TFTNIAVQLVR

SEQ ID NO: 237952 - protein, 11 aa, Japanese encephalitis virus
FTNIAVQLVRL

SEQ ID NO: 237953 - protein, 11 aa, Japanese encephalitis virus
TNIAVQLVRLM

SEQ ID NO: 237954 - protein, 11 aa, Japanese encephalitis virus
NIAVQLVRLME

SEQ ID NO: 237955 - protein, 11 aa, Japanese encephalitis virus
IAVQLVRLMEA

SEQ ID NO: 237956 - protein, 11 aa, Japanese encephalitis virus
AVQLVRLMEAE

SEQ ID NO: 237957 - protein, 11 aa, Japanese encephalitis virus
VQLVRLMEAEG

SEQ ID NO: 237958 - protein, 11 aa, Japanese encephalitis virus
QLVRLMEAEGV

SEQ ID NO: 237959 - protein, 11 aa, Japanese encephalitis virus
LVRLMEAEGVI

SEQ ID NO: 237960 - protein, 11 aa, Japanese encephalitis virus
VRLMEAEGVIG

SEQ ID NO: 237961 - protein, 11 aa, Japanese encephalitis virus
RLMEAEGVIGP

SEQ ID NO: 237962 - protein, 11 aa, Japanese encephalitis virus
LMEAEGVIGPQ

SEQ ID NO: 237963 - protein, 11 aa, Japanese encephalitis virus
MEAEGVIGPQH

SEQ ID NO: 237964 - protein, 11 aa, Japanese encephalitis virus
EAEGVIGPQHL

SEQ ID NO: 237965 - protein, 11 aa, Japanese encephalitis virus
AEGVIGPQHLE

SEQ ID NO: 237966 - protein, 11 aa, Japanese encephalitis virus
EGVIGPQHLEQ

SEQ ID NO: 237967 - protein, 11 aa, Japanese encephalitis virus
GVIGPQHLEQL

SEQ ID NO: 237968 - protein, 11 aa, Japanese encephalitis virus
VIGPQHLEQLP

SEQ ID NO: 237969 - protein, 11 aa, Japanese encephalitis virus
IGPQHLEQLPR

SEQ ID NO: 237970 - protein, 11 aa, Japanese encephalitis virus
GPQHLEQLPRK

SEQ ID NO: 237971 - protein, 11 aa, Japanese encephalitis virus
EQLPRKNKIAV

SEQ ID NO: 237972 - protein, 11 aa, Japanese encephalitis virus
QLPRKNKIAVR

SEQ ID NO: 237973 - protein, 11 aa, Japanese encephalitis virus
LPRKNKIAVRT

SEQ ID NO: 237974 - protein, 11 aa, Japanese encephalitis virus
PRKNKIAVRTW

SEQ ID NO: 237975 - protein, 11 aa, Japanese encephalitis virus
RKNKIAVRTWL

SEQ ID NO: 237976 - protein, 11 aa, Japanese encephalitis virus
KNKIAVRTWLF

SEQ ID NO: 237977 - protein, 11 aa, Japanese encephalitis virus
NKIAVRTWLFE

SEQ ID NO: 237978 - protein, 11 aa, Japanese encephalitis virus
KIAVRTWLFEN

SEQ ID NO: 237979 - protein, 11 aa, Japanese encephalitis virus
IAVRTWLFENG

SEQ ID NO: 237980 - protein, 11 aa, Japanese encephalitis virus
AVRTWLFENGE

SEQ ID NO: 237981 - protein, 11 aa, Japanese encephalitis virus
VRTWLFENGEE

SEQ ID NO: 237982 - protein, 11 aa, Japanese encephalitis virus
RTWLFENGEER

SEQ ID NO: 237983 - protein, 11 aa, Japanese encephalitis virus
TWLFENGEERV

SEQ ID NO: 237984 - protein, 11 aa, Japanese encephalitis virus
WLFENGEERVT

SEQ ID NO: 237985 - protein, 11 aa, Japanese encephalitis virus
LFENGEERVTR

SEQ ID NO: 237986 - protein, 11 aa, Japanese encephalitis virus
FENGEERVTRM

SEQ ID NO: 237987 - protein, 11 aa, Japanese encephalitis virus
ENGEERVTRMA

SEQ ID NO: 237988 - protein, 11 aa, Japanese encephalitis virus
NGEERVTRMAI

SEQ ID NO: 237989 - protein, 11 aa, Japanese encephalitis virus
GEERVTRMAIS

SEQ ID NO: 237990 - protein, 11 aa, Japanese encephalitis virus
EERVTRMAISG

SEQ ID NO: 237991 - protein, 11 aa, Japanese encephalitis virus
ERVTRMAISGD

SEQ ID NO: 237992 - protein, 11 aa, Japanese encephalitis virus
RVTRMAISGDD

SEQ ID NO: 237993 - protein, 11 aa, Japanese encephalitis virus
VTRMAISGDDC

SEQ ID NO: 237994 - protein, 11 aa, Japanese encephalitis virus
TRMAISGDDCV

SEQ ID NO: 237995 - protein, 11 aa, Japanese encephalitis virus
RMAISGDDCVV

SEQ ID NO: 237996 - protein, 11 aa, Japanese encephalitis virus
MAISGDDCVVK

SEQ ID NO: 237997 - protein, 11 aa, Japanese encephalitis virus
AISGDDCVVKP

SEQ ID NO: 237998 - protein, 11 aa, Japanese encephalitis virus
ISGDDCVVKPL

SEQ ID NO: 237999 - protein, 11 aa, Japanese encephalitis virus
SGDDCVVKPLD

SEQ ID NO: 238000 - protein, 11 aa, Japanese encephalitis virus
GDDCVVKPLDD

SEQ ID NO: 238001 - protein, 11 aa, Japanese encephalitis virus
DDCVVKPLDDR

SEQ ID NO: 238002 - protein, 11 aa, Japanese encephalitis virus
DCVVKPLDDRF

SEQ ID NO: 238003 - protein, 11 aa, Japanese encephalitis virus
CVVKPLDDRFA

SEQ ID NO: 238004 - protein, 11 aa, Japanese encephalitis virus
VVKPLDDRFAT

SEQ ID NO: 238005 - protein, 11 aa, Japanese encephalitis virus
VKPLDDRFATA

SEQ ID NO: 238006 - protein, 11 aa, Japanese encephalitis virus
KPLDDRFATAL

SEQ ID NO: 238007 - protein, 11 aa, Japanese encephalitis virus
PLDDRFATALH

SEQ ID NO: 238008 - protein, 11 aa, Japanese encephalitis virus
LDDRFATALHF

SEQ ID NO: 238009 - protein, 11 aa, Japanese encephalitis virus
DDRFATALHFL

SEQ ID NO: 238010 - protein, 11 aa, Japanese encephalitis virus
DRFATALHFLN

SEQ ID NO: 238011 - protein, 11 aa, Japanese encephalitis virus
RFATALHFLNA

SEQ ID NO: 238012 - protein, 11 aa, Japanese encephalitis virus
FATALHFLNAM

SEQ ID NO: 238013 - protein, 11 aa, Japanese encephalitis virus
ATALHFLNAMS

SEQ ID NO: 238014 - protein, 11 aa, Japanese encephalitis virus
TALHFLNAMSK

SEQ ID NO: 238015 - protein, 11 aa, Japanese encephalitis virus
ALHFLNAMSKV

SEQ ID NO: 238016 - protein, 11 aa, Japanese encephalitis virus
LHFLNAMSKVR

SEQ ID NO: 238017 - protein, 11 aa, Japanese encephalitis virus
HFLNAMSKVRK

SEQ ID NO: 238018 - protein, 11 aa, Japanese encephalitis virus
FLNAMSKVRKD

SEQ ID NO: 238019 - protein, 11 aa, Japanese encephalitis virus
LNAMSKVRKDI

SEQ ID NO: 238020 - protein, 11 aa, Japanese encephalitis virus
NAMSKVRKDIQ

SEQ ID NO: 238021 - protein, 11 aa, Japanese encephalitis virus
AMSKVRKDIQE

SEQ ID NO: 238022 - protein, 11 aa, Japanese encephalitis virus
MSKVRKDIQEW

SEQ ID NO: 238023 - protein, 11 aa, Japanese encephalitis virus
SKVRKDIQEWK

SEQ ID NO: 238024 - protein, 11 aa, Japanese encephalitis virus
KVRKDIQEWKP

SEQ ID NO: 238025 - protein, 11 aa, Japanese encephalitis virus
VRKDIQEWKPS

SEQ ID NO: 238026 - protein, 11 aa, Japanese encephalitis virus
RKDIQEWKPSH

SEQ ID NO: 238027 - protein, 11 aa, Japanese encephalitis virus
KDIQEWKPSHG

SEQ ID NO: 238028 - protein, 11 aa, Japanese encephalitis virus
DIQEWKPSHGW

SEQ ID NO: 238029 - protein, 11 aa, Japanese encephalitis virus
IQEWKPSHGWH

SEQ ID NO: 238030 - protein, 11 aa, Japanese encephalitis virus
QEWKPSHGWHD

SEQ ID NO: 238031 - protein, 11 aa, Japanese encephalitis virus
EWKPSHGWHDW

SEQ ID NO: 238032 - protein, 11 aa, Japanese encephalitis virus
WKPSHGWHDWQ

SEQ ID NO: 238033 - protein, 11 aa, Japanese encephalitis virus
KPSHGWHDWQQ

SEQ ID NO: 238034 - protein, 11 aa, Japanese encephalitis virus
PSHGWHDWQQV

SEQ ID NO: 238035 - protein, 11 aa, Japanese encephalitis virus
SHGWHDWQQVP

SEQ ID NO: 238036 - protein, 11 aa, Japanese encephalitis virus
HGWHDWQQVPF

SEQ ID NO: 238037 - protein, 11 aa, Japanese encephalitis virus
GWHDWQQVPFC

SEQ ID NO: 238038 - protein, 11 aa, Japanese encephalitis virus
WHDWQQVPFCS

SEQ ID NO: 238039 - protein, 11 aa, Japanese encephalitis virus
HDWQQVPFCSN

SEQ ID NO: 238040 - protein, 11 aa, Japanese encephalitis virus
DWQQVPFCSNH

SEQ ID NO: 238041 - protein, 11 aa, Japanese encephalitis virus
WQQVPFCSNHF

SEQ ID NO: 238042 - protein, 11 aa, Japanese encephalitis virus
QQVPFCSNHFQ

SEQ ID NO: 238043 - protein, 11 aa, Japanese encephalitis virus
QVPFCSNHFQE

SEQ ID NO: 238044 - protein, 11 aa, Japanese encephalitis virus
VPFCSNHFQEI

SEQ ID NO: 238045 - protein, 11 aa, Japanese encephalitis virus
PFCSNHFQEIV

SEQ ID NO: 238046 - protein, 11 aa, Japanese encephalitis virus
FCSNHFQEIVM

SEQ ID NO: 238047 - protein, 11 aa, Japanese encephalitis virus
CSNHFQEIVMK

SEQ ID NO: 238048 - protein, 11 aa, Japanese encephalitis virus
SNHFQEIVMKD

SEQ ID NO: 238049 - protein, 11 aa, Japanese encephalitis virus
NHFQEIVMKDG

SEQ ID NO: 238050 - protein, 11 aa, Japanese encephalitis virus
HFQEIVMKDGR

SEQ ID NO: 238051 - protein, 11 aa, Japanese encephalitis virus
FQEIVMKDGRS

SEQ ID NO: 238052 - protein, 11 aa, Japanese encephalitis virus
QEIVMKDGRSI

SEQ ID NO: 238053 - protein, 11 aa, Japanese encephalitis virus
EIVMKDGRSIV

SEQ ID NO: 238054 - protein, 11 aa, Japanese encephalitis virus
IVMKDGRSIVV

SEQ ID NO: 238055 - protein, 11 aa, Japanese encephalitis virus
VMKDGRSIVVP

SEQ ID NO: 238056 - protein, 11 aa, Japanese encephalitis virus
MKDGRSIVVPC

SEQ ID NO: 238057 - protein, 11 aa, Japanese encephalitis virus
KDGRSIVVPCR

SEQ ID NO: 238058 - protein, 11 aa, Japanese encephalitis virus
DGRSIVVPCRG

SEQ ID NO: 238059 - protein, 11 aa, Japanese encephalitis virus
GRSIVVPCRGQ

SEQ ID NO: 238060 - protein, 11 aa, Japanese encephalitis virus
RSIVVPCRGQD

SEQ ID NO: 238061 - protein, 11 aa, Japanese encephalitis virus
SIVVPCRGQDE

SEQ ID NO: 238062 - protein, 11 aa, Japanese encephalitis virus
IVVPCRGQDEL

SEQ ID NO: 238063 - protein, 11 aa, Japanese encephalitis virus
VVPCRGQDELI

SEQ ID NO: 238064 - protein, 11 aa, Japanese encephalitis virus
VPCRGQDELIG

SEQ ID NO: 238065 - protein, 11 aa, Japanese encephalitis virus
PCRGQDELIGR

SEQ ID NO: 238066 - protein, 11 aa, Japanese encephalitis virus
CRGQDELIGRA

SEQ ID NO: 238067 - protein, 11 aa, Japanese encephalitis virus
RGQDELIGRAR

SEQ ID NO: 238068 - protein, 11 aa, Japanese encephalitis virus
GQDELIGRARI

SEQ ID NO: 238069 - protein, 11 aa, Japanese encephalitis virus
QDELIGRARIS

SEQ ID NO: 238070 - protein, 11 aa, Japanese encephalitis virus
DELIGRARISP

SEQ ID NO: 238071 - protein, 11 aa, Japanese encephalitis virus
ELIGRARISPG

SEQ ID NO: 238072 - protein, 11 aa, Japanese encephalitis virus
LIGRARISPGA

SEQ ID NO: 238073 - protein, 11 aa, Japanese encephalitis virus
IGRARISPGAG

SEQ ID NO: 238074 - protein, 11 aa, Japanese encephalitis virus
GRARISPGAGW

SEQ ID NO: 238075 - protein, 11 aa, Japanese encephalitis virus
RARISPGAGWN

SEQ ID NO: 238076 - protein, 11 aa, Japanese encephalitis virus
ARISPGAGWNV

SEQ ID NO: 238077 - protein, 11 aa, Japanese encephalitis virus
RISPGAGWNVK

SEQ ID NO: 238078 - protein, 11 aa, Japanese encephalitis virus
ISPGAGWNVKD

SEQ ID NO: 238079 - protein, 11 aa, Japanese encephalitis virus
SPGAGWNVKDT

SEQ ID NO: 238080 - protein, 11 aa, Japanese encephalitis virus
PGAGWNVKDTA

SEQ ID NO: 238081 - protein, 11 aa, Japanese encephalitis virus
GAGWNVKDTAC

SEQ ID NO: 238082 - protein, 11 aa, Japanese encephalitis virus
AGWNVKDTACL

SEQ ID NO: 238083 - protein, 11 aa, Japanese encephalitis virus
GWNVKDTACLA

SEQ ID NO: 238084 - protein, 11 aa, Japanese encephalitis virus
WNVKDTACLAK

SEQ ID NO: 238085 - protein, 11 aa, Japanese encephalitis virus
NVKDTACLAKA

SEQ ID NO: 238086 - protein, 11 aa, Japanese encephalitis virus
VKDTACLAKAY

SEQ ID NO: 238087 - protein, 11 aa, Japanese encephalitis virus
KDTACLAKAYA

SEQ ID NO: 238088 - protein, 11 aa, Japanese encephalitis virus
DTACLAKAYAQ

SEQ ID NO: 238089 - protein, 11 aa, Japanese encephalitis virus
TACLAKAYAQM

SEQ ID NO: 238090 - protein, 11 aa, Japanese encephalitis virus
ACLAKAYAQMW

SEQ ID NO: 238091 - protein, 11 aa, Japanese encephalitis virus
CLAKAYAQMWL

SEQ ID NO: 238092 - protein, 11 aa, Japanese encephalitis virus
LAKAYAQMWLL

SEQ ID NO: 238093 - protein, 11 aa, Japanese encephalitis virus
AKAYAQMWLLL

SEQ ID NO: 238094 - protein, 11 aa, Japanese encephalitis virus
KAYAQMWLLLY

SEQ ID NO: 238095 - protein, 11 aa, Japanese encephalitis virus
AYAQMWLLLYF

SEQ ID NO: 238096 - protein, 11 aa, Japanese encephalitis virus
YAQMWLLLYFH

SEQ ID NO: 238097 - protein, 11 aa, Japanese encephalitis virus
AQMWLLLYFHR

SEQ ID NO: 238098 - protein, 11 aa, Japanese encephalitis virus
QMWLLLYFHRR

SEQ ID NO: 238099 - protein, 11 aa, Japanese encephalitis virus
MWLLLYFHRRD

SEQ ID NO: 238100 - protein, 11 aa, Japanese encephalitis virus
WLLLYFHRRDL

SEQ ID NO: 238101 - protein, 11 aa, Japanese encephalitis virus
LLLYFHRRDLR

SEQ ID NO: 238102 - protein, 11 aa, Japanese encephalitis virus
LLYFHRRDLRL

SEQ ID NO: 238103 - protein, 11 aa, Japanese encephalitis virus
LYFHRRDLRLM

SEQ ID NO: 238104 - protein, 11 aa, Japanese encephalitis virus
YFHRRDLRLMA

SEQ ID NO: 238105 - protein, 11 aa, Japanese encephalitis virus
FHRRDLRLMAN

SEQ ID NO: 238106 - protein, 11 aa, Japanese encephalitis virus
HRRDLRLMANA

SEQ ID NO: 238107 - protein, 11 aa, Japanese encephalitis virus
RRDLRLMANAI

SEQ ID NO: 238108 - protein, 11 aa, Japanese encephalitis virus
RDLRLMANAIC

SEQ ID NO: 238109 - protein, 11 aa, Japanese encephalitis virus
DLRLMANAICS

SEQ ID NO: 238110 - protein, 11 aa, Japanese encephalitis virus
LRLMANAICSA

SEQ ID NO: 238111 - protein, 11 aa, Japanese encephalitis virus
RLMANAICSAV

SEQ ID NO: 238112 - protein, 11 aa, Japanese encephalitis virus
LMANAICSAVP

SEQ ID NO: 238113 - protein, 11 aa, Japanese encephalitis virus
MANAICSAVPV

SEQ ID NO: 238114 - protein, 11 aa, Japanese encephalitis virus
ANAICSAVPVD

SEQ ID NO: 238115 - protein, 11 aa, Japanese encephalitis virus
NAICSAVPVDW

SEQ ID NO: 238116 - protein, 11 aa, Japanese encephalitis virus
AICSAVPVDWV

SEQ ID NO: 238117 - protein, 11 aa, Japanese encephalitis virus
ICSAVPVDWVP

SEQ ID NO: 238118 - protein, 11 aa, Japanese encephalitis virus
CSAVPVDWVPT

SEQ ID NO: 238119 - protein, 11 aa, Japanese encephalitis virus
SAVPVDWVPTG

SEQ ID NO: 238120 - protein, 11 aa, Japanese encephalitis virus
AVPVDWVPTGR

SEQ ID NO: 238121 - protein, 11 aa, Japanese encephalitis virus
VPVDWVPTGRT

SEQ ID NO: 238122 - protein, 11 aa, Japanese encephalitis virus
PVDWVPTGRTS

SEQ ID NO: 238123 - protein, 11 aa, Japanese encephalitis virus
VDWVPTGRTSW

SEQ ID NO: 238124 - protein, 11 aa, Japanese encephalitis virus
DWVPTGRTSWS

SEQ ID NO: 238125 - protein, 11 aa, Japanese encephalitis virus
WVPTGRTSWSI

SEQ ID NO: 238126 - protein, 11 aa, Japanese encephalitis virus
VPTGRTSWSIH

SEQ ID NO: 238127 - protein, 11 aa, Japanese encephalitis virus
PTGRTSWSIHS

SEQ ID NO: 238128 - protein, 11 aa, Japanese encephalitis virus
TGRTSWSIHSK

SEQ ID NO: 238129 - protein, 11 aa, Japanese encephalitis virus
GRTSWSIHSKG

SEQ ID NO: 238130 - protein, 11 aa, Japanese encephalitis virus
RTSWSIHSKGE

SEQ ID NO: 238131 - protein, 11 aa, Japanese encephalitis virus
TSWSIHSKGEW

SEQ ID NO: 238132 - protein, 11 aa, Japanese encephalitis virus
SWSIHSKGEWM

SEQ ID NO: 238133 - protein, 11 aa, Japanese encephalitis virus
WSIHSKGEWMT

SEQ ID NO: 238134 - protein, 11 aa, Japanese encephalitis virus
SIHSKGEWMTT

SEQ ID NO: 238135 - protein, 11 aa, Japanese encephalitis virus
IHSKGEWMTTE

SEQ ID NO: 238136 - protein, 11 aa, Japanese encephalitis virus
HSKGEWMTTED

SEQ ID NO: 238137 - protein, 11 aa, Japanese encephalitis virus
SKGEWMTTEDM

SEQ ID NO: 238138 - protein, 11 aa, Japanese encephalitis virus
KGEWMTTEDML

SEQ ID NO: 238139 - protein, 11 aa, Japanese encephalitis virus
GEWMTTEDMLQ

SEQ ID NO: 238140 - protein, 11 aa, Japanese encephalitis virus
EWMTTEDMLQV

SEQ ID NO: 238141 - protein, 11 aa, Japanese encephalitis virus
WMTTEDMLQVW

SEQ ID NO: 238142 - protein, 11 aa, Japanese encephalitis virus
MTTEDMLQVWN

SEQ ID NO: 238143 - protein, 11 aa, Japanese encephalitis virus
TTEDMLQVWNR

SEQ ID NO: 238144 - protein, 11 aa, Japanese encephalitis virus
TEDMLQVWNRV

SEQ ID NO: 238145 - protein, 11 aa, Japanese encephalitis virus
EDMLQVWNRVW

SEQ ID NO: 238146 - protein, 11 aa, Japanese encephalitis virus
DMLQVWNRVWI

SEQ ID NO: 238147 - protein, 11 aa, Japanese encephalitis virus
MLQVWNRVWIE

SEQ ID NO: 238148 - protein, 11 aa, Japanese encephalitis virus
LQVWNRVWIEE

SEQ ID NO: 238149 - protein, 11 aa, Japanese encephalitis virus
QVWNRVWIEEN

SEQ ID NO: 238150 - protein, 11 aa, Japanese encephalitis virus
VWNRVWIEENE

SEQ ID NO: 238151 - protein, 11 aa, Japanese encephalitis virus
WNRVWIEENEW

SEQ ID NO: 238152 - protein, 11 aa, Japanese encephalitis virus
NRVWIEENEWM

SEQ ID NO: 238153 - protein, 11 aa, Japanese encephalitis virus
RVWIEENEWMM

SEQ ID NO: 238154 - protein, 11 aa, Japanese encephalitis virus
VWIEENEWMMD

SEQ ID NO: 238155 - protein, 11 aa, Japanese encephalitis virus
WIEENEWMMDK

SEQ ID NO: 238156 - protein, 11 aa, Japanese encephalitis virus
IEENEWMMDKT

SEQ ID NO: 238157 - protein, 11 aa, Japanese encephalitis virus
EENEWMMDKTP

SEQ ID NO: 238158 - protein, 11 aa, Japanese encephalitis virus
DKTPITSWTDV

SEQ ID NO: 238159 - protein, 11 aa, Japanese encephalitis virus
KTPITSWTDVP

SEQ ID NO: 238160 - protein, 11 aa, Japanese encephalitis virus
TPITSWTDVPY

SEQ ID NO: 238161 - protein, 11 aa, Japanese encephalitis virus
PITSWTDVPYV

SEQ ID NO: 238162 - protein, 11 aa, Japanese encephalitis virus
ITSWTDVPYVG

SEQ ID NO: 238163 - protein, 11 aa, Japanese encephalitis virus
TSWTDVPYVGK

SEQ ID NO: 238164 - protein, 11 aa, Japanese encephalitis virus
SWTDVPYVGKR

SEQ ID NO: 238165 - protein, 11 aa, Japanese encephalitis virus
WTDVPYVGKRE

SEQ ID NO: 238166 - protein, 11 aa, Japanese encephalitis virus
TDVPYVGKRED

SEQ ID NO: 238167 - protein, 11 aa, Japanese encephalitis virus
DVPYVGKREDI

SEQ ID NO: 238168 - protein, 11 aa, Japanese encephalitis virus
VPYVGKREDIW

SEQ ID NO: 238169 - protein, 11 aa, Japanese encephalitis virus
PYVGKREDIWC

SEQ ID NO: 238170 - protein, 11 aa, Japanese encephalitis virus
YVGKREDIWCG

SEQ ID NO: 238171 - protein, 11 aa, Japanese encephalitis virus
VGKREDIWCGS

SEQ ID NO: 238172 - protein, 11 aa, Japanese encephalitis virus
GKREDIWCGSL

SEQ ID NO: 238173 - protein, 11 aa, Japanese encephalitis virus
KREDIWCGSLI

SEQ ID NO: 238174 - protein, 11 aa, Japanese encephalitis virus
REDIWCGSLIG

SEQ ID NO: 238175 - protein, 11 aa, Japanese encephalitis virus
EDIWCGSLIGT

SEQ ID NO: 238176 - protein, 11 aa, Japanese encephalitis virus
DIWCGSLIGTR

SEQ ID NO: 238177 - protein, 11 aa, Japanese encephalitis virus
IWCGSLIGTRS

SEQ ID NO: 238178 - protein, 11 aa, Japanese encephalitis virus
WCGSLIGTRSR

SEQ ID NO: 238179 - protein, 11 aa, Japanese encephalitis virus
CGSLIGTRSRA

SEQ ID NO: 238180 - protein, 11 aa, Japanese encephalitis virus
GSLIGTRSRAT

SEQ ID NO: 238181 - protein, 11 aa, Japanese encephalitis virus
SLIGTRSRATW

SEQ ID NO: 238182 - protein, 11 aa, Japanese encephalitis virus
LIGTRSRATWA

SEQ ID NO: 238183 - protein, 11 aa, Japanese encephalitis virus
IGTRSRATWAE

SEQ ID NO: 238184 - protein, 11 aa, Japanese encephalitis virus
GTRSRATWAEN

SEQ ID NO: 238185 - protein, 11 aa, Japanese encephalitis virus
TRSRATWAENI

SEQ ID NO: 238186 - protein, 11 aa, Japanese encephalitis virus
RSRATWAENIY

SEQ ID NO: 238187 - protein, 11 aa, Japanese encephalitis virus
SRATWAENIYA

SEQ ID NO: 238188 - protein, 11 aa, Japanese encephalitis virus
RATWAENIYAA

SEQ ID NO: 238189 - protein, 11 aa, Japanese encephalitis virus
ATWAENIYAAI

SEQ ID NO: 238190 - protein, 11 aa, Japanese encephalitis virus
TWAENIYAAIN

SEQ ID NO: 238191 - protein, 11 aa, Japanese encephalitis virus
WAENIYAAINQ

SEQ ID NO: 238192 - protein, 11 aa, Japanese encephalitis virus
AENIYAAINQV

SEQ ID NO: 238193 - protein, 11 aa, Japanese encephalitis virus
ENIYAAINQVR

SEQ ID NO: 238194 - protein, 11 aa, Japanese encephalitis virus
NIYAAINQVRA

SEQ ID NO: 238195 - protein, 11 aa, Japanese encephalitis virus
IYAAINQVRAV

SEQ ID NO: 238196 - protein, 11 aa, Japanese encephalitis virus
YAAINQVRAVI

SEQ ID NO: 238197 - protein, 11 aa, Japanese encephalitis virus
AAINQVRAVIG

SEQ ID NO: 238198 - protein, 11 aa, Japanese encephalitis virus
AINQVRAVIGK

SEQ ID NO: 238199 - protein, 11 aa, Japanese encephalitis virus
INQVRAVIGKE

SEQ ID NO: 238200 - protein, 11 aa, Japanese encephalitis virus
NQVRAVIGKEN

SEQ ID NO: 238201 - protein, 11 aa, Japanese encephalitis virus
QVRAVIGKENY

SEQ ID NO: 238202 - protein, 11 aa, Japanese encephalitis virus
VRAVIGKENYV

SEQ ID NO: 238203 - protein, 11 aa, Japanese encephalitis virus
RAVIGKENYVD

SEQ ID NO: 238204 - protein, 11 aa, Japanese encephalitis virus
AVIGKENYVDY

SEQ ID NO: 238205 - protein, 11 aa, Japanese encephalitis virus
VIGKENYVDYM

SEQ ID NO: 238206 - protein, 11 aa, Japanese encephalitis virus
IGKENYVDYMT

SEQ ID NO: 238207 - protein, 11 aa, Japanese encephalitis virus
GKENYVDYMTS

SEQ ID NO: 238208 - protein, 11 aa, Japanese encephalitis virus
KENYVDYMTSL

SEQ ID NO: 238209 - protein, 11 aa, Japanese encephalitis virus
ENYVDYMTSLR

SEQ ID NO: 238210 - protein, 11 aa, Japanese encephalitis virus
NYVDYMTSLRR

SEQ ID NO: 238211 - protein, 11 aa, Japanese encephalitis virus
YVDYMTSLRRY

SEQ ID NO: 238212 - protein, 11 aa, Japanese encephalitis virus
VDYMTSLRRYE

SEQ ID NO: 238213 - protein, 11 aa, Japanese encephalitis virus
DYMTSLRRYED

SEQ ID NO: 238214 - protein, 11 aa, Japanese encephalitis virus
YMTSLRRYEDV

SEQ ID NO: 238215 - protein, 11 aa, Japanese encephalitis virus
MTSLRRYEDVL

SEQ ID NO: 238216 - protein, 11 aa, Japanese encephalitis virus
SLRRYEDVLIQ

SEQ ID NO: 238217 - protein, 11 aa, Japanese encephalitis virus
LRRYEDVLIQE

SEQ ID NO: 238218 - protein, 11 aa, Japanese encephalitis virus
RRYEDVLIQED

SEQ ID NO: 238219 - protein, 11 aa, Japanese encephalitis virus
RYEDVLIQEDR

SEQ ID NO: 238220 - protein, 11 aa, Japanese encephalitis virus
YEDVLIQEDRV

SEQ ID NO: 238221 - protein, 11 aa, Japanese encephalitis virus
EDVLIQEDRVI

SEQ ID NO: 238222 - protein, 11 aa, Japanese encephalitis virus
MTKKPGGPGRN

SEQ ID NO: 238223 - protein, 11 aa, Japanese encephalitis virus
TKKPGGPGRNR

SEQ ID NO: 238224 - protein, 11 aa, Japanese encephalitis virus
KKPGGPGRNRA

SEQ ID NO: 238225 - protein, 11 aa, Japanese encephalitis virus
KPGGPGRNRAI

SEQ ID NO: 238226 - protein, 11 aa, Japanese encephalitis virus
PGGPGRNRAIN

SEQ ID NO: 238227 - protein, 11 aa, Japanese encephalitis virus
GGPGRNRAINM

SEQ ID NO: 238228 - protein, 11 aa, Japanese encephalitis virus
GPGRNRAINML

SEQ ID NO: 238229 - protein, 11 aa, Japanese encephalitis virus
PGRNRAINMLK

SEQ ID NO: 238230 - protein, 11 aa, Japanese encephalitis virus
GRNRAINMLKR

SEQ ID NO: 238231 - protein, 11 aa, Japanese encephalitis virus
RNRAINMLKRG

SEQ ID NO: 238232 - protein, 11 aa, Japanese encephalitis virus
NRAIYMLKRGL

SEQ ID NO: 238233 - protein, 11 aa, Japanese encephalitis virus
RAIYMLKRGLP

SEQ ID NO: 238234 - protein, 11 aa, Japanese encephalitis virus
AIYMLKRGLPR

SEQ ID NO: 238235 - protein, 11 aa, Japanese encephalitis virus
IYMLKRGLPRV

SEQ ID NO: 238236 - protein, 11 aa, Japanese encephalitis virus
YMLKRGLPRVF

SEQ ID NO: 238237 - protein, 11 aa, Japanese encephalitis virus
RGLPRVFPLVR

SEQ ID NO: 238238 - protein, 11 aa, Japanese encephalitis virus
GLPRVFPLVRV

SEQ ID NO: 238239 - protein, 11 aa, Japanese encephalitis virus
LPRVFPLVRVK

SEQ ID NO: 238240 - protein, 11 aa, Japanese encephalitis virus
PRVFPLVGVKK

SEQ ID NO: 238241 - protein, 11 aa, Japanese encephalitis virus
RVFPLVRVKRV

SEQ ID NO: 238242 - protein, 11 aa, Japanese encephalitis virus
VFPLVGVKKVV

SEQ ID NO: 238243 - protein, 11 aa, Japanese encephalitis virus
FPLVRVKRVVM

SEQ ID NO: 238244 - protein, 11 aa, Japanese encephalitis virus
PLVRVKRVVMS

SEQ ID NO: 238245 - protein, 11 aa, Japanese encephalitis virus
LVGVKRVVISL

SEQ ID NO: 238246 - protein, 11 aa, Japanese encephalitis virus
VRVKRVVMSLL

SEQ ID NO: 238247 - protein, 11 aa, Japanese encephalitis virus
GVKKVVMSLLD

SEQ ID NO: 238248 - protein, 11 aa, Japanese encephalitis virus
VKRVVISLLDG

SEQ ID NO: 238249 - protein, 11 aa, Japanese encephalitis virus
KRVVISLLDGI

SEQ ID NO: 238250 - protein, 11 aa, Japanese encephalitis virus
KVVMSLLDGRG

SEQ ID NO: 238251 - protein, 11 aa, Japanese encephalitis virus
VVISLLDGIGP

SEQ ID NO: 238252 - protein, 11 aa, Japanese encephalitis virus
VMSLLDGRGPA

SEQ ID NO: 238253 - protein, 11 aa, Japanese encephalitis virus
MSLLDGRGPAR

SEQ ID NO: 238254 - protein, 11 aa, Japanese encephalitis virus
SLLDGRGPARF

SEQ ID NO: 238255 - protein, 11 aa, Japanese encephalitis virus
LLDGRGPARFV

SEQ ID NO: 238256 - protein, 11 aa, Japanese encephalitis virus
LDGRGPARFVL

SEQ ID NO: 238257 - protein, 11 aa, Japanese encephalitis virus
DGRGPARFVLA

SEQ ID NO: 238258 - protein, 11 aa, Japanese encephalitis virus
GRGPARFVLAL

SEQ ID NO: 238259 - protein, 11 aa, Japanese encephalitis virus
RGPVRFVLALT

SEQ ID NO: 238260 - protein, 11 aa, Japanese encephalitis virus
GPARFVLALIT

SEQ ID NO: 238261 - protein, 11 aa, Japanese encephalitis virus
PVRFVLALTTF

SEQ ID NO: 238262 - protein, 11 aa, Japanese encephalitis virus
VRFVLALTTFF

SEQ ID NO: 238263 - protein, 11 aa, Japanese encephalitis virus
RFVLALTTFFK

SEQ ID NO: 238264 - protein, 11 aa, Japanese encephalitis virus
FVLALTTFFKF

SEQ ID NO: 238265 - protein, 11 aa, Japanese encephalitis virus
VLALTTFFKFT

SEQ ID NO: 238266 - protein, 11 aa, Japanese encephalitis virus
LALTTFFKFTA

SEQ ID NO: 238267 - protein, 11 aa, Japanese encephalitis virus
ALTTFFKFTAL

SEQ ID NO: 238268 - protein, 11 aa, Japanese encephalitis virus
LTTFFKFTALA

SEQ ID NO: 238269 - protein, 11 aa, Japanese encephalitis virus
TTFFKFTALAP

SEQ ID NO: 238270 - protein, 11 aa, Japanese encephalitis virus
SFFKFTALSPT

SEQ ID NO: 238271 - protein, 11 aa, Japanese encephalitis virus
FFKFTALSPTK

SEQ ID NO: 238272 - protein, 11 aa, Japanese encephalitis virus
FKFTALSPTKA

SEQ ID NO: 238273 - protein, 11 aa, Japanese encephalitis virus
KFTALSPTKAL

SEQ ID NO: 238274 - protein, 11 aa, Japanese encephalitis virus
FTALAPTKALS

SEQ ID NO: 238275 - protein, 11 aa, Japanese encephalitis virus
TALAPTKALSG

SEQ ID NO: 238276 - protein, 11 aa, Japanese encephalitis virus
ALAPTKALSGR

SEQ ID NO: 238277 - protein, 11 aa, Japanese encephalitis virus
LAPTKALSGRW

SEQ ID NO: 238278 - protein, 11 aa, Japanese encephalitis virus
APTKALLGRWR

SEQ ID NO: 238279 - protein, 11 aa, Japanese encephalitis virus
PTKALLGRWRA

SEQ ID NO: 238280 - protein, 11 aa, Japanese encephalitis virus
TKALLGRWRAV

SEQ ID NO: 238281 - protein, 11 aa, Japanese encephalitis virus
KALLGRWRAVE

SEQ ID NO: 238282 - protein, 11 aa, Japanese encephalitis virus
ALLGRWRAVEK

SEQ ID NO: 238283 - protein, 11 aa, Japanese encephalitis virus
LLGRWRAVEKS

SEQ ID NO: 238284 - protein, 11 aa, Japanese encephalitis virus
LGRWRAVEKSV

SEQ ID NO: 238285 - protein, 11 aa, Japanese encephalitis virus
GRWRAVEKSVA

SEQ ID NO: 238286 - protein, 11 aa, Japanese encephalitis virus
RWRAVEKSVAM

SEQ ID NO: 238287 - protein, 11 aa, Japanese encephalitis virus
WRAVEKSVAMK

SEQ ID NO: 238288 - protein, 11 aa, Japanese encephalitis virus
RAVEKSVAMKH

SEQ ID NO: 238289 - protein, 11 aa, Japanese encephalitis virus
ALEKSVAMKHL

SEQ ID NO: 238290 - protein, 11 aa, Japanese encephalitis virus
LEKSVAMKHLT

SEQ ID NO: 238291 - protein, 11 aa, Japanese encephalitis virus
ERSVAMKHLTS

SEQ ID NO: 238292 - protein, 11 aa, Japanese encephalitis virus
RSVAMKHLTSF

SEQ ID NO: 238293 - protein, 11 aa, Japanese encephalitis virus
VAMKHLTSFKG

SEQ ID NO: 238294 - protein, 11 aa, Japanese encephalitis virus
AMKHLTSFKGE

SEQ ID NO: 238295 - protein, 11 aa, Japanese encephalitis virus
MKHLTSFKGEL

SEQ ID NO: 238296 - protein, 11 aa, Japanese encephalitis virus
KHLTSFKGELG

SEQ ID NO: 238297 - protein, 11 aa, Japanese encephalitis virus
HLTSFKGELGT

SEQ ID NO: 238298 - protein, 11 aa, Japanese encephalitis virus
LTSFKGELGTL

SEQ ID NO: 238299 - protein, 11 aa, Japanese encephalitis virus
TSFKRELGILI

SEQ ID NO: 238300 - protein, 11 aa, Japanese encephalitis virus
SFKRELGILID

SEQ ID NO: 238301 - protein, 11 aa, Japanese encephalitis virus
FKRELGTLIDT

SEQ ID NO: 238302 - protein, 11 aa, Japanese encephalitis virus
KRELGTLIDTV

SEQ ID NO: 238303 - protein, 11 aa, Japanese encephalitis virus
RELGILIDAVN

SEQ ID NO: 238304 - protein, 11 aa, Japanese encephalitis virus
ELGTLIDVVNK

SEQ ID NO: 238305 - protein, 11 aa, Japanese encephalitis virus
LGILIDAVNKR

SEQ ID NO: 238306 - protein, 11 aa, Japanese encephalitis virus
GTLIDVVNKRG

SEQ ID NO: 238307 - protein, 11 aa, Japanese encephalitis virus
LIDAVNKRGKK

SEQ ID NO: 238308 - protein, 11 aa, Japanese encephalitis virus
VNKRGKKQNKR

SEQ ID NO: 238309 - protein, 11 aa, Japanese encephalitis virus
NKRGKKQNKRG

SEQ ID NO: 238310 - protein, 11 aa, Japanese encephalitis virus
KRGKKQNKRGG

SEQ ID NO: 238311 - protein, 11 aa, Japanese encephalitis virus
RGKKQNKRGGN

SEQ ID NO: 238312 - protein, 11 aa, Japanese encephalitis virus
GKKQNKRGGNE

SEQ ID NO: 238313 - protein, 11 aa, Japanese encephalitis virus
VGAMKLSNFQG

SEQ ID NO: 238314 - protein, 11 aa, Japanese encephalitis virus
GAMRLSNFQGK

SEQ ID NO: 238315 - protein, 11 aa, Japanese encephalitis virus
AMRLSNFQGKL

SEQ ID NO: 238316 - protein, 11 aa, Japanese encephalitis virus
MRLSNFQGKLL

SEQ ID NO: 238317 - protein, 11 aa, Japanese encephalitis virus
RLSNFQGKLLM

SEQ ID NO: 238318 - protein, 11 aa, Japanese encephalitis virus
LSNFQGKLLMA

SEQ ID NO: 238319 - protein, 11 aa, Japanese encephalitis virus
SNFQGKLLMTV

SEQ ID NO: 238320 - protein, 11 aa, Japanese encephalitis virus
NFQGKLLMTVN

SEQ ID NO: 238321 - protein, 11 aa, Japanese encephalitis virus
FQGKLLMTVNN

SEQ ID NO: 238322 - protein, 11 aa, Japanese encephalitis virus
QGKLLMTVNNT

SEQ ID NO: 238323 - protein, 11 aa, Japanese encephalitis virus
GKLLMTVNNTD

SEQ ID NO: 238324 - protein, 11 aa, Japanese encephalitis virus
KLLMTVNNTDI

SEQ ID NO: 238325 - protein, 11 aa, Japanese encephalitis virus
LLMTVNNTDIA

SEQ ID NO: 238326 - protein, 11 aa, Japanese encephalitis virus
LMTVNNTDIAD

SEQ ID NO: 238327 - protein, 11 aa, Japanese encephalitis virus
MTVNNTDIADV

SEQ ID NO: 238328 - protein, 11 aa, Japanese encephalitis virus
TVNNTDIADVI

SEQ ID NO: 238329 - protein, 11 aa, Japanese encephalitis virus
VNNTDIADVIV

SEQ ID NO: 238330 - protein, 11 aa, Japanese encephalitis virus
RCWVRAIDVGH

SEQ ID NO: 238331 - protein, 11 aa, Japanese encephalitis virus
CWVRAIDVGHM

SEQ ID NO: 238332 - protein, 11 aa, Japanese encephalitis virus
WVRAIDVGHMC

SEQ ID NO: 238333 - protein, 11 aa, Japanese encephalitis virus
VRAIDVGHMCE

SEQ ID NO: 238334 - protein, 11 aa, Japanese encephalitis virus
RAIDVGHMCED

SEQ ID NO: 238335 - protein, 11 aa, Japanese encephalitis virus
AIDVGYLCEDT

SEQ ID NO: 238336 - protein, 11 aa, Japanese encephalitis virus
IDVGHMCEDTI

SEQ ID NO: 238337 - protein, 11 aa, Japanese encephalitis virus
DVGHMCEDTIT

SEQ ID NO: 238338 - protein, 11 aa, Japanese encephalitis virus
VGHMCEDTITY

SEQ ID NO: 238339 - protein, 11 aa, Japanese encephalitis virus
GYLCEDTITYE

SEQ ID NO: 238340 - protein, 11 aa, Japanese encephalitis virus
HMCEDTITYEC

SEQ ID NO: 238341 - protein, 11 aa, Japanese encephalitis virus
LCEDTITYECP

SEQ ID NO: 238342 - protein, 11 aa, Japanese encephalitis virus
DTITYECPKLA

SEQ ID NO: 238343 - protein, 11 aa, Japanese encephalitis virus
VGNDPEDVDCW

SEQ ID NO: 238344 - protein, 11 aa, Japanese encephalitis virus
GNDPQDVDCWC

SEQ ID NO: 238345 - protein, 11 aa, Japanese encephalitis virus
NDPQDVDCWCD

SEQ ID NO: 238346 - protein, 11 aa, Japanese encephalitis virus
DPQDVDCWCDH

SEQ ID NO: 238347 - protein, 11 aa, Japanese encephalitis virus
PQDVDCWCDHQ

SEQ ID NO: 238348 - protein, 11 aa, Japanese encephalitis virus
EDVDCWCDNQQ

SEQ ID NO: 238349 - protein, 11 aa, Japanese encephalitis virus
DVDCWCDNQQV

SEQ ID NO: 238350 - protein, 11 aa, Japanese encephalitis virus
VDCWCDNQQVY

SEQ ID NO: 238351 - protein, 11 aa, Japanese encephalitis virus
DCWCDNQQVYV

SEQ ID NO: 238352 - protein, 11 aa, Japanese encephalitis virus
CWCDNQQVYVQ

SEQ ID NO: 238353 - protein, 11 aa, Japanese encephalitis virus
WCDNQQVYVQY

SEQ ID NO: 238354 - protein, 11 aa, Japanese encephalitis virus
CDNQQVYVQYG

SEQ ID NO: 238355 - protein, 11 aa, Japanese encephalitis virus
DNQQVYVQYGP

SEQ ID NO: 238356 - protein, 11 aa, Japanese encephalitis virus
NQQVYVQYGPC

SEQ ID NO: 238357 - protein, 11 aa, Japanese encephalitis virus
QQVYVQYGPCT

SEQ ID NO: 238358 - protein, 11 aa, Japanese encephalitis virus
QVYVQYGPCTR

SEQ ID NO: 238359 - protein, 11 aa, Japanese encephalitis virus
VYVQYGPCTRT

SEQ ID NO: 238360 - protein, 11 aa, Japanese encephalitis virus
YVQYGPCTRTR

SEQ ID NO: 238361 - protein, 11 aa, Japanese encephalitis virus
VQYGPCTRTRH

SEQ ID NO: 238362 - protein, 11 aa, Japanese encephalitis virus
QYGPCTRTRHS

SEQ ID NO: 238363 - protein, 11 aa, Japanese encephalitis virus
YGPCTRTRHSK

SEQ ID NO: 238364 - protein, 11 aa, Japanese encephalitis virus
GPCTRTRHSKR

SEQ ID NO: 238365 - protein, 11 aa, Japanese encephalitis virus
RCTRTRHSKRT

SEQ ID NO: 238366 - protein, 11 aa, Japanese encephalitis virus
CTRTRHSKRTR

SEQ ID NO: 238367 - protein, 11 aa, Japanese encephalitis virus
TRTRHSKRTRR

SEQ ID NO: 238368 - protein, 11 aa, Japanese encephalitis virus
RTRHSKRTRRS

SEQ ID NO: 238369 - protein, 11 aa, Japanese encephalitis virus
TRHSKRTRRSV

SEQ ID NO: 238370 - protein, 11 aa, Japanese encephalitis virus
RHSKRTRRSVS

SEQ ID NO: 238371 - protein, 11 aa, Japanese encephalitis virus
HSKRTRRSVSV

SEQ ID NO: 238372 - protein, 11 aa, Japanese encephalitis virus
SKRTRRSVSVQ

SEQ ID NO: 238373 - protein, 11 aa, Japanese encephalitis virus
KRTRRSVSVQT

SEQ ID NO: 238374 - protein, 11 aa, Japanese encephalitis virus
RTRRSVSVQTH

SEQ ID NO: 238375 - protein, 11 aa, Japanese encephalitis virus
TRRSVSVQTHG

SEQ ID NO: 238376 - protein, 11 aa, Japanese encephalitis virus
RRSVSVQPNGE

SEQ ID NO: 238377 - protein, 11 aa, Japanese encephalitis virus
RSVSVHTHGES

SEQ ID NO: 238378 - protein, 11 aa, Japanese encephalitis virus
SVSVQPNGERS

SEQ ID NO: 238379 - protein, 11 aa, Japanese encephalitis virus
VSVHTHGESSL

SEQ ID NO: 238380 - protein, 11 aa, Japanese encephalitis virus
SVQPNGERSLV

SEQ ID NO: 238381 - protein, 11 aa, Japanese encephalitis virus
VQTHGESSLEN

SEQ ID NO: 238382 - protein, 11 aa, Japanese encephalitis virus
QPNGERSLVNK

SEQ ID NO: 238383 - protein, 11 aa, Japanese encephalitis virus
PNGERSLVNKK

SEQ ID NO: 238384 - protein, 11 aa, Japanese encephalitis virus
NGERSLVNKKE

SEQ ID NO: 238385 - protein, 11 aa, Japanese encephalitis virus
GESSLENKKEA

SEQ ID NO: 238386 - protein, 11 aa, Japanese encephalitis virus
ESSLENKKEAW

SEQ ID NO: 238387 - protein, 11 aa, Japanese encephalitis virus
SSLENKKEAWL

SEQ ID NO: 238388 - protein, 11 aa, Japanese encephalitis virus
SLVNKKKAWLD

SEQ ID NO: 238389 - protein, 11 aa, Japanese encephalitis virus
LVNKKEAWLNS

SEQ ID NO: 238390 - protein, 11 aa, Japanese encephalitis virus
VNKKKAWLDST

SEQ ID NO: 238391 - protein, 11 aa, Japanese encephalitis virus
NKKEAWLDSTR

SEQ ID NO: 238392 - protein, 11 aa, Japanese encephalitis virus
KKEAWLNSTKA

SEQ ID NO: 238393 - protein, 11 aa, Japanese encephalitis virus
KEAWLDSTRAT

SEQ ID NO: 238394 - protein, 11 aa, Japanese encephalitis virus
EAWLDSTRATR

SEQ ID NO: 238395 - protein, 11 aa, Japanese encephalitis virus
AWLDSTRATRY

SEQ ID NO: 238396 - protein, 11 aa, Japanese encephalitis virus
WLDSTRATRYL

SEQ ID NO: 238397 - protein, 11 aa, Japanese encephalitis virus
LDSTKATRYLT

SEQ ID NO: 238398 - protein, 11 aa, Japanese encephalitis virus
DSTKATRYLTK

SEQ ID NO: 238399 - protein, 11 aa, Japanese encephalitis virus
STKATRYLTKT

SEQ ID NO: 238400 - protein, 11 aa, Japanese encephalitis virus
TKATRYLTKTE

SEQ ID NO: 238401 - protein, 11 aa, Japanese encephalitis virus
KATRYLTKTEN

SEQ ID NO: 238402 - protein, 11 aa, Japanese encephalitis virus
ATRYLTKTENW

SEQ ID NO: 238403 - protein, 11 aa, Japanese encephalitis virus
TRYLTKTENWI

SEQ ID NO: 238404 - protein, 11 aa, Japanese encephalitis virus
RYLTKTENWII

SEQ ID NO: 238405 - protein, 11 aa, Japanese encephalitis virus
YLTKTENWIIR

SEQ ID NO: 238406 - protein, 11 aa, Japanese encephalitis virus
LMKTENWIVRN

SEQ ID NO: 238407 - protein, 11 aa, Japanese encephalitis virus
TKTENWIIRNP

SEQ ID NO: 238408 - protein, 11 aa, Japanese encephalitis virus
KTENWIVRNPG

SEQ ID NO: 238409 - protein, 11 aa, Japanese encephalitis virus
TENWIVRNPGY

SEQ ID NO: 238410 - protein, 11 aa, Japanese encephalitis virus
ENWIVRNPGYA

SEQ ID NO: 238411 - protein, 11 aa, Japanese encephalitis virus
NWIVRNPGYAF

SEQ ID NO: 238412 - protein, 11 aa, Japanese encephalitis virus
WIVRNPGYAFL

SEQ ID NO: 238413 - protein, 11 aa, Japanese encephalitis virus
IVRNPGYAFLA

SEQ ID NO: 238414 - protein, 11 aa, Japanese encephalitis virus
VRNPGYAFLAA

SEQ ID NO: 238415 - protein, 11 aa, Japanese encephalitis virus
GPRVVFTILLL

SEQ ID NO: 238416 - protein, 11 aa, Japanese encephalitis virus
QRLGFTILLLL

SEQ ID NO: 238417 - protein, 11 aa, Japanese encephalitis virus
RVVFTILPLLV

SEQ ID NO: 238418 - protein, 11 aa, Japanese encephalitis virus
LGFTILLLLVA

SEQ ID NO: 238419 - protein, 11 aa, Japanese encephalitis virus
GFTILLLLVAP

SEQ ID NO: 238420 - protein, 11 aa, Japanese encephalitis virus
FTILPLLVAPA

SEQ ID NO: 238421 - protein, 11 aa, Japanese encephalitis virus
TILPLLVAPAY

SEQ ID NO: 238422 - protein, 11 aa, Japanese encephalitis virus
ILPLLVAPAYS

SEQ ID NO: 238423 - protein, 11 aa, Japanese encephalitis virus
LPLLVAPAYSF

SEQ ID NO: 238424 - protein, 11 aa, Japanese encephalitis virus
LLLVAPAYSFT

SEQ ID NO: 238425 - protein, 11 aa, Japanese encephalitis virus
LLVAPAYSFTC

SEQ ID NO: 238426 - protein, 11 aa, Japanese encephalitis virus
LVAPAYSFTCL

SEQ ID NO: 238427 - protein, 11 aa, Japanese encephalitis virus
VAPAYSFTCLG

SEQ ID NO: 238428 - protein, 11 aa, Japanese encephalitis virus
APAYSFTCLGM

SEQ ID NO: 238429 - protein, 11 aa, Japanese encephalitis virus
PAYSFTCLGMG

SEQ ID NO: 238430 - protein, 11 aa, Japanese encephalitis virus
AYSFTCLGMGN

SEQ ID NO: 238431 - protein, 11 aa, Japanese encephalitis virus
YSFTCLGMGNR

SEQ ID NO: 238432 - protein, 11 aa, Japanese encephalitis virus
SFTCLGMGNRD

SEQ ID NO: 238433 - protein, 11 aa, Japanese encephalitis virus
FTCLGMGNRDF

SEQ ID NO: 238434 - protein, 11 aa, Japanese encephalitis virus
TCLGMGNRDFI

SEQ ID NO: 238435 - protein, 11 aa, Japanese encephalitis virus
CLGMGNRDFVE

SEQ ID NO: 238436 - protein, 11 aa, Japanese encephalitis virus
LGMGNRDFVEG

SEQ ID NO: 238437 - protein, 11 aa, Japanese encephalitis virus
GMGNRDFIERA

SEQ ID NO: 238438 - protein, 11 aa, Japanese encephalitis virus
MGNRDFVEGAS

SEQ ID NO: 238439 - protein, 11 aa, Japanese encephalitis virus
GNRDFIEGVSG

SEQ ID NO: 238440 - protein, 11 aa, Japanese encephalitis virus
NRDFIERASGA

SEQ ID NO: 238441 - protein, 11 aa, Japanese encephalitis virus
RDFVEGASGAT

SEQ ID NO: 238442 - protein, 11 aa, Japanese encephalitis virus
DFVEGASGATW

SEQ ID NO: 238443 - protein, 11 aa, Japanese encephalitis virus
FVEGASGATWV

SEQ ID NO: 238444 - protein, 11 aa, Japanese encephalitis virus
IEGVSGATWVD

SEQ ID NO: 238445 - protein, 11 aa, Japanese encephalitis virus
QGASGATWVDL

SEQ ID NO: 238446 - protein, 11 aa, Japanese encephalitis virus
GVSGATWVDLV

SEQ ID NO: 238447 - protein, 11 aa, Japanese encephalitis virus
VSGATWVDLVL

SEQ ID NO: 238448 - protein, 11 aa, Japanese encephalitis virus
EGDSCLTIMAS

SEQ ID NO: 238449 - protein, 11 aa, Japanese encephalitis virus
GDSCLTIMASD

SEQ ID NO: 238450 - protein, 11 aa, Japanese encephalitis virus
DSCLTIMASDK

SEQ ID NO: 238451 - protein, 11 aa, Japanese encephalitis virus
SCLTIMASDKP

SEQ ID NO: 238452 - protein, 11 aa, Japanese encephalitis virus
CLTIMASDKPT

SEQ ID NO: 238453 - protein, 11 aa, Japanese encephalitis virus
LTIMASDKPTL

SEQ ID NO: 238454 - protein, 11 aa, Japanese encephalitis virus
TIMASDKPTLD

SEQ ID NO: 238455 - protein, 11 aa, Japanese encephalitis virus
IMASDKPTLDV

SEQ ID NO: 238456 - protein, 11 aa, Japanese encephalitis virus
MASDKPTLDVR

SEQ ID NO: 238457 - protein, 11 aa, Japanese encephalitis virus
ASDKPTLDVRM

SEQ ID NO: 238458 - protein, 11 aa, Japanese encephalitis virus
SDKPTLDVRMI

SEQ ID NO: 238459 - protein, 11 aa, Japanese encephalitis virus
DKPTLDVRMTN

SEQ ID NO: 238460 - protein, 11 aa, Japanese encephalitis virus
KPTLDVRMTNI

SEQ ID NO: 238461 - protein, 11 aa, Japanese encephalitis virus
PTLDRRMINIE

SEQ ID NO: 238462 - protein, 11 aa, Japanese encephalitis virus
TLDVRMTNIEA

SEQ ID NO: 238463 - protein, 11 aa, Japanese encephalitis virus
LDVRMINIEAV

SEQ ID NO: 238464 - protein, 11 aa, Japanese encephalitis virus
DVRMINIEAVQ

SEQ ID NO: 238465 - protein, 11 aa, Japanese encephalitis virus
VRMINIEAVQL

SEQ ID NO: 238466 - protein, 11 aa, Japanese encephalitis virus
RMINIEAVQLA

SEQ ID NO: 238467 - protein, 11 aa, Japanese encephalitis virus
MINIEAVQLAE

SEQ ID NO: 238468 - protein, 11 aa, Japanese encephalitis virus
INIEAVQLAEV

SEQ ID NO: 238469 - protein, 11 aa, Japanese encephalitis virus
NIEAVQLAEVR

SEQ ID NO: 238470 - protein, 11 aa, Japanese encephalitis virus
IEAVQLAEVRS

SEQ ID NO: 238471 - protein, 11 aa, Japanese encephalitis virus
EAVQLAEVRSY

SEQ ID NO: 238472 - protein, 11 aa, Japanese encephalitis virus
AVQLAEVRSYC

SEQ ID NO: 238473 - protein, 11 aa, Japanese encephalitis virus
VQLAEVRSYCY

SEQ ID NO: 238474 - protein, 11 aa, Japanese encephalitis virus
QLAEVRSYCYR

SEQ ID NO: 238475 - protein, 11 aa, Japanese encephalitis virus
LAEVRSYCYRA

SEQ ID NO: 238476 - protein, 11 aa, Japanese encephalitis virus
AEVRSYCYRAS

SEQ ID NO: 238477 - protein, 11 aa, Japanese encephalitis virus
EVRSYCYRASV

SEQ ID NO: 238478 - protein, 11 aa, Japanese encephalitis virus
VRSYCYRASVT

SEQ ID NO: 238479 - protein, 11 aa, Japanese encephalitis virus
RSYCYRASVTD

SEQ ID NO: 238480 - protein, 11 aa, Japanese encephalitis virus
SYCYRASVTDI

SEQ ID NO: 238481 - protein, 11 aa, Japanese encephalitis virus
YYYHASVTDIS

SEQ ID NO: 238482 - protein, 11 aa, Japanese encephalitis virus
YYHASVTDIST

SEQ ID NO: 238483 - protein, 11 aa, Japanese encephalitis virus
YRASVTDISTV

SEQ ID NO: 238484 - protein, 11 aa, Japanese encephalitis virus
RASVTDISTVA

SEQ ID NO: 238485 - protein, 11 aa, Japanese encephalitis virus
TDISTVARCPM

SEQ ID NO: 238486 - protein, 11 aa, Japanese encephalitis virus
DISTVARCPMT

SEQ ID NO: 238487 - protein, 11 aa, Japanese encephalitis virus
ISTVARCPMTG

SEQ ID NO: 238488 - protein, 11 aa, Japanese encephalitis virus
STVARCPMTGE

SEQ ID NO: 238489 - protein, 11 aa, Japanese encephalitis virus
TVARCPMTGEA

SEQ ID NO: 238490 - protein, 11 aa, Japanese encephalitis virus
VARCPMTGEAH

SEQ ID NO: 238491 - protein, 11 aa, Japanese encephalitis virus
ARCPMTGEAHN

SEQ ID NO: 238492 - protein, 11 aa, Japanese encephalitis virus
RCPMTGEAHNE

SEQ ID NO: 238493 - protein, 11 aa, Japanese encephalitis virus
CPMTGEAHNEK

SEQ ID NO: 238494 - protein, 11 aa, Japanese encephalitis virus
PMTGEAHNEKR

SEQ ID NO: 238495 - protein, 11 aa, Japanese encephalitis virus
MTGEAHNEKRA

SEQ ID NO: 238496 - protein, 11 aa, Japanese encephalitis virus
TGEAHNEKGAD

SEQ ID NO: 238497 - protein, 11 aa, Japanese encephalitis virus
GEAHNEKQADS

SEQ ID NO: 238498 - protein, 11 aa, Japanese encephalitis virus
EAHNKKRADSS

SEQ ID NO: 238499 - protein, 11 aa, Japanese encephalitis virus
AHNEKQADSSY

SEQ ID NO: 238500 - protein, 11 aa, Japanese encephalitis virus
HNKKRADSSYV

SEQ ID NO: 238501 - protein, 11 aa, Japanese encephalitis virus
NKKRADSSYVC

SEQ ID NO: 238502 - protein, 11 aa, Japanese encephalitis virus
KKRADSSYVCK

SEQ ID NO: 238503 - protein, 11 aa, Japanese encephalitis virus
KGADSSYVCKQ

SEQ ID NO: 238504 - protein, 11 aa, Japanese encephalitis virus
GADSSYVCKQG

SEQ ID NO: 238505 - protein, 11 aa, Japanese encephalitis virus
CKQGFTDRGWR

SEQ ID NO: 238506 - protein, 11 aa, Japanese encephalitis virus
KQGFTDRGWRN

SEQ ID NO: 238507 - protein, 11 aa, Japanese encephalitis virus
QGFTDRGWGKG

SEQ ID NO: 238508 - protein, 11 aa, Japanese encephalitis virus
GFTDRGWRNGC

SEQ ID NO: 238509 - protein, 11 aa, Japanese encephalitis virus
FTDRGWGKGCG

SEQ ID NO: 238510 - protein, 11 aa, Japanese encephalitis virus
TDRGWGNGCGF

SEQ ID NO: 238511 - protein, 11 aa, Japanese encephalitis virus
DRGWGNGCGFF

SEQ ID NO: 238512 - protein, 11 aa, Japanese encephalitis virus
RGWGNGCGFFG

SEQ ID NO: 238513 - protein, 11 aa, Japanese encephalitis virus
GWGNGCGFFGK

SEQ ID NO: 238514 - protein, 11 aa, Japanese encephalitis virus
WGNGCGFFGKG

SEQ ID NO: 238515 - protein, 11 aa, Japanese encephalitis virus
GNGCGFFGKGS

SEQ ID NO: 238516 - protein, 11 aa, Japanese encephalitis virus
NGCGFFGKGSI

SEQ ID NO: 238517 - protein, 11 aa, Japanese encephalitis virus
GCGFFGKGSID

SEQ ID NO: 238518 - protein, 11 aa, Japanese encephalitis virus
CGFFGKGSIDT

SEQ ID NO: 238519 - protein, 11 aa, Japanese encephalitis virus
GFFGKGSIDTC

SEQ ID NO: 238520 - protein, 11 aa, Japanese encephalitis virus
FFGKGSIDTCA

SEQ ID NO: 238521 - protein, 11 aa, Japanese encephalitis virus
SGKGSIDTCAK

SEQ ID NO: 238522 - protein, 11 aa, Japanese encephalitis virus
IDTCAKFSCTR

SEQ ID NO: 238523 - protein, 11 aa, Japanese encephalitis virus
DTCAKFSCTRK

SEQ ID NO: 238524 - protein, 11 aa, Japanese encephalitis virus
TCAKFSCTRKA

SEQ ID NO: 238525 - protein, 11 aa, Japanese encephalitis virus
CAKFSCTRKAI

SEQ ID NO: 238526 - protein, 11 aa, Japanese encephalitis virus
AKFSCTRKAIG

SEQ ID NO: 238527 - protein, 11 aa, Japanese encephalitis virus
KFSCTRKAIGR

SEQ ID NO: 238528 - protein, 11 aa, Japanese encephalitis virus
IQPENIKYKVG

SEQ ID NO: 238529 - protein, 11 aa, Japanese encephalitis virus
QPENIKYKVGI

SEQ ID NO: 238530 - protein, 11 aa, Japanese encephalitis virus
PENIKYKVGIF

SEQ ID NO: 238531 - protein, 11 aa, Japanese encephalitis virus
ENIKYKVGIFV

SEQ ID NO: 238532 - protein, 11 aa, Japanese encephalitis virus
NIKYKVGIFVH

SEQ ID NO: 238533 - protein, 11 aa, Japanese encephalitis virus
IKYKVGIFVHG

SEQ ID NO: 238534 - protein, 11 aa, Japanese encephalitis virus
KYKVGIFVHGT

SEQ ID NO: 238535 - protein, 11 aa, Japanese encephalitis virus
YKVGIFVHGTT

SEQ ID NO: 238536 - protein, 11 aa, Japanese encephalitis virus
KVGIFVHGTTT

SEQ ID NO: 238537 - protein, 11 aa, Japanese encephalitis virus
VGIFVHGATTS

SEQ ID NO: 238538 - protein, 11 aa, Japanese encephalitis virus
GIFVHGATTSE

SEQ ID NO: 238539 - protein, 11 aa, Japanese encephalitis virus
IFVHGATTSEN

SEQ ID NO: 238540 - protein, 11 aa, Japanese encephalitis virus
FVHGATTSENH

SEQ ID NO: 238541 - protein, 11 aa, Japanese encephalitis virus
VHGATTSENHG

SEQ ID NO: 238542 - protein, 11 aa, Japanese encephalitis virus
HGATTSENHGN

SEQ ID NO: 238543 - protein, 11 aa, Japanese encephalitis virus
GATTSENHGNY

SEQ ID NO: 238544 - protein, 11 aa, Japanese encephalitis virus
ATTSENHGNYS

SEQ ID NO: 238545 - protein, 11 aa, Japanese encephalitis virus
TTSENHGNYTA

SEQ ID NO: 238546 - protein, 11 aa, Japanese encephalitis virus
TSENHGNYTAQ

SEQ ID NO: 238547 - protein, 11 aa, Japanese encephalitis virus
SENHGNYTAQI

SEQ ID NO: 238548 - protein, 11 aa, Japanese encephalitis virus
ENHGNYTAQIG

SEQ ID NO: 238549 - protein, 11 aa, Japanese encephalitis virus
NHGNYSAQVGT

SEQ ID NO: 238550 - protein, 11 aa, Japanese encephalitis virus
HGNYSAQVGTS

SEQ ID NO: 238551 - protein, 11 aa, Japanese encephalitis virus
GNYSAQVGTSQ

SEQ ID NO: 238552 - protein, 11 aa, Japanese encephalitis virus
NYSAQVGTSQA

SEQ ID NO: 238553 - protein, 11 aa, Japanese encephalitis virus
YSAQVGTSQAA

SEQ ID NO: 238554 - protein, 11 aa, Japanese encephalitis virus
SAQVGTSQAAK

SEQ ID NO: 238555 - protein, 11 aa, Japanese encephalitis virus
AQVGTSQAAKF

SEQ ID NO: 238556 - protein, 11 aa, Japanese encephalitis virus
QVGTSQAAKFT

SEQ ID NO: 238557 - protein, 11 aa, Japanese encephalitis virus
GASQAAKFTIT

SEQ ID NO: 238558 - protein, 11 aa, Japanese encephalitis virus
ASQAAKFTITP

SEQ ID NO: 238559 - protein, 11 aa, Japanese encephalitis virus
SQAAKFTITPN

SEQ ID NO: 238560 - protein, 11 aa, Japanese encephalitis virus
QAAKFTITPNA

SEQ ID NO: 238561 - protein, 11 aa, Japanese encephalitis virus
AAKFTITPNAP

SEQ ID NO: 238562 - protein, 11 aa, Japanese encephalitis virus
AKFTITPNAPS

SEQ ID NO: 238563 - protein, 11 aa, Japanese encephalitis virus
KFTVTPNAPSV

SEQ ID NO: 238564 - protein, 11 aa, Japanese encephalitis virus
FTVTPNAPSTT

SEQ ID NO: 238565 - protein, 11 aa, Japanese encephalitis virus
TITPNAPSITL

SEQ ID NO: 238566 - protein, 11 aa, Japanese encephalitis virus
TPNAPSTTLKL

SEQ ID NO: 238567 - protein, 11 aa, Japanese encephalitis virus
PNAPSTTLKLG

SEQ ID NO: 238568 - protein, 11 aa, Japanese encephalitis virus
NAPSTTLKLGD

SEQ ID NO: 238569 - protein, 11 aa, Japanese encephalitis virus
ALKLGDYGEVT

SEQ ID NO: 238570 - protein, 11 aa, Japanese encephalitis virus
LELGDYGEVTL

SEQ ID NO: 238571 - protein, 11 aa, Japanese encephalitis virus
KLGDFGEVTLD

SEQ ID NO: 238572 - protein, 11 aa, Japanese encephalitis virus
LGDFGEVTLDC

SEQ ID NO: 238573 - protein, 11 aa, Japanese encephalitis virus
GDFGEVTLDCE

SEQ ID NO: 238574 - protein, 11 aa, Japanese encephalitis virus
DYGEVTLDCEA

SEQ ID NO: 238575 - protein, 11 aa, Japanese encephalitis virus
FGEVTLDCEPK

SEQ ID NO: 238576 - protein, 11 aa, Japanese encephalitis virus
GEVTLDCEARS

SEQ ID NO: 238577 - protein, 11 aa, Japanese encephalitis virus
EVTLDCEARSG

SEQ ID NO: 238578 - protein, 11 aa, Japanese encephalitis virus
VTLDCEARSGL

SEQ ID NO: 238579 - protein, 11 aa, Japanese encephalitis virus
TLDCEARSGLN

SEQ ID NO: 238580 - protein, 11 aa, Japanese encephalitis virus
LDCEARSGLNT

SEQ ID NO: 238581 - protein, 11 aa, Japanese encephalitis virus
DCEARSGLNTE

SEQ ID NO: 238582 - protein, 11 aa, Japanese encephalitis virus
CEPKSGLNTEA

SEQ ID NO: 238583 - protein, 11 aa, Japanese encephalitis virus
EPKSGLNTEAF

SEQ ID NO: 238584 - protein, 11 aa, Japanese encephalitis virus
PKSGLNTEAFY

SEQ ID NO: 238585 - protein, 11 aa, Japanese encephalitis virus
KSGLNTEAFYV

SEQ ID NO: 238586 - protein, 11 aa, Japanese encephalitis virus
TEAFYVMTVGP

SEQ ID NO: 238587 - protein, 11 aa, Japanese encephalitis virus
EAFYVMTVGSR

SEQ ID NO: 238588 - protein, 11 aa, Japanese encephalitis virus
AFYVMTVGSRS

SEQ ID NO: 238589 - protein, 11 aa, Japanese encephalitis virus
FYVMTVGSRSF

SEQ ID NO: 238590 - protein, 11 aa, Japanese encephalitis virus
YVMTVGSRSFL

SEQ ID NO: 238591 - protein, 11 aa, Japanese encephalitis virus
VMTVGSRSFLV

SEQ ID NO: 238592 - protein, 11 aa, Japanese encephalitis virus
MTVGSRSFLVH

SEQ ID NO: 238593 - protein, 11 aa, Japanese encephalitis virus
TVGSRSFLVHR

SEQ ID NO: 238594 - protein, 11 aa, Japanese encephalitis virus
VGSRSFLVHRE

SEQ ID NO: 238595 - protein, 11 aa, Japanese encephalitis virus
GSRSFLVHREW

SEQ ID NO: 238596 - protein, 11 aa, Japanese encephalitis virus
SRSFLVHREWF

SEQ ID NO: 238597 - protein, 11 aa, Japanese encephalitis virus
RSFLVHREWFH

SEQ ID NO: 238598 - protein, 11 aa, Japanese encephalitis virus
SLLVHREWFHD

SEQ ID NO: 238599 - protein, 11 aa, Japanese encephalitis virus
LLVHREWFHDL

SEQ ID NO: 238600 - protein, 11 aa, Japanese encephalitis virus
LVHREWFHDLS

SEQ ID NO: 238601 - protein, 11 aa, Japanese encephalitis virus
VHREWFHDLSL

SEQ ID NO: 238602 - protein, 11 aa, Japanese encephalitis virus
HREWFHDLSLP

SEQ ID NO: 238603 - protein, 11 aa, Japanese encephalitis virus
REWFHDLSLPW

SEQ ID NO: 238604 - protein, 11 aa, Japanese encephalitis virus
EWFHDLSLPWT

SEQ ID NO: 238605 - protein, 11 aa, Japanese encephalitis virus
WFHDLSLPWTS

SEQ ID NO: 238606 - protein, 11 aa, Japanese encephalitis virus
FHDLSLPWTSP

SEQ ID NO: 238607 - protein, 11 aa, Japanese encephalitis virus
HDLSLPWTSPS

SEQ ID NO: 238608 - protein, 11 aa, Japanese encephalitis virus
DLSLPWTSPSS

SEQ ID NO: 238609 - protein, 11 aa, Japanese encephalitis virus
LSLPWTSPSST

SEQ ID NO: 238610 - protein, 11 aa, Japanese encephalitis virus
SLPWTSPSSTA

SEQ ID NO: 238611 - protein, 11 aa, Japanese encephalitis virus
LPWTPPSSTAW

SEQ ID NO: 238612 - protein, 11 aa, Japanese encephalitis virus
PWTPPSSTAWR

SEQ ID NO: 238613 - protein, 11 aa, Japanese encephalitis virus
WTPPSSTAWRN

SEQ ID NO: 238614 - protein, 11 aa, Japanese encephalitis virus
TPPSSTAWRNR

SEQ ID NO: 238615 - protein, 11 aa, Japanese encephalitis virus
PPSSTAWRNRE

SEQ ID NO: 238616 - protein, 11 aa, Japanese encephalitis virus
SSNTAWRNREL

SEQ ID NO: 238617 - protein, 11 aa, Japanese encephalitis virus
SNTAWRNRELL

SEQ ID NO: 238618 - protein, 11 aa, Japanese encephalitis virus
NTAWRNRELLM

SEQ ID NO: 238619 - protein, 11 aa, Japanese encephalitis virus
RNRELLMEFEG

SEQ ID NO: 238620 - protein, 11 aa, Japanese encephalitis virus
NRELLMEFEGA

SEQ ID NO: 238621 - protein, 11 aa, Japanese encephalitis virus
RELLMEFEGAH

SEQ ID NO: 238622 - protein, 11 aa, Japanese encephalitis virus
ELLMEFEGAHA

SEQ ID NO: 238623 - protein, 11 aa, Japanese encephalitis virus
LLMEFEGAHAT

SEQ ID NO: 238624 - protein, 11 aa, Japanese encephalitis virus
LMEFEGAHATK

SEQ ID NO: 238625 - protein, 11 aa, Japanese encephalitis virus
MEFEGAHATKQ

SEQ ID NO: 238626 - protein, 11 aa, Japanese encephalitis virus
EFEGAHATKQS

SEQ ID NO: 238627 - protein, 11 aa, Japanese encephalitis virus
FEGAHATKQSV

SEQ ID NO: 238628 - protein, 11 aa, Japanese encephalitis virus
EGAHATKQSVV

SEQ ID NO: 238629 - protein, 11 aa, Japanese encephalitis virus
GAHATKQSVVA

SEQ ID NO: 238630 - protein, 11 aa, Japanese encephalitis virus
TKQSVVALGSR

SEQ ID NO: 238631 - protein, 11 aa, Japanese encephalitis virus
KQSVVALGSRE

SEQ ID NO: 238632 - protein, 11 aa, Japanese encephalitis virus
QSVVALGSREG

SEQ ID NO: 238633 - protein, 11 aa, Japanese encephalitis virus
SVVALGSREGG

SEQ ID NO: 238634 - protein, 11 aa, Japanese encephalitis virus
VVALGSQERAL

SEQ ID NO: 238635 - protein, 11 aa, Japanese encephalitis virus
VALGSQEGSLH

SEQ ID NO: 238636 - protein, 11 aa, Japanese encephalitis virus
ALGSQEGGLHH

SEQ ID NO: 238637 - protein, 11 aa, Japanese encephalitis virus
LGSQEGGLHHA

SEQ ID NO: 238638 - protein, 11 aa, Japanese encephalitis virus
GSQEGGLHHAL

SEQ ID NO: 238639 - protein, 11 aa, Japanese encephalitis virus
SQEGGLHHALA

SEQ ID NO: 238640 - protein, 11 aa, Japanese encephalitis virus
QEGGLHHALAG

SEQ ID NO: 238641 - protein, 11 aa, Japanese encephalitis virus
EGGLHHALAGA

SEQ ID NO: 238642 - protein, 11 aa, Japanese encephalitis virus
GGLHHALAGAI

SEQ ID NO: 238643 - protein, 11 aa, Japanese encephalitis virus
GLHHALAGAIV

SEQ ID NO: 238644 - protein, 11 aa, Japanese encephalitis virus
LHHALAGAIVV

SEQ ID NO: 238645 - protein, 11 aa, Japanese encephalitis virus
HHALAGAIVVE

SEQ ID NO: 238646 - protein, 11 aa, Japanese encephalitis virus
HALAGAIVVEY

SEQ ID NO: 238647 - protein, 11 aa, Japanese encephalitis virus
ALAGAIVVEYP

SEQ ID NO: 238648 - protein, 11 aa, Japanese encephalitis virus
LAGAIVVEYSN

SEQ ID NO: 238649 - protein, 11 aa, Japanese encephalitis virus
AGAIVVEYPSS

SEQ ID NO: 238650 - protein, 11 aa, Japanese encephalitis virus
GAIVVEYPSSV

SEQ ID NO: 238651 - protein, 11 aa, Japanese encephalitis virus
AIVVEYSSSVM

SEQ ID NO: 238652 - protein, 11 aa, Japanese encephalitis virus
IVVEYSSSVML

SEQ ID NO: 238653 - protein, 11 aa, Japanese encephalitis virus
VVEYSSSVMLT

SEQ ID NO: 238654 - protein, 11 aa, Japanese encephalitis virus
VEYSSSVMLTS

SEQ ID NO: 238655 - protein, 11 aa, Japanese encephalitis virus
EYSSSVMLTSG

SEQ ID NO: 238656 - protein, 11 aa, Japanese encephalitis virus
YSSSVMLTSGH

SEQ ID NO: 238657 - protein, 11 aa, Japanese encephalitis virus
SSSVMLTSGHL

SEQ ID NO: 238658 - protein, 11 aa, Japanese encephalitis virus
SSVMLTSGHLK

SEQ ID NO: 238659 - protein, 11 aa, Japanese encephalitis virus
SVMLTSGHLKC

SEQ ID NO: 238660 - protein, 11 aa, Japanese encephalitis virus
VMLTSGHLKCR

SEQ ID NO: 238661 - protein, 11 aa, Japanese encephalitis virus
MLTSGHLKCRL

SEQ ID NO: 238662 - protein, 11 aa, Japanese encephalitis virus
LTSGHLKCRLR

SEQ ID NO: 238663 - protein, 11 aa, Japanese encephalitis virus
TSGHLKCRLRM

SEQ ID NO: 238664 - protein, 11 aa, Japanese encephalitis virus
SGHLKCRLRMD

SEQ ID NO: 238665 - protein, 11 aa, Japanese encephalitis virus
GHVKRRLKMDK

SEQ ID NO: 238666 - protein, 11 aa, Japanese encephalitis virus
HVKRRLKMDKL

SEQ ID NO: 238667 - protein, 11 aa, Japanese encephalitis virus
VKRRLKMDKLA

SEQ ID NO: 238668 - protein, 11 aa, Japanese encephalitis virus
KCRLRMDKLAL

SEQ ID NO: 238669 - protein, 11 aa, Japanese encephalitis virus
CRLRMDKLALK

SEQ ID NO: 238670 - protein, 11 aa, Japanese encephalitis virus
RLRMDKLALKG

SEQ ID NO: 238671 - protein, 11 aa, Japanese encephalitis virus
LRMDKLALKGT

SEQ ID NO: 238672 - protein, 11 aa, Japanese encephalitis virus
RMDKLALKGTT

SEQ ID NO: 238673 - protein, 11 aa, Japanese encephalitis virus
KLALKGTTYGV

SEQ ID NO: 238674 - protein, 11 aa, Japanese encephalitis virus
LALKGTTYGVC

SEQ ID NO: 238675 - protein, 11 aa, Japanese encephalitis virus
ALKGTTYGVCT

SEQ ID NO: 238676 - protein, 11 aa, Japanese encephalitis virus
LKGTTYGMCTG

SEQ ID NO: 238677 - protein, 11 aa, Japanese encephalitis virus
KGTTYGMCTGK

SEQ ID NO: 238678 - protein, 11 aa, Japanese encephalitis virus
GTTYGMCTGKF

SEQ ID NO: 238679 - protein, 11 aa, Japanese encephalitis virus
TTYGMCTGKFS

SEQ ID NO: 238680 - protein, 11 aa, Japanese encephalitis virus
TYGMCTGKFSF

SEQ ID NO: 238681 - protein, 11 aa, Japanese encephalitis virus
YGMCTGKFSFA

SEQ ID NO: 238682 - protein, 11 aa, Japanese encephalitis virus
GMCTGKFSFAK

SEQ ID NO: 238683 - protein, 11 aa, Japanese encephalitis virus
MCTGKFSFAKN

SEQ ID NO: 238684 - protein, 11 aa, Japanese encephalitis virus
CTGKFSFAKNP

SEQ ID NO: 238685 - protein, 11 aa, Japanese encephalitis virus
TGKFSFAKNPA

SEQ ID NO: 238686 - protein, 11 aa, Japanese encephalitis virus
GKFSFAKNPAD

SEQ ID NO: 238687 - protein, 11 aa, Japanese encephalitis virus
KFSFAKNPVDT

SEQ ID NO: 238688 - protein, 11 aa, Japanese encephalitis virus
FSFAKNPVDTG

SEQ ID NO: 238689 - protein, 11 aa, Japanese encephalitis virus
SFAKNPVDTGH

SEQ ID NO: 238690 - protein, 11 aa, Japanese encephalitis virus
FAKNPVDTGHG

SEQ ID NO: 238691 - protein, 11 aa, Japanese encephalitis virus
AKNPVDTGHGT

SEQ ID NO: 238692 - protein, 11 aa, Japanese encephalitis virus
KNPVDTGHGTV

SEQ ID NO: 238693 - protein, 11 aa, Japanese encephalitis virus
NPVDTGHGTVV

SEQ ID NO: 238694 - protein, 11 aa, Japanese encephalitis virus
PVDTGHGTVVI

SEQ ID NO: 238695 - protein, 11 aa, Japanese encephalitis virus
VDTGHGTVVIE

SEQ ID NO: 238696 - protein, 11 aa, Japanese encephalitis virus
TGHGTVVIELT

SEQ ID NO: 238697 - protein, 11 aa, Japanese encephalitis virus
GHGTVVIELTY

SEQ ID NO: 238698 - protein, 11 aa, Japanese encephalitis virus
HGTVVIELTYS

SEQ ID NO: 238699 - protein, 11 aa, Japanese encephalitis virus
GTVVIELTYSG

SEQ ID NO: 238700 - protein, 11 aa, Japanese encephalitis virus
TVVIELTYSGS

SEQ ID NO: 238701 - protein, 11 aa, Japanese encephalitis virus
VVIELTYSGSD

SEQ ID NO: 238702 - protein, 11 aa, Japanese encephalitis virus
VIELTYSGSDG

SEQ ID NO: 238703 - protein, 11 aa, Japanese encephalitis virus
IELTYSGSDGP

SEQ ID NO: 238704 - protein, 11 aa, Japanese encephalitis virus
ELTYSGSDGPC

SEQ ID NO: 238705 - protein, 11 aa, Japanese encephalitis virus
LTYSGSDGPCK

SEQ ID NO: 238706 - protein, 11 aa, Japanese encephalitis virus
TYSGSDGPCKI

SEQ ID NO: 238707 - protein, 11 aa, Japanese encephalitis virus
YSGRDGPCKIP

SEQ ID NO: 238708 - protein, 11 aa, Japanese encephalitis virus
SGSDGSCKIPI

SEQ ID NO: 238709 - protein, 11 aa, Japanese encephalitis virus
GRDGPCKIPIV

SEQ ID NO: 238710 - protein, 11 aa, Japanese encephalitis virus
SDGSCKIPIVS

SEQ ID NO: 238711 - protein, 11 aa, Japanese encephalitis virus
DGSCKIPIVSV

SEQ ID NO: 238712 - protein, 11 aa, Japanese encephalitis virus
GSCKIPIVSVA

SEQ ID NO: 238713 - protein, 11 aa, Japanese encephalitis virus
SCKIPIVSVAS

SEQ ID NO: 238714 - protein, 11 aa, Japanese encephalitis virus
CKIPIVSVANL

SEQ ID NO: 238715 - protein, 11 aa, Japanese encephalitis virus
KIPIVSVVSLN

SEQ ID NO: 238716 - protein, 11 aa, Japanese encephalitis virus
IPIVSVVSLND

SEQ ID NO: 238717 - protein, 11 aa, Japanese encephalitis virus
PIVSVASLNDL

SEQ ID NO: 238718 - protein, 11 aa, Japanese encephalitis virus
IVSVASLNDLT

SEQ ID NO: 238719 - protein, 11 aa, Japanese encephalitis virus
VSVASLNDLTP

SEQ ID NO: 238720 - protein, 11 aa, Japanese encephalitis virus
SVASLNDLTPV

SEQ ID NO: 238721 - protein, 11 aa, Japanese encephalitis virus
VASLNDLTPVG

SEQ ID NO: 238722 - protein, 11 aa, Japanese encephalitis virus
ASLNDLTPVGR

SEQ ID NO: 238723 - protein, 11 aa, Japanese encephalitis virus
SLNDLTPVGRL

SEQ ID NO: 238724 - protein, 11 aa, Japanese encephalitis virus
LNDLTPVGRLV

SEQ ID NO: 238725 - protein, 11 aa, Japanese encephalitis virus
NDLTPVGRLVT

SEQ ID NO: 238726 - protein, 11 aa, Japanese encephalitis virus
DLTPVGRLVTV

SEQ ID NO: 238727 - protein, 11 aa, Japanese encephalitis virus
LTPVGRLVTVN

SEQ ID NO: 238728 - protein, 11 aa, Japanese encephalitis virus
TPAGRLVTVNP

SEQ ID NO: 238729 - protein, 11 aa, Japanese encephalitis virus
PAGRLVTVNPF

SEQ ID NO: 238730 - protein, 11 aa, Japanese encephalitis virus
AGRLVTVNPFV

SEQ ID NO: 238731 - protein, 11 aa, Japanese encephalitis virus
RLVTVNPFVAA

SEQ ID NO: 238732 - protein, 11 aa, Japanese encephalitis virus
LVTVNPFVAAS

SEQ ID NO: 238733 - protein, 11 aa, Japanese encephalitis virus
VTVNPFVAASS

SEQ ID NO: 238734 - protein, 11 aa, Japanese encephalitis virus
TVNPFVATSSS

SEQ ID NO: 238735 - protein, 11 aa, Japanese encephalitis virus
VNPFVATSSSN

SEQ ID NO: 238736 - protein, 11 aa, Japanese encephalitis virus
NPFVATSSSNS

SEQ ID NO: 238737 - protein, 11 aa, Japanese encephalitis virus
PFVATSSSNSK

SEQ ID NO: 238738 - protein, 11 aa, Japanese encephalitis virus
FVATSSSNSKV

SEQ ID NO: 238739 - protein, 11 aa, Japanese encephalitis virus
VATSSSNSKVL

SEQ ID NO: 238740 - protein, 11 aa, Japanese encephalitis virus
SSSNSKVLVEM

SEQ ID NO: 238741 - protein, 11 aa, Japanese encephalitis virus
SSNSKVLVEME

SEQ ID NO: 238742 - protein, 11 aa, Japanese encephalitis virus
SNSKVLVEMEP

SEQ ID NO: 238743 - protein, 11 aa, Japanese encephalitis virus
NSKVLLEIEPP

SEQ ID NO: 238744 - protein, 11 aa, Japanese encephalitis virus
SKVLLEIEPPF

SEQ ID NO: 238745 - protein, 11 aa, Japanese encephalitis virus
KALVEMEPPFG

SEQ ID NO: 238746 - protein, 11 aa, Japanese encephalitis virus
ALVEMEPPFGD

SEQ ID NO: 238747 - protein, 11 aa, Japanese encephalitis virus
LLEIEPPFGDS

SEQ ID NO: 238748 - protein, 11 aa, Japanese encephalitis virus
LEIEPPFGDSY

SEQ ID NO: 238749 - protein, 11 aa, Japanese encephalitis virus
EIEPPFGDSYI

SEQ ID NO: 238750 - protein, 11 aa, Japanese encephalitis virus
IEPPFGDSYIV

SEQ ID NO: 238751 - protein, 11 aa, Japanese encephalitis virus
EPPFGDSYIVI

SEQ ID NO: 238752 - protein, 11 aa, Japanese encephalitis virus
PPFGDSYIVIG

SEQ ID NO: 238753 - protein, 11 aa, Japanese encephalitis virus
PFGDSYIVIGR

SEQ ID NO: 238754 - protein, 11 aa, Japanese encephalitis virus
FGDSYIVVGRK

SEQ ID NO: 238755 - protein, 11 aa, Japanese encephalitis virus
HHWHRAGSTLG

SEQ ID NO: 238756 - protein, 11 aa, Japanese encephalitis virus
HWHRAGSTLGK

SEQ ID NO: 238757 - protein, 11 aa, Japanese encephalitis virus
WHRAGSTLGKA

SEQ ID NO: 238758 - protein, 11 aa, Japanese encephalitis virus
HRAGSTLGKAF

SEQ ID NO: 238759 - protein, 11 aa, Japanese encephalitis virus
KAGSTLGKAFL

SEQ ID NO: 238760 - protein, 11 aa, Japanese encephalitis virus
AGSTLGKAFLT

SEQ ID NO: 238761 - protein, 11 aa, Japanese encephalitis virus
GSTLGKAFLTT

SEQ ID NO: 238762 - protein, 11 aa, Japanese encephalitis virus
STLGKAFLTTL

SEQ ID NO: 238763 - protein, 11 aa, Japanese encephalitis virus
TLGKAFLTTLK

SEQ ID NO: 238764 - protein, 11 aa, Japanese encephalitis virus
LGKAFLTTLKG

SEQ ID NO: 238765 - protein, 11 aa, Japanese encephalitis virus
GKAFLTTLKGA

SEQ ID NO: 238766 - protein, 11 aa, Japanese encephalitis virus
KAFLTTLKGAQ

SEQ ID NO: 238767 - protein, 11 aa, Japanese encephalitis virus
AFLTTLKGAQR

SEQ ID NO: 238768 - protein, 11 aa, Japanese encephalitis virus
FLTTLKGAQRL

SEQ ID NO: 238769 - protein, 11 aa, Japanese encephalitis virus
LTTLKGAQRLA

SEQ ID NO: 238770 - protein, 11 aa, Japanese encephalitis virus
TTLKGAQRLVA

SEQ ID NO: 238771 - protein, 11 aa, Japanese encephalitis virus
TLKGAQRLVAL

SEQ ID NO: 238772 - protein, 11 aa, Japanese encephalitis virus
LKGAQRLVALG

SEQ ID NO: 238773 - protein, 11 aa, Japanese encephalitis virus
KGAQRLVALGD

SEQ ID NO: 238774 - protein, 11 aa, Japanese encephalitis virus
GAQRLVALGDT

SEQ ID NO: 238775 - protein, 11 aa, Japanese encephalitis virus
AQRLVALGDTA

SEQ ID NO: 238776 - protein, 11 aa, Japanese encephalitis virus
QRLVALGDTAW

SEQ ID NO: 238777 - protein, 11 aa, Japanese encephalitis virus
RLVALGDTAWD

SEQ ID NO: 238778 - protein, 11 aa, Japanese encephalitis virus
LVALGDTAWDF

SEQ ID NO: 238779 - protein, 11 aa, Japanese encephalitis virus
VALGDTAWDFG

SEQ ID NO: 238780 - protein, 11 aa, Japanese encephalitis virus
DTAWDFGSIGR

SEQ ID NO: 238781 - protein, 11 aa, Japanese encephalitis virus
TAWDFGSIGGA

SEQ ID NO: 238782 - protein, 11 aa, Japanese encephalitis virus
AWDFGSIGGIF

SEQ ID NO: 238783 - protein, 11 aa, Japanese encephalitis virus
WDFGSIGGAFN

SEQ ID NO: 238784 - protein, 11 aa, Japanese encephalitis virus
DFGSIGGAFNS

SEQ ID NO: 238785 - protein, 11 aa, Japanese encephalitis virus
FGSIGGAFNSI

SEQ ID NO: 238786 - protein, 11 aa, Japanese encephalitis virus
GSIGGAFNSIG

SEQ ID NO: 238787 - protein, 11 aa, Japanese encephalitis virus
SIGGVFNSIGR

SEQ ID NO: 238788 - protein, 11 aa, Japanese encephalitis virus
IGGVFNSIGRA

SEQ ID NO: 238789 - protein, 11 aa, Japanese encephalitis virus
GGVFNSIGRAV

SEQ ID NO: 238790 - protein, 11 aa, Japanese encephalitis virus
GVFNSIGRAVH

SEQ ID NO: 238791 - protein, 11 aa, Japanese encephalitis virus
VFNSIGRAVHQ

SEQ ID NO: 238792 - protein, 11 aa, Japanese encephalitis virus
FNSIGRAVHQV

SEQ ID NO: 238793 - protein, 11 aa, Japanese encephalitis virus
NSIGRAVHQVF

SEQ ID NO: 238794 - protein, 11 aa, Japanese encephalitis virus
SIGRAVHQVFG

SEQ ID NO: 238795 - protein, 11 aa, Japanese encephalitis virus
IGRAVHQVFGG

SEQ ID NO: 238796 - protein, 11 aa, Japanese encephalitis virus
GRAVHQVFGGA

SEQ ID NO: 238797 - protein, 11 aa, Japanese encephalitis virus
RAVHQVFGGAF

SEQ ID NO: 238798 - protein, 11 aa, Japanese encephalitis virus
AVHQVFGDAFR

SEQ ID NO: 238799 - protein, 11 aa, Japanese encephalitis virus
VHQVFGDAFRT

SEQ ID NO: 238800 - protein, 11 aa, Japanese encephalitis virus
HQVFGDAFRTL

SEQ ID NO: 238801 - protein, 11 aa, Japanese encephalitis virus
QVFGDAFRTLF

SEQ ID NO: 238802 - protein, 11 aa, Japanese encephalitis virus
VFGDAFRTLFG

SEQ ID NO: 238803 - protein, 11 aa, Japanese encephalitis virus
FGDAFRTLFGG

SEQ ID NO: 238804 - protein, 11 aa, Japanese encephalitis virus
GDAFRTLFGGM

SEQ ID NO: 238805 - protein, 11 aa, Japanese encephalitis virus
DAFRTLFGGMS

SEQ ID NO: 238806 - protein, 11 aa, Japanese encephalitis virus
MSWITQGLMGV

SEQ ID NO: 238807 - protein, 11 aa, Japanese encephalitis virus
SWITQGLMGVL

SEQ ID NO: 238808 - protein, 11 aa, Japanese encephalitis virus
WITQGLMGVLL

SEQ ID NO: 238809 - protein, 11 aa, Japanese encephalitis virus
ITQGLMGVLLL

SEQ ID NO: 238810 - protein, 11 aa, Japanese encephalitis virus
TQGLMGVLLLW

SEQ ID NO: 238811 - protein, 11 aa, Japanese encephalitis virus
QGLMGVLLLWM

SEQ ID NO: 238812 - protein, 11 aa, Japanese encephalitis virus
GLMGVLLLWMG

SEQ ID NO: 238813 - protein, 11 aa, Japanese encephalitis virus
LMGALLLWMGI

SEQ ID NO: 238814 - protein, 11 aa, Japanese encephalitis virus
MGALLLWMGIN

SEQ ID NO: 238815 - protein, 11 aa, Japanese encephalitis virus
GALLLWMGINA

SEQ ID NO: 238816 - protein, 11 aa, Japanese encephalitis virus
ALLLWMGINAR

SEQ ID NO: 238817 - protein, 11 aa, Japanese encephalitis virus
LLLWMGINARD

SEQ ID NO: 238818 - protein, 11 aa, Japanese encephalitis virus
LLWMGINARDR

SEQ ID NO: 238819 - protein, 11 aa, Japanese encephalitis virus
LWMGINARDRS

SEQ ID NO: 238820 - protein, 11 aa, Japanese encephalitis virus
WMGINARDRSI

SEQ ID NO: 238821 - protein, 11 aa, Japanese encephalitis virus
MGINARDRSIA

SEQ ID NO: 238822 - protein, 11 aa, Japanese encephalitis virus
GINARDRSIAL

SEQ ID NO: 238823 - protein, 11 aa, Japanese encephalitis virus
INARDRSIALA

SEQ ID NO: 238824 - protein, 11 aa, Japanese encephalitis virus
NARDRSIAMAF

SEQ ID NO: 238825 - protein, 11 aa, Japanese encephalitis virus
ARDRSIAMAFL

SEQ ID NO: 238826 - protein, 11 aa, Japanese encephalitis virus
RDRSIAMAFLV

SEQ ID NO: 238827 - protein, 11 aa, Japanese encephalitis virus
DRSIAMAFLVT

SEQ ID NO: 238828 - protein, 11 aa, Japanese encephalitis virus
RSIAMAFLVTG

SEQ ID NO: 238829 - protein, 11 aa, Japanese encephalitis virus
SIAMAFLVTGG

SEQ ID NO: 238830 - protein, 11 aa, Japanese encephalitis virus
IAMAFLVTGGT

SEQ ID NO: 238831 - protein, 11 aa, Japanese encephalitis virus
AMAFLVTGGTL

SEQ ID NO: 238832 - protein, 11 aa, Japanese encephalitis virus
MAFLVTGGTLL

SEQ ID NO: 238833 - protein, 11 aa, Japanese encephalitis virus
AFLVTGGTLLF

SEQ ID NO: 238834 - protein, 11 aa, Japanese encephalitis virus
FLVTGGTLLFL

SEQ ID NO: 238835 - protein, 11 aa, Japanese encephalitis virus
LVTGGTLLFLA

SEQ ID NO: 238836 - protein, 11 aa, Japanese encephalitis virus
VTGGTLLFLAT

SEQ ID NO: 238837 - protein, 11 aa, Japanese encephalitis virus
TGGTLLFLATN

SEQ ID NO: 238838 - protein, 11 aa, Japanese encephalitis virus
GGTLLFLATNV

SEQ ID NO: 238839 - protein, 11 aa, Japanese encephalitis virus
GTLLFLATNVH

SEQ ID NO: 238840 - protein, 11 aa, Japanese encephalitis virus
TLLFLATNVHA

SEQ ID NO: 238841 - protein, 11 aa, Japanese encephalitis virus
LLFLATNVHAD

SEQ ID NO: 238842 - protein, 11 aa, Japanese encephalitis virus
LFLATNVHADT

SEQ ID NO: 238843 - protein, 11 aa, Japanese encephalitis virus
LATNVHADTGS

SEQ ID NO: 238844 - protein, 11 aa, Japanese encephalitis virus
ATNVHADTGSA

SEQ ID NO: 238845 - protein, 11 aa, Japanese encephalitis virus
TNVHADTGSAI

SEQ ID NO: 238846 - protein, 11 aa, Japanese encephalitis virus
NVHADTGSAID

SEQ ID NO: 238847 - protein, 11 aa, Japanese encephalitis virus
VHADTGCAIDT

SEQ ID NO: 238848 - protein, 11 aa, Japanese encephalitis virus
HADTGCAIDIA

SEQ ID NO: 238849 - protein, 11 aa, Japanese encephalitis virus
ADTGCAIDIAR

SEQ ID NO: 238850 - protein, 11 aa, Japanese encephalitis virus
TRREMRCGSGI

SEQ ID NO: 238851 - protein, 11 aa, Japanese encephalitis virus
RREMRCGSGIF

SEQ ID NO: 238852 - protein, 11 aa, Japanese encephalitis virus
REMRCGSGIFV

SEQ ID NO: 238853 - protein, 11 aa, Japanese encephalitis virus
QMRCGSGIFVH

SEQ ID NO: 238854 - protein, 11 aa, Japanese encephalitis virus
DRYKYLPETPK

SEQ ID NO: 238855 - protein, 11 aa, Japanese encephalitis virus
RYKYLPETPRA

SEQ ID NO: 238856 - protein, 11 aa, Japanese encephalitis virus
YKYLPETPKSL

SEQ ID NO: 238857 - protein, 11 aa, Japanese encephalitis virus
KYLPETPKSLA

SEQ ID NO: 238858 - protein, 11 aa, Japanese encephalitis virus
YLPETPKSLAK

SEQ ID NO: 238859 - protein, 11 aa, Japanese encephalitis virus
LPETPRALAKI

SEQ ID NO: 238860 - protein, 11 aa, Japanese encephalitis virus
PETPKSLAKIV

SEQ ID NO: 238861 - protein, 11 aa, Japanese encephalitis virus
ETPRALAKIVH

SEQ ID NO: 238862 - protein, 11 aa, Japanese encephalitis virus
TPRALAKIVHK

SEQ ID NO: 238863 - protein, 11 aa, Japanese encephalitis virus
PRALAKIVHKA

SEQ ID NO: 238864 - protein, 11 aa, Japanese encephalitis virus
RALAKIVHKAH

SEQ ID NO: 238865 - protein, 11 aa, Japanese encephalitis virus
SLAKIVHKAHQ

SEQ ID NO: 238866 - protein, 11 aa, Japanese encephalitis virus
LAKIVHKAHQE

SEQ ID NO: 238867 - protein, 11 aa, Japanese encephalitis virus
AKIVHKAHQEG

SEQ ID NO: 238868 - protein, 11 aa, Japanese encephalitis virus
KIVHKAHQEGV

SEQ ID NO: 238869 - protein, 11 aa, Japanese encephalitis virus
IVHKAHQEGVC

SEQ ID NO: 238870 - protein, 11 aa, Japanese encephalitis virus
VHKAHQEGVCG

SEQ ID NO: 238871 - protein, 11 aa, Japanese encephalitis virus
HKAHQEGVCGV

SEQ ID NO: 238872 - protein, 11 aa, Japanese encephalitis virus
KAHQEGVCGVR

SEQ ID NO: 238873 - protein, 11 aa, Japanese encephalitis virus
AHQEGVCGVRS

SEQ ID NO: 238874 - protein, 11 aa, Japanese encephalitis virus
HQEGVCGVRSV

SEQ ID NO: 238875 - protein, 11 aa, Japanese encephalitis virus
QEGVCGVRSVT

SEQ ID NO: 238876 - protein, 11 aa, Japanese encephalitis virus
EGVCGIRSVTR

SEQ ID NO: 238877 - protein, 11 aa, Japanese encephalitis virus
GICGVRSVTRL

SEQ ID NO: 238878 - protein, 11 aa, Japanese encephalitis virus
ICGVRSVTRLE

SEQ ID NO: 238879 - protein, 11 aa, Japanese encephalitis virus
CGIRSVTRLEH

SEQ ID NO: 238880 - protein, 11 aa, Japanese encephalitis virus
GIRSVTRLEHQ

SEQ ID NO: 238881 - protein, 11 aa, Japanese encephalitis virus
IRSVTRLEHQM

SEQ ID NO: 238882 - protein, 11 aa, Japanese encephalitis virus
VTRLEHQMWES

SEQ ID NO: 238883 - protein, 11 aa, Japanese encephalitis virus
TRLEHQMWESV

SEQ ID NO: 238884 - protein, 11 aa, Japanese encephalitis virus
RLEHQMWESVR

SEQ ID NO: 238885 - protein, 11 aa, Japanese encephalitis virus
LEHQMWESVRD

SEQ ID NO: 238886 - protein, 11 aa, Japanese encephalitis virus
EHQMWESVRDE

SEQ ID NO: 238887 - protein, 11 aa, Japanese encephalitis virus
HQMWESVRDEL

SEQ ID NO: 238888 - protein, 11 aa, Japanese encephalitis virus
QMWESVRDELN

SEQ ID NO: 238889 - protein, 11 aa, Japanese encephalitis virus
MWESVRDELNV

SEQ ID NO: 238890 - protein, 11 aa, Japanese encephalitis virus
WESVRDELNVL

SEQ ID NO: 238891 - protein, 11 aa, Japanese encephalitis virus
ESVRDELNVLL

SEQ ID NO: 238892 - protein, 11 aa, Japanese encephalitis virus
SVRDELNVLLK

SEQ ID NO: 238893 - protein, 11 aa, Japanese encephalitis virus
VRDELNVPLKE

SEQ ID NO: 238894 - protein, 11 aa, Japanese encephalitis virus
RDELNVPLKEN

SEQ ID NO: 238895 - protein, 11 aa, Japanese encephalitis virus
DELNVPLKENA

SEQ ID NO: 238896 - protein, 11 aa, Japanese encephalitis virus
ELNVPLKENAV

SEQ ID NO: 238897 - protein, 11 aa, Japanese encephalitis virus
LNVPLKENAVD

SEQ ID NO: 238898 - protein, 11 aa, Japanese encephalitis virus
NVPLKENAVDL

SEQ ID NO: 238899 - protein, 11 aa, Japanese encephalitis virus
VPLKENAVDLS

SEQ ID NO: 238900 - protein, 11 aa, Japanese encephalitis virus
PLKENAVDLSV

SEQ ID NO: 238901 - protein, 11 aa, Japanese encephalitis virus
VNKPVGRYRST

SEQ ID NO: 238902 - protein, 11 aa, Japanese encephalitis virus
NKPVGRYRSTP

SEQ ID NO: 238903 - protein, 11 aa, Japanese encephalitis virus
KPVGRYRSTPK

SEQ ID NO: 238904 - protein, 11 aa, Japanese encephalitis virus
PVGRYRSTPKR

SEQ ID NO: 238905 - protein, 11 aa, Japanese encephalitis virus
VGRYRSTPKRL

SEQ ID NO: 238906 - protein, 11 aa, Japanese encephalitis virus
GRYRSTPKRLS

SEQ ID NO: 238907 - protein, 11 aa, Japanese encephalitis virus
RYRSAPKRLFM

SEQ ID NO: 238908 - protein, 11 aa, Japanese encephalitis virus
YRSTPKRLSMT

SEQ ID NO: 238909 - protein, 11 aa, Japanese encephalitis virus
RSTPKRLSMTQ

SEQ ID NO: 238910 - protein, 11 aa, Japanese encephalitis virus
SAPKRLFMTQE

SEQ ID NO: 238911 - protein, 11 aa, Japanese encephalitis virus
APKRLFMTQEK

SEQ ID NO: 238912 - protein, 11 aa, Japanese encephalitis virus
PKRLFMTQEKV

SEQ ID NO: 238913 - protein, 11 aa, Japanese encephalitis virus
KRLSMTREKFE

SEQ ID NO: 238914 - protein, 11 aa, Japanese encephalitis virus
RLFMTQEKVEM

SEQ ID NO: 238915 - protein, 11 aa, Japanese encephalitis virus
LSMTREKFEMG

SEQ ID NO: 238916 - protein, 11 aa, Japanese encephalitis virus
SMTREKFEMGW

SEQ ID NO: 238917 - protein, 11 aa, Japanese encephalitis virus
MTREKFEMGWK

SEQ ID NO: 238918 - protein, 11 aa, Japanese encephalitis virus
TREKFEMGWKA

SEQ ID NO: 238919 - protein, 11 aa, Japanese encephalitis virus
REKFEMGWKAW

SEQ ID NO: 238920 - protein, 11 aa, Japanese encephalitis virus
EKVEMGWKAWG

SEQ ID NO: 238921 - protein, 11 aa, Japanese encephalitis virus
KVEMGWKAWGK

SEQ ID NO: 238922 - protein, 11 aa, Japanese encephalitis virus
VEMGWKAWGKS

SEQ ID NO: 238923 - protein, 11 aa, Japanese encephalitis virus
EMGWKAWGKSL

SEQ ID NO: 238924 - protein, 11 aa, Japanese encephalitis virus
MGWKAWGKSML

SEQ ID NO: 238925 - protein, 11 aa, Japanese encephalitis virus
GWKAWGKSLLF

SEQ ID NO: 238926 - protein, 11 aa, Japanese encephalitis virus
WKAWGKSMLFA

SEQ ID NO: 238927 - protein, 11 aa, Japanese encephalitis virus
KAWGKSMLFAP

SEQ ID NO: 238928 - protein, 11 aa, Japanese encephalitis virus
AWGKSMLFAPE

SEQ ID NO: 238929 - protein, 11 aa, Japanese encephalitis virus
WGKSLLFAPEL

SEQ ID NO: 238930 - protein, 11 aa, Japanese encephalitis virus
GKSILFAPEMA

SEQ ID NO: 238931 - protein, 11 aa, Japanese encephalitis virus
KSMLFAPELAN

SEQ ID NO: 238932 - protein, 11 aa, Japanese encephalitis virus
SMLFAPELANS

SEQ ID NO: 238933 - protein, 11 aa, Japanese encephalitis virus
ILFAPEMANST

SEQ ID NO: 238934 - protein, 11 aa, Japanese encephalitis virus
LFAPELANSSF

SEQ ID NO: 238935 - protein, 11 aa, Japanese encephalitis virus
FAPELANSSFV

SEQ ID NO: 238936 - protein, 11 aa, Japanese encephalitis virus
APEMANSTFVV

SEQ ID NO: 238937 - protein, 11 aa, Japanese encephalitis virus
PEMANSTFVVD

SEQ ID NO: 238938 - protein, 11 aa, Japanese encephalitis virus
EMANSTFVVDG

SEQ ID NO: 238939 - protein, 11 aa, Japanese encephalitis virus
MANSTFVVDGP

SEQ ID NO: 238940 - protein, 11 aa, Japanese encephalitis virus
ANSSFVVDGPE

SEQ ID NO: 238941 - protein, 11 aa, Japanese encephalitis virus
NSSFVVDGPET

SEQ ID NO: 238942 - protein, 11 aa, Japanese encephalitis virus
SSFVVDGPETK

SEQ ID NO: 238943 - protein, 11 aa, Japanese encephalitis virus
SFVVDGPETKE

SEQ ID NO: 238944 - protein, 11 aa, Japanese encephalitis virus
VDGPETKECPV

SEQ ID NO: 238945 - protein, 11 aa, Japanese encephalitis virus
DGPETKECPVV

SEQ ID NO: 238946 - protein, 11 aa, Japanese encephalitis virus
GPETKECPDER

SEQ ID NO: 238947 - protein, 11 aa, Japanese encephalitis virus
PETKECPDERR

SEQ ID NO: 238948 - protein, 11 aa, Japanese encephalitis virus
ETKECPDERRA

SEQ ID NO: 238949 - protein, 11 aa, Japanese encephalitis virus
TKECPDERRAW

SEQ ID NO: 238950 - protein, 11 aa, Japanese encephalitis virus
KECPDERRAWN

SEQ ID NO: 238951 - protein, 11 aa, Japanese encephalitis virus
ECPDERRAWNS

SEQ ID NO: 238952 - protein, 11 aa, Japanese encephalitis virus
CPDERRAWNSM

SEQ ID NO: 238953 - protein, 11 aa, Japanese encephalitis virus
PDERRAWNSMQ

SEQ ID NO: 238954 - protein, 11 aa, Japanese encephalitis virus
DERRAWNSMQI

SEQ ID NO: 238955 - protein, 11 aa, Japanese encephalitis virus
ERRAWNSMQIE

SEQ ID NO: 238956 - protein, 11 aa, Japanese encephalitis virus
RRAWNSMQIED

SEQ ID NO: 238957 - protein, 11 aa, Japanese encephalitis virus
RAWNSTQIEDF

SEQ ID NO: 238958 - protein, 11 aa, Japanese encephalitis virus
AWNSTQIEDFG

SEQ ID NO: 238959 - protein, 11 aa, Japanese encephalitis virus
WNSTQIEDFGF

SEQ ID NO: 238960 - protein, 11 aa, Japanese encephalitis virus
NSTQIEDFGFG

SEQ ID NO: 238961 - protein, 11 aa, Japanese encephalitis virus
STQIEDFGFGI

SEQ ID NO: 238962 - protein, 11 aa, Japanese encephalitis virus
TQIEDFGFGIT

SEQ ID NO: 238963 - protein, 11 aa, Japanese encephalitis virus
TRVWLKIREEN

SEQ ID NO: 238964 - protein, 11 aa, Japanese encephalitis virus
RVWLKIREENT

SEQ ID NO: 238965 - protein, 11 aa, Japanese encephalitis virus
VWLKIREENTD

SEQ ID NO: 238966 - protein, 11 aa, Japanese encephalitis virus
WLKIREENTDE

SEQ ID NO: 238967 - protein, 11 aa, Japanese encephalitis virus
LKIREENTDEC

SEQ ID NO: 238968 - protein, 11 aa, Japanese encephalitis virus
KIREENTDECD

SEQ ID NO: 238969 - protein, 11 aa, Japanese encephalitis virus
IREENTDECDG

SEQ ID NO: 238970 - protein, 11 aa, Japanese encephalitis virus
REENTDECDGA

SEQ ID NO: 238971 - protein, 11 aa, Japanese encephalitis virus
EENTDECDGAI

SEQ ID NO: 238972 - protein, 11 aa, Japanese encephalitis virus
ENTDECDGAII

SEQ ID NO: 238973 - protein, 11 aa, Japanese encephalitis virus
NTDECDGAIIG

SEQ ID NO: 238974 - protein, 11 aa, Japanese encephalitis virus
TDECDGPIIGT

SEQ ID NO: 238975 - protein, 11 aa, Japanese encephalitis virus
DECDGPIIGTA

SEQ ID NO: 238976 - protein, 11 aa, Japanese encephalitis virus
ECDGPIIGTAV

SEQ ID NO: 238977 - protein, 11 aa, Japanese encephalitis virus
CDGPIIGTAVK

SEQ ID NO: 238978 - protein, 11 aa, Japanese encephalitis virus
DGPIIGTAVKG

SEQ ID NO: 238979 - protein, 11 aa, Japanese encephalitis virus
GAIIGTAVKGN

SEQ ID NO: 238980 - protein, 11 aa, Japanese encephalitis virus
PIIGTAVKGHV

SEQ ID NO: 238981 - protein, 11 aa, Japanese encephalitis virus
IIGTAVKGNVA

SEQ ID NO: 238982 - protein, 11 aa, Japanese encephalitis virus
IGTAVKGNVAV

SEQ ID NO: 238983 - protein, 11 aa, Japanese encephalitis virus
GTAVKGNVAVH

SEQ ID NO: 238984 - protein, 11 aa, Japanese encephalitis virus
TAVKGNVAVHS

SEQ ID NO: 238985 - protein, 11 aa, Japanese encephalitis virus
AVKGNVAVHSD

SEQ ID NO: 238986 - protein, 11 aa, Japanese encephalitis virus
VKGNVAVHSDL

SEQ ID NO: 238987 - protein, 11 aa, Japanese encephalitis virus
KGNVAVHSDLS

SEQ ID NO: 238988 - protein, 11 aa, Japanese encephalitis virus
GNVAVHSDLSY

SEQ ID NO: 238989 - protein, 11 aa, Japanese encephalitis virus
NVAVHSDLSYW

SEQ ID NO: 238990 - protein, 11 aa, Japanese encephalitis virus
VALHSDLSYWI

SEQ ID NO: 238991 - protein, 11 aa, Japanese encephalitis virus
ALHSDLSYWIE

SEQ ID NO: 238992 - protein, 11 aa, Japanese encephalitis virus
VHSDVSYWIES

SEQ ID NO: 238993 - protein, 11 aa, Japanese encephalitis virus
HSDLSYWIESH

SEQ ID NO: 238994 - protein, 11 aa, Japanese encephalitis virus
NDTRKLERAVF

SEQ ID NO: 238995 - protein, 11 aa, Japanese encephalitis virus
DTRKLERAVFG

SEQ ID NO: 238996 - protein, 11 aa, Japanese encephalitis virus
TWKLERLVFGE

SEQ ID NO: 238997 - protein, 11 aa, Japanese encephalitis virus
WKLERAVFGEI

SEQ ID NO: 238998 - protein, 11 aa, Japanese encephalitis virus
KLERAVFGEIK

SEQ ID NO: 238999 - protein, 11 aa, Japanese encephalitis virus
LERAVFGEIKS

SEQ ID NO: 239000 - protein, 11 aa, Japanese encephalitis virus
ERAVFGEIKSC

SEQ ID NO: 239001 - protein, 11 aa, Japanese encephalitis virus
RAVFGEIKSCT

SEQ ID NO: 239002 - protein, 11 aa, Japanese encephalitis virus
AVFGEIKSCTW

SEQ ID NO: 239003 - protein, 11 aa, Japanese encephalitis virus
VFGEIKSCTWP

SEQ ID NO: 239004 - protein, 11 aa, Japanese encephalitis virus
FGEIKSCTWPE

SEQ ID NO: 239005 - protein, 11 aa, Japanese encephalitis virus
GEIKSCTWPET

SEQ ID NO: 239006 - protein, 11 aa, Japanese encephalitis virus
EIKSCTWPETH

SEQ ID NO: 239007 - protein, 11 aa, Japanese encephalitis virus
VKSCTWPETHS

SEQ ID NO: 239008 - protein, 11 aa, Japanese encephalitis virus
KSCTWPETHSL

SEQ ID NO: 239009 - protein, 11 aa, Japanese encephalitis virus
SCTWPETHSLW

SEQ ID NO: 239010 - protein, 11 aa, Japanese encephalitis virus
CTWPETHSLWG

SEQ ID NO: 239011 - protein, 11 aa, Japanese encephalitis virus
TWPETHSLWGD

SEQ ID NO: 239012 - protein, 11 aa, Japanese encephalitis virus
WPETHTLWGDD

SEQ ID NO: 239013 - protein, 11 aa, Japanese encephalitis virus
PETHTLWGDDV

SEQ ID NO: 239014 - protein, 11 aa, Japanese encephalitis virus
ETHTLWGDDVE

SEQ ID NO: 239015 - protein, 11 aa, Japanese encephalitis virus
THTLWGDDVEE

SEQ ID NO: 239016 - protein, 11 aa, Japanese encephalitis virus
HTLWGDDVEES

SEQ ID NO: 239017 - protein, 11 aa, Japanese encephalitis virus
TLWGDDVEESE

SEQ ID NO: 239018 - protein, 11 aa, Japanese encephalitis virus
LWGDDVEESEL

SEQ ID NO: 239019 - protein, 11 aa, Japanese encephalitis virus
WGDDVEESELI

SEQ ID NO: 239020 - protein, 11 aa, Japanese encephalitis virus
GDDVEESELII

SEQ ID NO: 239021 - protein, 11 aa, Japanese encephalitis virus
DDVEESELIIP

SEQ ID NO: 239022 - protein, 11 aa, Japanese encephalitis virus
DVEESELIIPH

SEQ ID NO: 239023 - protein, 11 aa, Japanese encephalitis virus
AEESELIIPHT

SEQ ID NO: 239024 - protein, 11 aa, Japanese encephalitis virus
EESELIIPHTL

SEQ ID NO: 239025 - protein, 11 aa, Japanese encephalitis virus
ESELIIPHTLA

SEQ ID NO: 239026 - protein, 11 aa, Japanese encephalitis virus
SELIIPHTLAG

SEQ ID NO: 239027 - protein, 11 aa, Japanese encephalitis virus
ELIIPHTLAGP

SEQ ID NO: 239028 - protein, 11 aa, Japanese encephalitis virus
LIIPHTIAGPR

SEQ ID NO: 239029 - protein, 11 aa, Japanese encephalitis virus
IIPHTIAGPRS

SEQ ID NO: 239030 - protein, 11 aa, Japanese encephalitis virus
IPHTIAGPRSK

SEQ ID NO: 239031 - protein, 11 aa, Japanese encephalitis virus
PHTIAGPRSKH

SEQ ID NO: 239032 - protein, 11 aa, Japanese encephalitis virus
HTIAGPRSKHN

SEQ ID NO: 239033 - protein, 11 aa, Japanese encephalitis virus
TIAGPRSKHNR

SEQ ID NO: 239034 - protein, 11 aa, Japanese encephalitis virus
IAGPRSKHNRR

SEQ ID NO: 239035 - protein, 11 aa, Japanese encephalitis virus
AGPRSKHNRRE

SEQ ID NO: 239036 - protein, 11 aa, Japanese encephalitis virus
GPRSKHNRREG

SEQ ID NO: 239037 - protein, 11 aa, Japanese encephalitis virus
PRSKHNRREGY

SEQ ID NO: 239038 - protein, 11 aa, Japanese encephalitis virus
RSKHNRREGYK

SEQ ID NO: 239039 - protein, 11 aa, Japanese encephalitis virus
SKHNRREGYRT

SEQ ID NO: 239040 - protein, 11 aa, Japanese encephalitis virus
KHNRREGYRTQ

SEQ ID NO: 239041 - protein, 11 aa, Japanese encephalitis virus
HNRREGYRTQN

SEQ ID NO: 239042 - protein, 11 aa, Japanese encephalitis virus
NRREGYRTQNQ

SEQ ID NO: 239043 - protein, 11 aa, Japanese encephalitis virus
RREGYRTQNQG

SEQ ID NO: 239044 - protein, 11 aa, Japanese encephalitis virus
REGYRTQNQGP

SEQ ID NO: 239045 - protein, 11 aa, Japanese encephalitis virus
EGYRTQNQGPW

SEQ ID NO: 239046 - protein, 11 aa, Japanese encephalitis virus
GYRTQNQGPWD

SEQ ID NO: 239047 - protein, 11 aa, Japanese encephalitis virus
YRTQNQGPWDE

SEQ ID NO: 239048 - protein, 11 aa, Japanese encephalitis virus
TQNQGPWDEDG

SEQ ID NO: 239049 - protein, 11 aa, Japanese encephalitis virus
QNQGPWDEKGI

SEQ ID NO: 239050 - protein, 11 aa, Japanese encephalitis virus
NQGPWDESGIV

SEQ ID NO: 239051 - protein, 11 aa, Japanese encephalitis virus
QGPWDEDGIVL

SEQ ID NO: 239052 - protein, 11 aa, Japanese encephalitis virus
GPWDESGIVLD

SEQ ID NO: 239053 - protein, 11 aa, Japanese encephalitis virus
PWDESGIVLDF

SEQ ID NO: 239054 - protein, 11 aa, Japanese encephalitis virus
WDEDGIVLDFD

SEQ ID NO: 239055 - protein, 11 aa, Japanese encephalitis virus
DENGLVPGLDY

SEQ ID NO: 239056 - protein, 11 aa, Japanese encephalitis virus
EKGIVLDFDYC

SEQ ID NO: 239057 - protein, 11 aa, Japanese encephalitis virus
DGIVLDFDYCP

SEQ ID NO: 239058 - protein, 11 aa, Japanese encephalitis virus
GLVPGLDYCPG

SEQ ID NO: 239059 - protein, 11 aa, Japanese encephalitis virus
LVPGLDYCPGT

SEQ ID NO: 239060 - protein, 11 aa, Japanese encephalitis virus
VLDFDYCPGTT

SEQ ID NO: 239061 - protein, 11 aa, Japanese encephalitis virus
PGLDYCPGTKV

SEQ ID NO: 239062 - protein, 11 aa, Japanese encephalitis virus
GLDYCPGTKVT

SEQ ID NO: 239063 - protein, 11 aa, Japanese encephalitis virus
FDYCPGTTVTI

SEQ ID NO: 239064 - protein, 11 aa, Japanese encephalitis virus
DYCPGTTVTIT

SEQ ID NO: 239065 - protein, 11 aa, Japanese encephalitis virus
YCPGTTVTITE

SEQ ID NO: 239066 - protein, 11 aa, Japanese encephalitis virus
CPGTTVTITED

SEQ ID NO: 239067 - protein, 11 aa, Japanese encephalitis virus
PGTTVTITEDC

SEQ ID NO: 239068 - protein, 11 aa, Japanese encephalitis virus
GTKVTITEDCS

SEQ ID NO: 239069 - protein, 11 aa, Japanese encephalitis virus
TKVTITEDCSK

SEQ ID NO: 239070 - protein, 11 aa, Japanese encephalitis virus
KVTITEDCSKR

SEQ ID NO: 239071 - protein, 11 aa, Japanese encephalitis virus
VTITEDCSKRG

SEQ ID NO: 239072 - protein, 11 aa, Japanese encephalitis virus
TITEDCSKRGP

SEQ ID NO: 239073 - protein, 11 aa, Japanese encephalitis virus
ITEDCSKRGPS

SEQ ID NO: 239074 - protein, 11 aa, Japanese encephalitis virus
TEDCGKRGPSI

SEQ ID NO: 239075 - protein, 11 aa, Japanese encephalitis virus
EDCGKRGPSIR

SEQ ID NO: 239076 - protein, 11 aa, Japanese encephalitis virus
DCGKRGPSIRT

SEQ ID NO: 239077 - protein, 11 aa, Japanese encephalitis virus
CGKRGPSIRTT

SEQ ID NO: 239078 - protein, 11 aa, Japanese encephalitis virus
GKRGPSIRTTT

SEQ ID NO: 239079 - protein, 11 aa, Japanese encephalitis virus
KRGPSIRTTTD

SEQ ID NO: 239080 - protein, 11 aa, Japanese encephalitis virus
RGPSIRTTTDS

SEQ ID NO: 239081 - protein, 11 aa, Japanese encephalitis virus
GPSIRTTTDSG

SEQ ID NO: 239082 - protein, 11 aa, Japanese encephalitis virus
PSIRTTTDSGK

SEQ ID NO: 239083 - protein, 11 aa, Japanese encephalitis virus
SIRTTTDSGKL

SEQ ID NO: 239084 - protein, 11 aa, Japanese encephalitis virus
IRTTTDSGKLI

SEQ ID NO: 239085 - protein, 11 aa, Japanese encephalitis virus
RTTTDIGKLIT

SEQ ID NO: 239086 - protein, 11 aa, Japanese encephalitis virus
TTTDIGKLITD

SEQ ID NO: 239087 - protein, 11 aa, Japanese encephalitis virus
TTDIGKLITDW

SEQ ID NO: 239088 - protein, 11 aa, Japanese encephalitis virus
TDIGKLITDWC

SEQ ID NO: 239089 - protein, 11 aa, Japanese encephalitis virus
DIGKLITDWCC

SEQ ID NO: 239090 - protein, 11 aa, Japanese encephalitis virus
IGKLITDWCCR

SEQ ID NO: 239091 - protein, 11 aa, Japanese encephalitis virus
GKLITDWCCRN

SEQ ID NO: 239092 - protein, 11 aa, Japanese encephalitis virus
KLITDWCCRNC

SEQ ID NO: 239093 - protein, 11 aa, Japanese encephalitis virus
LITDWCCRNCS

SEQ ID NO: 239094 - protein, 11 aa, Japanese encephalitis virus
ITDWCCRSCTL

SEQ ID NO: 239095 - protein, 11 aa, Japanese encephalitis virus
TDWCCRNCSLP

SEQ ID NO: 239096 - protein, 11 aa, Japanese encephalitis virus
DWCCRNCSLPP

SEQ ID NO: 239097 - protein, 11 aa, Japanese encephalitis virus
WCCRNCSLPPL

SEQ ID NO: 239098 - protein, 11 aa, Japanese encephalitis virus
CCRSCSLPPLG

SEQ ID NO: 239099 - protein, 11 aa, Japanese encephalitis virus
CRSCSLPPLGF

SEQ ID NO: 239100 - protein, 11 aa, Japanese encephalitis virus
RSCSLPPLGFR

SEQ ID NO: 239101 - protein, 11 aa, Japanese encephalitis virus
SCSLPPLGFRT

SEQ ID NO: 239102 - protein, 11 aa, Japanese encephalitis virus
CSLPPLGFRTE

SEQ ID NO: 239103 - protein, 11 aa, Japanese encephalitis virus
SLPPLGFRTEN

SEQ ID NO: 239104 - protein, 11 aa, Japanese encephalitis virus
LPPLGFRTENG

SEQ ID NO: 239105 - protein, 11 aa, Japanese encephalitis virus
PPLGFRTENGC

SEQ ID NO: 239106 - protein, 11 aa, Japanese encephalitis virus
PLGFRTENGCW

SEQ ID NO: 239107 - protein, 11 aa, Japanese encephalitis virus
LGFRTENGCWY

SEQ ID NO: 239108 - protein, 11 aa, Japanese encephalitis virus
GFRTENGCWYG

SEQ ID NO: 239109 - protein, 11 aa, Japanese encephalitis virus
FRTGSGCWYGM

SEQ ID NO: 239110 - protein, 11 aa, Japanese encephalitis virus
RTGSGCWYGME

SEQ ID NO: 239111 - protein, 11 aa, Japanese encephalitis virus
TDNGCWYGMEI

SEQ ID NO: 239112 - protein, 11 aa, Japanese encephalitis virus
GSGCWYGMEVR

SEQ ID NO: 239113 - protein, 11 aa, Japanese encephalitis virus
SGCWYGMEVRP

SEQ ID NO: 239114 - protein, 11 aa, Japanese encephalitis virus
GCWYGMEIRPL

SEQ ID NO: 239115 - protein, 11 aa, Japanese encephalitis virus
HDEATLVRSQV

SEQ ID NO: 239116 - protein, 11 aa, Japanese encephalitis virus
GEMIDPFQLGL

SEQ ID NO: 239117 - protein, 11 aa, Japanese encephalitis virus
EMIDPFQLGLL

SEQ ID NO: 239118 - protein, 11 aa, Japanese encephalitis virus
MIDPFQLGLLV

SEQ ID NO: 239119 - protein, 11 aa, Japanese encephalitis virus
IDPFQLGLLVM

SEQ ID NO: 239120 - protein, 11 aa, Japanese encephalitis virus
DPFQLGLLVVF

SEQ ID NO: 239121 - protein, 11 aa, Japanese encephalitis virus
PFQLGLLVVFL

SEQ ID NO: 239122 - protein, 11 aa, Japanese encephalitis virus
FQLGLLVVFLA

SEQ ID NO: 239123 - protein, 11 aa, Japanese encephalitis virus
QLGLLVVFLAT

SEQ ID NO: 239124 - protein, 11 aa, Japanese encephalitis virus
LGLLVVFLATQ

SEQ ID NO: 239125 - protein, 11 aa, Japanese encephalitis virus
GLLVVFLATQE

SEQ ID NO: 239126 - protein, 11 aa, Japanese encephalitis virus
LLVVFLATQEV

SEQ ID NO: 239127 - protein, 11 aa, Japanese encephalitis virus
LVVFLATQEVL

SEQ ID NO: 239128 - protein, 11 aa, Japanese encephalitis virus
VVFLATQEVLR

SEQ ID NO: 239129 - protein, 11 aa, Japanese encephalitis virus
VFLATQEVLRK

SEQ ID NO: 239130 - protein, 11 aa, Japanese encephalitis virus
FLATQEVFRKR

SEQ ID NO: 239131 - protein, 11 aa, Japanese encephalitis virus
LATQEVLGKRW

SEQ ID NO: 239132 - protein, 11 aa, Japanese encephalitis virus
ATQEVFRKRWT

SEQ ID NO: 239133 - protein, 11 aa, Japanese encephalitis virus
TQEVFRKRWTA

SEQ ID NO: 239134 - protein, 11 aa, Japanese encephalitis virus
QEVLGKRWTAR

SEQ ID NO: 239135 - protein, 11 aa, Japanese encephalitis virus
EVLGKRWTARL

SEQ ID NO: 239136 - protein, 11 aa, Japanese encephalitis virus
VFRKRWTARLT

SEQ ID NO: 239137 - protein, 11 aa, Japanese encephalitis virus
LRKRWTARLTV

SEQ ID NO: 239138 - protein, 11 aa, Japanese encephalitis virus
RKRWTARLTVP

SEQ ID NO: 239139 - protein, 11 aa, Japanese encephalitis virus
KRWTARLTVPA

SEQ ID NO: 239140 - protein, 11 aa, Japanese encephalitis virus
RWTARLTVPAV

SEQ ID NO: 239141 - protein, 11 aa, Japanese encephalitis virus
WTARLTVPAVL

SEQ ID NO: 239142 - protein, 11 aa, Japanese encephalitis virus
TARLTVPAVLG

SEQ ID NO: 239143 - protein, 11 aa, Japanese encephalitis virus
ARLTIPAVLGV

SEQ ID NO: 239144 - protein, 11 aa, Japanese encephalitis virus
RLTIPAVLGVL

SEQ ID NO: 239145 - protein, 11 aa, Japanese encephalitis virus
LTIPAVLGVLL

SEQ ID NO: 239146 - protein, 11 aa, Japanese encephalitis virus
TIPAVLGVLLV

SEQ ID NO: 239147 - protein, 11 aa, Japanese encephalitis virus
IPAVLGVLLVL

SEQ ID NO: 239148 - protein, 11 aa, Japanese encephalitis virus
PAVLGVLLVLM

SEQ ID NO: 239149 - protein, 11 aa, Japanese encephalitis virus
AVLGVLLVLML

SEQ ID NO: 239150 - protein, 11 aa, Japanese encephalitis virus
VLGVLLVLMLG

SEQ ID NO: 239151 - protein, 11 aa, Japanese encephalitis virus
LGVLLVLMLGG

SEQ ID NO: 239152 - protein, 11 aa, Japanese encephalitis virus
GVLLVLMLGGI

SEQ ID NO: 239153 - protein, 11 aa, Japanese encephalitis virus
VLLVLMLGGIT

SEQ ID NO: 239154 - protein, 11 aa, Japanese encephalitis virus
LLVLMFGGITY

SEQ ID NO: 239155 - protein, 11 aa, Japanese encephalitis virus
LVLMLGGITYI

SEQ ID NO: 239156 - protein, 11 aa, Japanese encephalitis virus
VLMLGGITYID

SEQ ID NO: 239157 - protein, 11 aa, Japanese encephalitis virus
LMLGGITYIDL

SEQ ID NO: 239158 - protein, 11 aa, Japanese encephalitis virus
MLGGITYIDLA

SEQ ID NO: 239159 - protein, 11 aa, Japanese encephalitis virus
LGGITYIDLAR

SEQ ID NO: 239160 - protein, 11 aa, Japanese encephalitis virus
GGITYIDLARY

SEQ ID NO: 239161 - protein, 11 aa, Japanese encephalitis virus
GITYIDLARYV

SEQ ID NO: 239162 - protein, 11 aa, Japanese encephalitis virus
ITYIDLARYVV

SEQ ID NO: 239163 - protein, 11 aa, Japanese encephalitis virus
TYIDLARYVVL

SEQ ID NO: 239164 - protein, 11 aa, Japanese encephalitis virus
YIDLARYVVLV

SEQ ID NO: 239165 - protein, 11 aa, Japanese encephalitis virus
IDLARYVVLVA

SEQ ID NO: 239166 - protein, 11 aa, Japanese encephalitis virus
LARYVVLVAAS

SEQ ID NO: 239167 - protein, 11 aa, Japanese encephalitis virus
ARYVVLVAAVF

SEQ ID NO: 239168 - protein, 11 aa, Japanese encephalitis virus
RYVVLVAAVFA

SEQ ID NO: 239169 - protein, 11 aa, Japanese encephalitis virus
YVVLVAASFAE

SEQ ID NO: 239170 - protein, 11 aa, Japanese encephalitis virus
VVLVAASFAEA

SEQ ID NO: 239171 - protein, 11 aa, Japanese encephalitis virus
VLVAAVFAEAN

SEQ ID NO: 239172 - protein, 11 aa, Japanese encephalitis virus
LVAAAFAEANN

SEQ ID NO: 239173 - protein, 11 aa, Japanese encephalitis virus
VAAAFAEANNG

SEQ ID NO: 239174 - protein, 11 aa, Japanese encephalitis virus
AAAFAEANNGG

SEQ ID NO: 239175 - protein, 11 aa, Japanese encephalitis virus
AAFAEANNGGD

SEQ ID NO: 239176 - protein, 11 aa, Japanese encephalitis virus
AFAEANNGGDV

SEQ ID NO: 239177 - protein, 11 aa, Japanese encephalitis virus
FAEANNGGDVL

SEQ ID NO: 239178 - protein, 11 aa, Japanese encephalitis virus
AEANNGGDVLH

SEQ ID NO: 239179 - protein, 11 aa, Japanese encephalitis virus
EANNGGDVLHL

SEQ ID NO: 239180 - protein, 11 aa, Japanese encephalitis virus
ANNGGDVLHLA

SEQ ID NO: 239181 - protein, 11 aa, Japanese encephalitis virus
NNGGDVLHLAL

SEQ ID NO: 239182 - protein, 11 aa, Japanese encephalitis virus
NGGDVLHLALI

SEQ ID NO: 239183 - protein, 11 aa, Japanese encephalitis virus
AVFKIQPAFLA

SEQ ID NO: 239184 - protein, 11 aa, Japanese encephalitis virus
VFKIQPAFLAM

SEQ ID NO: 239185 - protein, 11 aa, Japanese encephalitis virus
FKIQPAFLAMN

SEQ ID NO: 239186 - protein, 11 aa, Japanese encephalitis virus
KIQPAFLAMNT

SEQ ID NO: 239187 - protein, 11 aa, Japanese encephalitis virus
IQPAFLAMNTL

SEQ ID NO: 239188 - protein, 11 aa, Japanese encephalitis virus
QPAFLAMKMLS

SEQ ID NO: 239189 - protein, 11 aa, Japanese encephalitis virus
PAFLVMNMLSA

SEQ ID NO: 239190 - protein, 11 aa, Japanese encephalitis virus
NMLSARWTNQE

SEQ ID NO: 239191 - protein, 11 aa, Japanese encephalitis virus
MLSARWTNQEN

SEQ ID NO: 239192 - protein, 11 aa, Japanese encephalitis virus
LSARWTNQENV

SEQ ID NO: 239193 - protein, 11 aa, Japanese encephalitis virus
SARWTNQENVV

SEQ ID NO: 239194 - protein, 11 aa, Japanese encephalitis virus
ARWTNQENVVL

SEQ ID NO: 239195 - protein, 11 aa, Japanese encephalitis virus
RWTNQENVALV

SEQ ID NO: 239196 - protein, 11 aa, Japanese encephalitis virus
WTNQENVALVL

SEQ ID NO: 239197 - protein, 11 aa, Japanese encephalitis virus
TNQENVALVLG

SEQ ID NO: 239198 - protein, 11 aa, Japanese encephalitis virus
NQENVALVLGA

SEQ ID NO: 239199 - protein, 11 aa, Japanese encephalitis virus
QENVALVLGAA

SEQ ID NO: 239200 - protein, 11 aa, Japanese encephalitis virus
ENVALVLGAAF

SEQ ID NO: 239201 - protein, 11 aa, Japanese encephalitis virus
NVALVLGAAFF

SEQ ID NO: 239202 - protein, 11 aa, Japanese encephalitis virus
VALVLGAAFFQ

SEQ ID NO: 239203 - protein, 11 aa, Japanese encephalitis virus
ALVLGAAFFQL

SEQ ID NO: 239204 - protein, 11 aa, Japanese encephalitis virus
LVLGAALFQLA

SEQ ID NO: 239205 - protein, 11 aa, Japanese encephalitis virus
VLGAALFQLAS

SEQ ID NO: 239206 - protein, 11 aa, Japanese encephalitis virus
LGAAFFQLASA

SEQ ID NO: 239207 - protein, 11 aa, Japanese encephalitis virus
GAAFFQLASAD

SEQ ID NO: 239208 - protein, 11 aa, Japanese encephalitis virus
AAFFQLASADL

SEQ ID NO: 239209 - protein, 11 aa, Japanese encephalitis virus
AFFQLASADLQ

SEQ ID NO: 239210 - protein, 11 aa, Japanese encephalitis virus
FFQLASADLQI

SEQ ID NO: 239211 - protein, 11 aa, Japanese encephalitis virus
FQLASADLQIG

SEQ ID NO: 239212 - protein, 11 aa, Japanese encephalitis virus
QLASADLQIGV

SEQ ID NO: 239213 - protein, 11 aa, Japanese encephalitis virus
LASADLQIGVH

SEQ ID NO: 239214 - protein, 11 aa, Japanese encephalitis virus
ASADLQIGVHG

SEQ ID NO: 239215 - protein, 11 aa, Japanese encephalitis virus
SADLQIGVHGI

SEQ ID NO: 239216 - protein, 11 aa, Japanese encephalitis virus
ADLQIGVHGIL

SEQ ID NO: 239217 - protein, 11 aa, Japanese encephalitis virus
DLQIGVHGMLN

SEQ ID NO: 239218 - protein, 11 aa, Japanese encephalitis virus
LQIGVHGMLNA

SEQ ID NO: 239219 - protein, 11 aa, Japanese encephalitis virus
QIGVHGMLNAA

SEQ ID NO: 239220 - protein, 11 aa, Japanese encephalitis virus
IGVHGMLNAAA

SEQ ID NO: 239221 - protein, 11 aa, Japanese encephalitis virus
GVHGILNAAAM

SEQ ID NO: 239222 - protein, 11 aa, Japanese encephalitis virus
VHGILNAAAMA

SEQ ID NO: 239223 - protein, 11 aa, Japanese encephalitis virus
HGILNAAAMAW

SEQ ID NO: 239224 - protein, 11 aa, Japanese encephalitis virus
GILNAAAMAWM

SEQ ID NO: 239225 - protein, 11 aa, Japanese encephalitis virus
ILNAAAMAWMI

SEQ ID NO: 239226 - protein, 11 aa, Japanese encephalitis virus
LNAAAMAWMIV

SEQ ID NO: 239227 - protein, 11 aa, Japanese encephalitis virus
NAAAIAWMIIK

SEQ ID NO: 239228 - protein, 11 aa, Japanese encephalitis virus
AAAMAWMIVRA

SEQ ID NO: 239229 - protein, 11 aa, Japanese encephalitis virus
AAIAWMIIKAI

SEQ ID NO: 239230 - protein, 11 aa, Japanese encephalitis virus
AMAWMIVRAIT

SEQ ID NO: 239231 - protein, 11 aa, Japanese encephalitis virus
MAWMIVRAITF

SEQ ID NO: 239232 - protein, 11 aa, Japanese encephalitis virus
AWMIIKAITFP

SEQ ID NO: 239233 - protein, 11 aa, Japanese encephalitis virus
WMIIKAITFPT

SEQ ID NO: 239234 - protein, 11 aa, Japanese encephalitis virus
MIVRAITFPTA

SEQ ID NO: 239235 - protein, 11 aa, Japanese encephalitis virus
IVRAITFPTAS

SEQ ID NO: 239236 - protein, 11 aa, Japanese encephalitis virus
VRAITFPTTST

SEQ ID NO: 239237 - protein, 11 aa, Japanese encephalitis virus
RAITFPTTSTV

SEQ ID NO: 239238 - protein, 11 aa, Japanese encephalitis virus
AITFPTTSTVA

SEQ ID NO: 239239 - protein, 11 aa, Japanese encephalitis virus
ITFPTTSTVAM

SEQ ID NO: 239240 - protein, 11 aa, Japanese encephalitis virus
TFPTTSTVAMP

SEQ ID NO: 239241 - protein, 11 aa, Japanese encephalitis virus
MPILALLTPGM

SEQ ID NO: 239242 - protein, 11 aa, Japanese encephalitis virus
PILALLTPGMR

SEQ ID NO: 239243 - protein, 11 aa, Japanese encephalitis virus
ILALLTPGMRA

SEQ ID NO: 239244 - protein, 11 aa, Japanese encephalitis virus
LALLTPGMRAF

SEQ ID NO: 239245 - protein, 11 aa, Japanese encephalitis virus
LLAPGMRALYL

SEQ ID NO: 239246 - protein, 11 aa, Japanese encephalitis virus
LTPGMRAFDLD

SEQ ID NO: 239247 - protein, 11 aa, Japanese encephalitis virus
APGMRALYLDT

SEQ ID NO: 239248 - protein, 11 aa, Japanese encephalitis virus
PGMRALCLDTY

SEQ ID NO: 239249 - protein, 11 aa, Japanese encephalitis virus
GMRALCLDTYR

SEQ ID NO: 239250 - protein, 11 aa, Japanese encephalitis virus
MKALYLDTYRI

SEQ ID NO: 239251 - protein, 11 aa, Japanese encephalitis virus
RAFDLDTYRII

SEQ ID NO: 239252 - protein, 11 aa, Japanese encephalitis virus
ALCLDTYRIIL

SEQ ID NO: 239253 - protein, 11 aa, Japanese encephalitis virus
FDLDTYRIILL

SEQ ID NO: 239254 - protein, 11 aa, Japanese encephalitis virus
YLDTYRIILLI

SEQ ID NO: 239255 - protein, 11 aa, Japanese encephalitis virus
LDTYRIILLII

SEQ ID NO: 239256 - protein, 11 aa, Japanese encephalitis virus
DTYRIILLIIG

SEQ ID NO: 239257 - protein, 11 aa, Japanese encephalitis virus
TYRIILLVIGV

SEQ ID NO: 239258 - protein, 11 aa, Japanese encephalitis virus
YRIILLVIGVC

SEQ ID NO: 239259 - protein, 11 aa, Japanese encephalitis virus
RIILLVIGVCS

SEQ ID NO: 239260 - protein, 11 aa, Japanese encephalitis virus
IILLVIGVCSL

SEQ ID NO: 239261 - protein, 11 aa, Japanese encephalitis virus
ILLVIGVCSLL

SEQ ID NO: 239262 - protein, 11 aa, Japanese encephalitis virus
LLVIGICSLLH

SEQ ID NO: 239263 - protein, 11 aa, Japanese encephalitis virus
LVIGICSLLHE

SEQ ID NO: 239264 - protein, 11 aa, Japanese encephalitis virus
VIGICSLLHER

SEQ ID NO: 239265 - protein, 11 aa, Japanese encephalitis virus
ERRKTMAKKKG

SEQ ID NO: 239266 - protein, 11 aa, Japanese encephalitis virus
RRKTMAKKKGA

SEQ ID NO: 239267 - protein, 11 aa, Japanese encephalitis virus
RKTMAKKKGAV

SEQ ID NO: 239268 - protein, 11 aa, Japanese encephalitis virus
KAMAKKKGAVL

SEQ ID NO: 239269 - protein, 11 aa, Japanese encephalitis virus
TMAKKKGAVLM

SEQ ID NO: 239270 - protein, 11 aa, Japanese encephalitis virus
MAKKKGAVLMG

SEQ ID NO: 239271 - protein, 11 aa, Japanese encephalitis virus
AKKKGAVLMGL

SEQ ID NO: 239272 - protein, 11 aa, Japanese encephalitis virus
KKKGAVLMGLA

SEQ ID NO: 239273 - protein, 11 aa, Japanese encephalitis virus
KKGAVLMGLAL

SEQ ID NO: 239274 - protein, 11 aa, Japanese encephalitis virus
KGAVLMGLALT

SEQ ID NO: 239275 - protein, 11 aa, Japanese encephalitis virus
GAVLMGLALTS

SEQ ID NO: 239276 - protein, 11 aa, Japanese encephalitis virus
AVLMGLALTST

SEQ ID NO: 239277 - protein, 11 aa, Japanese encephalitis virus
VLMGLALTSTG

SEQ ID NO: 239278 - protein, 11 aa, Japanese encephalitis virus
LMGLALTSTGW

SEQ ID NO: 239279 - protein, 11 aa, Japanese encephalitis virus
MGLALTSTGWF

SEQ ID NO: 239280 - protein, 11 aa, Japanese encephalitis virus
STGWFSPTTIT

SEQ ID NO: 239281 - protein, 11 aa, Japanese encephalitis virus
TGWFSPTTITA

SEQ ID NO: 239282 - protein, 11 aa, Japanese encephalitis virus
GWFSPTTITAG

SEQ ID NO: 239283 - protein, 11 aa, Japanese encephalitis virus
WFSPTTITAGL

SEQ ID NO: 239284 - protein, 11 aa, Japanese encephalitis virus
FSPTTITAGLM

SEQ ID NO: 239285 - protein, 11 aa, Japanese encephalitis virus
SPTTITAGLMV

SEQ ID NO: 239286 - protein, 11 aa, Japanese encephalitis virus
PTTITAGLMVC

SEQ ID NO: 239287 - protein, 11 aa, Japanese encephalitis virus
TTIAAGLMACN

SEQ ID NO: 239288 - protein, 11 aa, Japanese encephalitis virus
TIAAGLMACNP

SEQ ID NO: 239289 - protein, 11 aa, Japanese encephalitis virus
IAAGLMACNPN

SEQ ID NO: 239290 - protein, 11 aa, Japanese encephalitis virus
AAGLMACNPNK

SEQ ID NO: 239291 - protein, 11 aa, Japanese encephalitis virus
AGLMACNPNKK

SEQ ID NO: 239292 - protein, 11 aa, Japanese encephalitis virus
GLMACNPNKKR

SEQ ID NO: 239293 - protein, 11 aa, Japanese encephalitis virus
LMACNPNKKRG

SEQ ID NO: 239294 - protein, 11 aa, Japanese encephalitis virus
MACNPNKKRGW

SEQ ID NO: 239295 - protein, 11 aa, Japanese encephalitis virus
ACNPNKKRGWP

SEQ ID NO: 239296 - protein, 11 aa, Japanese encephalitis virus
NKKRGWPATEV

SEQ ID NO: 239297 - protein, 11 aa, Japanese encephalitis virus
KKRGWPATEVL

SEQ ID NO: 239298 - protein, 11 aa, Japanese encephalitis virus
KRGWPATEVLS

SEQ ID NO: 239299 - protein, 11 aa, Japanese encephalitis virus
RGWPATEVLSA

SEQ ID NO: 239300 - protein, 11 aa, Japanese encephalitis virus
GWPATEFLSAI

SEQ ID NO: 239301 - protein, 11 aa, Japanese encephalitis virus
WPATEFLSAIG

SEQ ID NO: 239302 - protein, 11 aa, Japanese encephalitis virus
PATEFLSAIGL

SEQ ID NO: 239303 - protein, 11 aa, Japanese encephalitis virus
ATEFLSAIGLM

SEQ ID NO: 239304 - protein, 11 aa, Japanese encephalitis virus
TEFLSAIGLMF

SEQ ID NO: 239305 - protein, 11 aa, Japanese encephalitis virus
EFLSAIGLMFA

SEQ ID NO: 239306 - protein, 11 aa, Japanese encephalitis virus
FLSAIGLMFAI

SEQ ID NO: 239307 - protein, 11 aa, Japanese encephalitis virus
LSAIGLMFAIV

SEQ ID NO: 239308 - protein, 11 aa, Japanese encephalitis virus
SAIGLMFAIVG

SEQ ID NO: 239309 - protein, 11 aa, Japanese encephalitis virus
AIGLMFAIVGG

SEQ ID NO: 239310 - protein, 11 aa, Japanese encephalitis virus
IGLMFAIVGGL

SEQ ID NO: 239311 - protein, 11 aa, Japanese encephalitis virus
MFAIVGGLAEM

SEQ ID NO: 239312 - protein, 11 aa, Japanese encephalitis virus
FAIVGGLAEMD

SEQ ID NO: 239313 - protein, 11 aa, Japanese encephalitis virus
AIVGGLAEMDI

SEQ ID NO: 239314 - protein, 11 aa, Japanese encephalitis virus
IVGGLAEMDIE

SEQ ID NO: 239315 - protein, 11 aa, Japanese encephalitis virus
VGGLAEMDIES

SEQ ID NO: 239316 - protein, 11 aa, Japanese encephalitis virus
GGLAEMDIESM

SEQ ID NO: 239317 - protein, 11 aa, Japanese encephalitis virus
GLAEMDIESMS

SEQ ID NO: 239318 - protein, 11 aa, Japanese encephalitis virus
LAEMDIESMSI

SEQ ID NO: 239319 - protein, 11 aa, Japanese encephalitis virus
AEMDIESMSIP

SEQ ID NO: 239320 - protein, 11 aa, Japanese encephalitis virus
EMDIESMSIPF

SEQ ID NO: 239321 - protein, 11 aa, Japanese encephalitis virus
MDIESMSIPFM

SEQ ID NO: 239322 - protein, 11 aa, Japanese encephalitis virus
ESMSIPFMLAV

SEQ ID NO: 239323 - protein, 11 aa, Japanese encephalitis virus
SMSIPFMLAVL

SEQ ID NO: 239324 - protein, 11 aa, Japanese encephalitis virus
MSIPFMLAVLM

SEQ ID NO: 239325 - protein, 11 aa, Japanese encephalitis virus
SIPFMLAVLMA

SEQ ID NO: 239326 - protein, 11 aa, Japanese encephalitis virus
IPFMLAVLMAV

SEQ ID NO: 239327 - protein, 11 aa, Japanese encephalitis virus
PFMLAVLMAVS

SEQ ID NO: 239328 - protein, 11 aa, Japanese encephalitis virus
FMLAVLMAVSY

SEQ ID NO: 239329 - protein, 11 aa, Japanese encephalitis virus
MLAVLMAVSYV

SEQ ID NO: 239330 - protein, 11 aa, Japanese encephalitis virus
LAVLMAVSYVV

SEQ ID NO: 239331 - protein, 11 aa, Japanese encephalitis virus
AVLMAVSYVVS

SEQ ID NO: 239332 - protein, 11 aa, Japanese encephalitis virus
VLMAVSYVVSG

SEQ ID NO: 239333 - protein, 11 aa, Japanese encephalitis virus
VSGKATDMWLD

SEQ ID NO: 239334 - protein, 11 aa, Japanese encephalitis virus
SGKATDMWLDR

SEQ ID NO: 239335 - protein, 11 aa, Japanese encephalitis virus
GKATDMWLDRA

SEQ ID NO: 239336 - protein, 11 aa, Japanese encephalitis virus
KATDMWLDRAA

SEQ ID NO: 239337 - protein, 11 aa, Japanese encephalitis virus
ATDMWLDRAAD

SEQ ID NO: 239338 - protein, 11 aa, Japanese encephalitis virus
TDMWLDRAADI

SEQ ID NO: 239339 - protein, 11 aa, Japanese encephalitis virus
DMWLDRAADIS

SEQ ID NO: 239340 - protein, 11 aa, Japanese encephalitis virus
MWLDRAADISW

SEQ ID NO: 239341 - protein, 11 aa, Japanese encephalitis virus
SWEMEAAITGS

SEQ ID NO: 239342 - protein, 11 aa, Japanese encephalitis virus
WEMEAAITGSS

SEQ ID NO: 239343 - protein, 11 aa, Japanese encephalitis virus
EMEAAITGSSR

SEQ ID NO: 239344 - protein, 11 aa, Japanese encephalitis virus
MEAAITGSSRR

SEQ ID NO: 239345 - protein, 11 aa, Japanese encephalitis virus
EAAITGSSRRL

SEQ ID NO: 239346 - protein, 11 aa, Japanese encephalitis virus
SSRRLDVKLDE

SEQ ID NO: 239347 - protein, 11 aa, Japanese encephalitis virus
SRRLDVKLDED

SEQ ID NO: 239348 - protein, 11 aa, Japanese encephalitis virus
RRLDVKLDEDG

SEQ ID NO: 239349 - protein, 11 aa, Japanese encephalitis virus
RLDVKLDEDGD

SEQ ID NO: 239350 - protein, 11 aa, Japanese encephalitis virus
LDVKLDEDGDF

SEQ ID NO: 239351 - protein, 11 aa, Japanese encephalitis virus
DVKLDEDGDFH

SEQ ID NO: 239352 - protein, 11 aa, Japanese encephalitis virus
VKLDEDGDFHL

SEQ ID NO: 239353 - protein, 11 aa, Japanese encephalitis virus
KLDEDGDFHLI

SEQ ID NO: 239354 - protein, 11 aa, Japanese encephalitis virus
LDEDGDFHLID

SEQ ID NO: 239355 - protein, 11 aa, Japanese encephalitis virus
DEDGDFHLIDD

SEQ ID NO: 239356 - protein, 11 aa, Japanese encephalitis virus
EDGDFHLIDDP

SEQ ID NO: 239357 - protein, 11 aa, Japanese encephalitis virus
DGDFHFIDDPG

SEQ ID NO: 239358 - protein, 11 aa, Japanese encephalitis virus
GDFHLIDVPGV

SEQ ID NO: 239359 - protein, 11 aa, Japanese encephalitis virus
DFHLIDVPGVP

SEQ ID NO: 239360 - protein, 11 aa, Japanese encephalitis virus
FHFIDDPGVPW

SEQ ID NO: 239361 - protein, 11 aa, Japanese encephalitis virus
HFIDDPGVPWK

SEQ ID NO: 239362 - protein, 11 aa, Japanese encephalitis virus
FIDDPGVPWKV

SEQ ID NO: 239363 - protein, 11 aa, Japanese encephalitis virus
IDVPGVPWKVW

SEQ ID NO: 239364 - protein, 11 aa, Japanese encephalitis virus
DDPGVPWKVWL

SEQ ID NO: 239365 - protein, 11 aa, Japanese encephalitis virus
DPGVPWKVWLL

SEQ ID NO: 239366 - protein, 11 aa, Japanese encephalitis virus
PGVPWKVWLLR

SEQ ID NO: 239367 - protein, 11 aa, Japanese encephalitis virus
GVPWKVWLLRM

SEQ ID NO: 239368 - protein, 11 aa, Japanese encephalitis virus
VPWKVWLLRMS

SEQ ID NO: 239369 - protein, 11 aa, Japanese encephalitis virus
PWKVWLLRMSC

SEQ ID NO: 239370 - protein, 11 aa, Japanese encephalitis virus
WKVWLLRMSCI

SEQ ID NO: 239371 - protein, 11 aa, Japanese encephalitis virus
LRMSCSGLAAL

SEQ ID NO: 239372 - protein, 11 aa, Japanese encephalitis virus
RMSCICLAALT

SEQ ID NO: 239373 - protein, 11 aa, Japanese encephalitis virus
MSCSGLAALTP

SEQ ID NO: 239374 - protein, 11 aa, Japanese encephalitis virus
SCIGLVALTPW

SEQ ID NO: 239375 - protein, 11 aa, Japanese encephalitis virus
CSGLAALTPWA

SEQ ID NO: 239376 - protein, 11 aa, Japanese encephalitis virus
SGLAALTPWAI

SEQ ID NO: 239377 - protein, 11 aa, Japanese encephalitis virus
CLAALTPWAIV

SEQ ID NO: 239378 - protein, 11 aa, Japanese encephalitis virus
LVALTPWAIVP

SEQ ID NO: 239379 - protein, 11 aa, Japanese encephalitis virus
VALTPWAIVPA

SEQ ID NO: 239380 - protein, 11 aa, Japanese encephalitis virus
FWDTPSPKPCL

SEQ ID NO: 239381 - protein, 11 aa, Japanese encephalitis virus
WDTPSPKPCLK

SEQ ID NO: 239382 - protein, 11 aa, Japanese encephalitis virus
DTPSPKPCLKG

SEQ ID NO: 239383 - protein, 11 aa, Japanese encephalitis virus
TPSPKPCLKGD

SEQ ID NO: 239384 - protein, 11 aa, Japanese encephalitis virus
PSPKPCLKGDT

SEQ ID NO: 239385 - protein, 11 aa, Japanese encephalitis virus
SPKPCLKGDTT

SEQ ID NO: 239386 - protein, 11 aa, Japanese encephalitis virus
PKPCLKGDTTT

SEQ ID NO: 239387 - protein, 11 aa, Japanese encephalitis virus
KPCLKGDTTTG

SEQ ID NO: 239388 - protein, 11 aa, Japanese encephalitis virus
PCLKGDTTTGV

SEQ ID NO: 239389 - protein, 11 aa, Japanese encephalitis virus
CLKGDTTTGVY

SEQ ID NO: 239390 - protein, 11 aa, Japanese encephalitis virus
LKGDTTTGVYR

SEQ ID NO: 239391 - protein, 11 aa, Japanese encephalitis virus
TTTGVYRIMAC

SEQ ID NO: 239392 - protein, 11 aa, Japanese encephalitis virus
TTGVYRIMACG

SEQ ID NO: 239393 - protein, 11 aa, Japanese encephalitis virus
TGVYRIMACGI

SEQ ID NO: 239394 - protein, 11 aa, Japanese encephalitis virus
GVYRIMARGIF

SEQ ID NO: 239395 - protein, 11 aa, Japanese encephalitis virus
VYRIMARGIFG

SEQ ID NO: 239396 - protein, 11 aa, Japanese encephalitis virus
YRIMARGIFGT

SEQ ID NO: 239397 - protein, 11 aa, Japanese encephalitis virus
RIMARGIFGTH

SEQ ID NO: 239398 - protein, 11 aa, Japanese encephalitis virus
IMARGIFGTHQ

SEQ ID NO: 239399 - protein, 11 aa, Japanese encephalitis virus
MARGIFGTHQA

SEQ ID NO: 239400 - protein, 11 aa, Japanese encephalitis virus
ACGILGTYQSG

SEQ ID NO: 239401 - protein, 11 aa, Japanese encephalitis virus
RGIFGTHQAGV

SEQ ID NO: 239402 - protein, 11 aa, Japanese encephalitis virus
GILGTYQSGVG

SEQ ID NO: 239403 - protein, 11 aa, Japanese encephalitis virus
ILGTYQSGVGV

SEQ ID NO: 239404 - protein, 11 aa, Japanese encephalitis virus
LGTYQSGVGVI

SEQ ID NO: 239405 - protein, 11 aa, Japanese encephalitis virus
GTHQAGVGVMY

SEQ ID NO: 239406 - protein, 11 aa, Japanese encephalitis virus
TYQSGVGVIYE

SEQ ID NO: 239407 - protein, 11 aa, Japanese encephalitis virus
YQSGVGVIYEN

SEQ ID NO: 239408 - protein, 11 aa, Japanese encephalitis virus
QAGVGVMYESV

SEQ ID NO: 239409 - protein, 11 aa, Japanese encephalitis virus
SGVGVIYENVF

SEQ ID NO: 239410 - protein, 11 aa, Japanese encephalitis virus
GVGVMYQNVFH

SEQ ID NO: 239411 - protein, 11 aa, Japanese encephalitis virus
VGVIYENVFHT

SEQ ID NO: 239412 - protein, 11 aa, Japanese encephalitis virus
GVIYENVFHTL

SEQ ID NO: 239413 - protein, 11 aa, Japanese encephalitis virus
VMYQNVFHTLW

SEQ ID NO: 239414 - protein, 11 aa, Japanese encephalitis virus
MYENVLHTLWH

SEQ ID NO: 239415 - protein, 11 aa, Japanese encephalitis virus
YENVFHTLWHP

SEQ ID NO: 239416 - protein, 11 aa, Japanese encephalitis virus
ENVFHTLWHPT

SEQ ID NO: 239417 - protein, 11 aa, Japanese encephalitis virus
SVFHTLWHTTR

SEQ ID NO: 239418 - protein, 11 aa, Japanese encephalitis virus
VLHTLWHTTRG

SEQ ID NO: 239419 - protein, 11 aa, Japanese encephalitis virus
LHTLWHTTRGA

SEQ ID NO: 239420 - protein, 11 aa, Japanese encephalitis virus
HTLWHPTRGAA

SEQ ID NO: 239421 - protein, 11 aa, Japanese encephalitis virus
TLWHTTRGAAV

SEQ ID NO: 239422 - protein, 11 aa, Japanese encephalitis virus
LWHTTRGAAIV

SEQ ID NO: 239423 - protein, 11 aa, Japanese encephalitis virus
WHTTRGAAIVS

SEQ ID NO: 239424 - protein, 11 aa, Japanese encephalitis virus
HTTRGAAIVSG

SEQ ID NO: 239425 - protein, 11 aa, Japanese encephalitis virus
TRGAAIVSGEG

SEQ ID NO: 239426 - protein, 11 aa, Japanese encephalitis virus
RGAAIVSGEGK

SEQ ID NO: 239427 - protein, 11 aa, Japanese encephalitis virus
GAAIVSGEGKL

SEQ ID NO: 239428 - protein, 11 aa, Japanese encephalitis virus
AAIVSGEGKLT

SEQ ID NO: 239429 - protein, 11 aa, Japanese encephalitis virus
AIVSGEGKLTP

SEQ ID NO: 239430 - protein, 11 aa, Japanese encephalitis virus
IVSGEGKLTPY

SEQ ID NO: 239431 - protein, 11 aa, Japanese encephalitis virus
VSGEGKLTPYW

SEQ ID NO: 239432 - protein, 11 aa, Japanese encephalitis virus
SGGGKLTPYWG

SEQ ID NO: 239433 - protein, 11 aa, Japanese encephalitis virus
GGGKLTPYWGS

SEQ ID NO: 239434 - protein, 11 aa, Japanese encephalitis virus
GGKLTPYWGSV

SEQ ID NO: 239435 - protein, 11 aa, Japanese encephalitis virus
GKLTPYWGSVR

SEQ ID NO: 239436 - protein, 11 aa, Japanese encephalitis virus
KLTPYWGSVRE

SEQ ID NO: 239437 - protein, 11 aa, Japanese encephalitis virus
LTPYWGSVRED

SEQ ID NO: 239438 - protein, 11 aa, Japanese encephalitis virus
TPYWGSVREDR

SEQ ID NO: 239439 - protein, 11 aa, Japanese encephalitis virus
PYWGSVREDRI

SEQ ID NO: 239440 - protein, 11 aa, Japanese encephalitis virus
YWGSVKEDRIS

SEQ ID NO: 239441 - protein, 11 aa, Japanese encephalitis virus
WGSVKEDRISY

SEQ ID NO: 239442 - protein, 11 aa, Japanese encephalitis virus
GSVKEDRISYG

SEQ ID NO: 239443 - protein, 11 aa, Japanese encephalitis virus
SVKEDRISYGG

SEQ ID NO: 239444 - protein, 11 aa, Japanese encephalitis virus
VKEDRISYGGP

SEQ ID NO: 239445 - protein, 11 aa, Japanese encephalitis virus
KEDRISYGGPW

SEQ ID NO: 239446 - protein, 11 aa, Japanese encephalitis virus
EDRISYGGPWR

SEQ ID NO: 239447 - protein, 11 aa, Japanese encephalitis virus
DRISYGGPWRF

SEQ ID NO: 239448 - protein, 11 aa, Japanese encephalitis virus
RISYGGPWRFD

SEQ ID NO: 239449 - protein, 11 aa, Japanese encephalitis virus
ISYGGPWRFDR

SEQ ID NO: 239450 - protein, 11 aa, Japanese encephalitis virus
SYGGPWRFDRK

SEQ ID NO: 239451 - protein, 11 aa, Japanese encephalitis virus
WRFDRKWNGTN

SEQ ID NO: 239452 - protein, 11 aa, Japanese encephalitis virus
RFDRKWNGTND

SEQ ID NO: 239453 - protein, 11 aa, Japanese encephalitis virus
FDRKWNGTNDV

SEQ ID NO: 239454 - protein, 11 aa, Japanese encephalitis virus
DRKWNGTNDVQ

SEQ ID NO: 239455 - protein, 11 aa, Japanese encephalitis virus
RKWNGTNDVQV

SEQ ID NO: 239456 - protein, 11 aa, Japanese encephalitis virus
KWNGTNDVQVI

SEQ ID NO: 239457 - protein, 11 aa, Japanese encephalitis virus
WNGTNDVQVIV

SEQ ID NO: 239458 - protein, 11 aa, Japanese encephalitis virus
NGTNDVQVIVV

SEQ ID NO: 239459 - protein, 11 aa, Japanese encephalitis virus
GTNDVQVIVVE

SEQ ID NO: 239460 - protein, 11 aa, Japanese encephalitis virus
TDDVQVIVVEQ

SEQ ID NO: 239461 - protein, 11 aa, Japanese encephalitis virus
DDVQVIVVEQG

SEQ ID NO: 239462 - protein, 11 aa, Japanese encephalitis virus
DVQVIVVEQGK

SEQ ID NO: 239463 - protein, 11 aa, Japanese encephalitis virus
VQVIVVEPGKP

SEQ ID NO: 239464 - protein, 11 aa, Japanese encephalitis virus
QVIVVEPGKPA

SEQ ID NO: 239465 - protein, 11 aa, Japanese encephalitis virus
IQTKPGVFCTP

SEQ ID NO: 239466 - protein, 11 aa, Japanese encephalitis virus
QTKPGIFPTPF

SEQ ID NO: 239467 - protein, 11 aa, Japanese encephalitis virus
TKPGIFPPPFG

SEQ ID NO: 239468 - protein, 11 aa, Japanese encephalitis virus
PFGEIGAVSLD

SEQ ID NO: 239469 - protein, 11 aa, Japanese encephalitis virus
FGEIGAVSLDY

SEQ ID NO: 239470 - protein, 11 aa, Japanese encephalitis virus
GEIGAVSLDYP

SEQ ID NO: 239471 - protein, 11 aa, Japanese encephalitis virus
EIGAVSLDYPR

SEQ ID NO: 239472 - protein, 11 aa, Japanese encephalitis virus
IGAVSLDYPRG

SEQ ID NO: 239473 - protein, 11 aa, Japanese encephalitis virus
GTVSLDYPRGT

SEQ ID NO: 239474 - protein, 11 aa, Japanese encephalitis virus
TVSLDYPRGTS

SEQ ID NO: 239475 - protein, 11 aa, Japanese encephalitis virus
PRGTSGSPILN

SEQ ID NO: 239476 - protein, 11 aa, Japanese encephalitis virus
RGTSGSPILDF

SEQ ID NO: 239477 - protein, 11 aa, Japanese encephalitis virus
GTSGSPILNSN

SEQ ID NO: 239478 - protein, 11 aa, Japanese encephalitis virus
TSGSPILDFNG

SEQ ID NO: 239479 - protein, 11 aa, Japanese encephalitis virus
SGSPILDFNGD

SEQ ID NO: 239480 - protein, 11 aa, Japanese encephalitis virus
GSPILNSNGDV

SEQ ID NO: 239481 - protein, 11 aa, Japanese encephalitis virus
SPILNSNGDVV

SEQ ID NO: 239482 - protein, 11 aa, Japanese encephalitis virus
PILDFNGDIIG

SEQ ID NO: 239483 - protein, 11 aa, Japanese encephalitis virus
ILNSNGDVVGC

SEQ ID NO: 239484 - protein, 11 aa, Japanese encephalitis virus
LNSNGDVVGCL

SEQ ID NO: 239485 - protein, 11 aa, Japanese encephalitis virus
DFNGDIIGLYG

SEQ ID NO: 239486 - protein, 11 aa, Japanese encephalitis virus
SNGDVVGCLGN

SEQ ID NO: 239487 - protein, 11 aa, Japanese encephalitis virus
NGDVVGCLGNG

SEQ ID NO: 239488 - protein, 11 aa, Japanese encephalitis virus
GDVVGCLGNGV

SEQ ID NO: 239489 - protein, 11 aa, Japanese encephalitis virus
DVVGCLGNGVE

SEQ ID NO: 239490 - protein, 11 aa, Japanese encephalitis virus
VVGCLGNGVEL

SEQ ID NO: 239491 - protein, 11 aa, Japanese encephalitis virus
VGCLGNGVELG

SEQ ID NO: 239492 - protein, 11 aa, Japanese encephalitis virus
GLYGNGGELGD

SEQ ID NO: 239493 - protein, 11 aa, Japanese encephalitis virus
CLGNGVELGDG

SEQ ID NO: 239494 - protein, 11 aa, Japanese encephalitis virus
LGNGVELGDGS

SEQ ID NO: 239495 - protein, 11 aa, Japanese encephalitis virus
GNGVELGDRSY

SEQ ID NO: 239496 - protein, 11 aa, Japanese encephalitis virus
NGGELGDGSYV

SEQ ID NO: 239497 - protein, 11 aa, Japanese encephalitis virus
GVELGDRSYVS

SEQ ID NO: 239498 - protein, 11 aa, Japanese encephalitis virus
GELGDGSYVSA

SEQ ID NO: 239499 - protein, 11 aa, Japanese encephalitis virus
ELGDRSYVSAI

SEQ ID NO: 239500 - protein, 11 aa, Japanese encephalitis virus
LGDRSYVSAIV

SEQ ID NO: 239501 - protein, 11 aa, Japanese encephalitis virus
GDRSYVSAIVQ

SEQ ID NO: 239502 - protein, 11 aa, Japanese encephalitis virus
DRSYVSAIVQG

SEQ ID NO: 239503 - protein, 11 aa, Japanese encephalitis virus
GSYVSAIVQGE

SEQ ID NO: 239504 - protein, 11 aa, Japanese encephalitis virus
SYVSAIVQGER

SEQ ID NO: 239505 - protein, 11 aa, Japanese encephalitis virus
YVSAIVQGERQ

SEQ ID NO: 239506 - protein, 11 aa, Japanese encephalitis virus
VSAIVQGERQE

SEQ ID NO: 239507 - protein, 11 aa, Japanese encephalitis virus
SAIVQGERQEE

SEQ ID NO: 239508 - protein, 11 aa, Japanese encephalitis virus
AIVQGERQEEP

SEQ ID NO: 239509 - protein, 11 aa, Japanese encephalitis virus
IVQGERQEEPV

SEQ ID NO: 239510 - protein, 11 aa, Japanese encephalitis virus
VQGERQEEPVP

SEQ ID NO: 239511 - protein, 11 aa, Japanese encephalitis virus
QGDRQEEPVPD

SEQ ID NO: 239512 - protein, 11 aa, Japanese encephalitis virus
GDRQEEPVPDA

SEQ ID NO: 239513 - protein, 11 aa, Japanese encephalitis virus
DRQEEPVPDAY

SEQ ID NO: 239514 - protein, 11 aa, Japanese encephalitis virus
RQEEPVPDAYT

SEQ ID NO: 239515 - protein, 11 aa, Japanese encephalitis virus
QEEPVPDAYTP

SEQ ID NO: 239516 - protein, 11 aa, Japanese encephalitis virus
EEPVPDAYTPS

SEQ ID NO: 239517 - protein, 11 aa, Japanese encephalitis virus
EPVPDAYTPSM

SEQ ID NO: 239518 - protein, 11 aa, Japanese encephalitis virus
PVPDAYTPSML

SEQ ID NO: 239519 - protein, 11 aa, Japanese encephalitis virus
MLKKRQMTVLD

SEQ ID NO: 239520 - protein, 11 aa, Japanese encephalitis virus
LKKRQMTVLDL

SEQ ID NO: 239521 - protein, 11 aa, Japanese encephalitis virus
KKRQMTVLDLH

SEQ ID NO: 239522 - protein, 11 aa, Japanese encephalitis virus
KRQLTVLDLHP

SEQ ID NO: 239523 - protein, 11 aa, Japanese encephalitis virus
RQLTVLDLHPG

SEQ ID NO: 239524 - protein, 11 aa, Japanese encephalitis virus
QLTVLDLHPGS

SEQ ID NO: 239525 - protein, 11 aa, Japanese encephalitis virus
LTVLDLHPGSG

SEQ ID NO: 239526 - protein, 11 aa, Japanese encephalitis virus
TVLDLHPGLGK

SEQ ID NO: 239527 - protein, 11 aa, Japanese encephalitis virus
VLDLPPGSGKT

SEQ ID NO: 239528 - protein, 11 aa, Japanese encephalitis virus
LDLHPGSGKTK

SEQ ID NO: 239529 - protein, 11 aa, Japanese encephalitis virus
DLHPGSGKTKK

SEQ ID NO: 239530 - protein, 11 aa, Japanese encephalitis virus
LHPGSGKTKKI

SEQ ID NO: 239531 - protein, 11 aa, Japanese encephalitis virus
HPGSGKTKKIL

SEQ ID NO: 239532 - protein, 11 aa, Japanese encephalitis virus
PGSGKTKKILP

SEQ ID NO: 239533 - protein, 11 aa, Japanese encephalitis virus
GSGKTKKILPQ

SEQ ID NO: 239534 - protein, 11 aa, Japanese encephalitis virus
SGKTKKILPQI

SEQ ID NO: 239535 - protein, 11 aa, Japanese encephalitis virus
GKTKKILPQII

SEQ ID NO: 239536 - protein, 11 aa, Japanese encephalitis virus
KTKKILPQIIK

SEQ ID NO: 239537 - protein, 11 aa, Japanese encephalitis virus
TKKILPQIIKD

SEQ ID NO: 239538 - protein, 11 aa, Japanese encephalitis virus
KKILPQIIKDA

SEQ ID NO: 239539 - protein, 11 aa, Japanese encephalitis virus
KILPQIIRDAI

SEQ ID NO: 239540 - protein, 11 aa, Japanese encephalitis virus
ILPQIIRDAIQ

SEQ ID NO: 239541 - protein, 11 aa, Japanese encephalitis virus
LPQIIRDAIQQ

SEQ ID NO: 239542 - protein, 11 aa, Japanese encephalitis virus
PQIIKDAIQQH

SEQ ID NO: 239543 - protein, 11 aa, Japanese encephalitis virus
QIIKDAIQQHL

SEQ ID NO: 239544 - protein, 11 aa, Japanese encephalitis virus
IIKDAIQQHLR

SEQ ID NO: 239545 - protein, 11 aa, Japanese encephalitis virus
IKDAIQQHLRT

SEQ ID NO: 239546 - protein, 11 aa, Japanese encephalitis virus
KDAIQQHLRTA

SEQ ID NO: 239547 - protein, 11 aa, Japanese encephalitis virus
DAIQQRLKTAV

SEQ ID NO: 239548 - protein, 11 aa, Japanese encephalitis virus
AIQQHLRTAVL

SEQ ID NO: 239549 - protein, 11 aa, Japanese encephalitis virus
IQQHLRTAVLA

SEQ ID NO: 239550 - protein, 11 aa, Japanese encephalitis virus
QQRLKTAVLAP

SEQ ID NO: 239551 - protein, 11 aa, Japanese encephalitis virus
QHLRTAVLAPT

SEQ ID NO: 239552 - protein, 11 aa, Japanese encephalitis virus
RLKTAVLAPTR

SEQ ID NO: 239553 - protein, 11 aa, Japanese encephalitis virus
LKTAVLAPTRV

SEQ ID NO: 239554 - protein, 11 aa, Japanese encephalitis virus
KTAVLAPTRVV

SEQ ID NO: 239555 - protein, 11 aa, Japanese encephalitis virus
TRVVAAEMAEV

SEQ ID NO: 239556 - protein, 11 aa, Japanese encephalitis virus
RVVAAEMAEVL

SEQ ID NO: 239557 - protein, 11 aa, Japanese encephalitis virus
VVAAEMAEALK

SEQ ID NO: 239558 - protein, 11 aa, Japanese encephalitis virus
VAAEMAEALKG

SEQ ID NO: 239559 - protein, 11 aa, Japanese encephalitis virus
AAEMAEALKGL

SEQ ID NO: 239560 - protein, 11 aa, Japanese encephalitis virus
AEMAEALKGLP

SEQ ID NO: 239561 - protein, 11 aa, Japanese encephalitis virus
EMAEALKGLPV

SEQ ID NO: 239562 - protein, 11 aa, Japanese encephalitis virus
MAEALKGLPVR

SEQ ID NO: 239563 - protein, 11 aa, Japanese encephalitis virus
AEALKGLPVRY

SEQ ID NO: 239564 - protein, 11 aa, Japanese encephalitis virus
EALKGLPVRYQ

SEQ ID NO: 239565 - protein, 11 aa, Japanese encephalitis virus
ALKGLPVRYQT

SEQ ID NO: 239566 - protein, 11 aa, Japanese encephalitis virus
LKGLPVRYQTS

SEQ ID NO: 239567 - protein, 11 aa, Japanese encephalitis virus
KGLPVRYQTSA

SEQ ID NO: 239568 - protein, 11 aa, Japanese encephalitis virus
VRYQTSAVQRS

SEQ ID NO: 239569 - protein, 11 aa, Japanese encephalitis virus
RYQTSAVQRSH

SEQ ID NO: 239570 - protein, 11 aa, Japanese encephalitis virus
YQTSAVQRSHQ

SEQ ID NO: 239571 - protein, 11 aa, Japanese encephalitis virus
QTSAVQRSHQG

SEQ ID NO: 239572 - protein, 11 aa, Japanese encephalitis virus
TSAVQRSHQGN

SEQ ID NO: 239573 - protein, 11 aa, Japanese encephalitis virus
SAVQRSHQGNE

SEQ ID NO: 239574 - protein, 11 aa, Japanese encephalitis virus
AVQREHQGNAI

SEQ ID NO: 239575 - protein, 11 aa, Japanese encephalitis virus
VQRSHQGNEIV

SEQ ID NO: 239576 - protein, 11 aa, Japanese encephalitis virus
QRSHQGNEIVD

SEQ ID NO: 239577 - protein, 11 aa, Japanese encephalitis virus
RSHQGNEIVDV

SEQ ID NO: 239578 - protein, 11 aa, Japanese encephalitis virus
SHQGNEIVDVM

SEQ ID NO: 239579 - protein, 11 aa, Japanese encephalitis virus
HQGNAIVDVMC

SEQ ID NO: 239580 - protein, 11 aa, Japanese encephalitis virus
QGNAIVDVMCH

SEQ ID NO: 239581 - protein, 11 aa, Japanese encephalitis virus
GNAIVDVMCHA

SEQ ID NO: 239582 - protein, 11 aa, Japanese encephalitis virus
NAIVDVMCHAT

SEQ ID NO: 239583 - protein, 11 aa, Japanese encephalitis virus
AIVDVMCHATL

SEQ ID NO: 239584 - protein, 11 aa, Japanese encephalitis virus
MCHATLTHRLT

SEQ ID NO: 239585 - protein, 11 aa, Japanese encephalitis virus
CHATLTHRLTS

SEQ ID NO: 239586 - protein, 11 aa, Japanese encephalitis virus
HATLTHRLTSP

SEQ ID NO: 239587 - protein, 11 aa, Japanese encephalitis virus
ATLTHRLTSPN

SEQ ID NO: 239588 - protein, 11 aa, Japanese encephalitis virus
TLTHRLTSPNR

SEQ ID NO: 239589 - protein, 11 aa, Japanese encephalitis virus
LTHRLTSPNRV

SEQ ID NO: 239590 - protein, 11 aa, Japanese encephalitis virus
THRLTSPNRVP

SEQ ID NO: 239591 - protein, 11 aa, Japanese encephalitis virus
HRLTSPNRVPN

SEQ ID NO: 239592 - protein, 11 aa, Japanese encephalitis virus
RLTSPNRVPNY

SEQ ID NO: 239593 - protein, 11 aa, Japanese encephalitis virus
LTSPNRVPNYN

SEQ ID NO: 239594 - protein, 11 aa, Japanese encephalitis virus
TSPNRVPNYNL

SEQ ID NO: 239595 - protein, 11 aa, Japanese encephalitis virus
MDEAHFTDPAG

SEQ ID NO: 239596 - protein, 11 aa, Japanese encephalitis virus
DEAHFTDPAGI

SEQ ID NO: 239597 - protein, 11 aa, Japanese encephalitis virus
EAHFTDPAGIA

SEQ ID NO: 239598 - protein, 11 aa, Japanese encephalitis virus
AHFTDPAGIAA

SEQ ID NO: 239599 - protein, 11 aa, Japanese encephalitis virus
HFTDPAGIAAR

SEQ ID NO: 239600 - protein, 11 aa, Japanese encephalitis virus
FTDPAGIAARG

SEQ ID NO: 239601 - protein, 11 aa, Japanese encephalitis virus
TDPAGIAARGY

SEQ ID NO: 239602 - protein, 11 aa, Japanese encephalitis virus
DPAGIAARGYI

SEQ ID NO: 239603 - protein, 11 aa, Japanese encephalitis virus
PAGIAARGYIA

SEQ ID NO: 239604 - protein, 11 aa, Japanese encephalitis virus
AGIAARGYIAT

SEQ ID NO: 239605 - protein, 11 aa, Japanese encephalitis virus
GIAARGYIATK

SEQ ID NO: 239606 - protein, 11 aa, Japanese encephalitis virus
EAAAIFMTATS

SEQ ID NO: 239607 - protein, 11 aa, Japanese encephalitis virus
AAAIFMTATSP

SEQ ID NO: 239608 - protein, 11 aa, Japanese encephalitis virus
AAIFMTATSPG

SEQ ID NO: 239609 - protein, 11 aa, Japanese encephalitis virus
AIFMTATSPGT

SEQ ID NO: 239610 - protein, 11 aa, Japanese encephalitis virus
IFMTATSPGTT

SEQ ID NO: 239611 - protein, 11 aa, Japanese encephalitis virus
FMTATSPGTTD

SEQ ID NO: 239612 - protein, 11 aa, Japanese encephalitis virus
MTATSPGTTDP

SEQ ID NO: 239613 - protein, 11 aa, Japanese encephalitis virus
TATSPGTTDPF

SEQ ID NO: 239614 - protein, 11 aa, Japanese encephalitis virus
ATSPGTTDPFP

SEQ ID NO: 239615 - protein, 11 aa, Japanese encephalitis virus
TSPGTTDPFPD

SEQ ID NO: 239616 - protein, 11 aa, Japanese encephalitis virus
SPGTTDPFPDS

SEQ ID NO: 239617 - protein, 11 aa, Japanese encephalitis virus
PGTTDPFPDSD

SEQ ID NO: 239618 - protein, 11 aa, Japanese encephalitis virus
GTTDPFPDSDA

SEQ ID NO: 239619 - protein, 11 aa, Japanese encephalitis virus
TTDPFPDSDAP

SEQ ID NO: 239620 - protein, 11 aa, Japanese encephalitis virus
TDPFPDSDAPI

SEQ ID NO: 239621 - protein, 11 aa, Japanese encephalitis virus
DPFPDSDAPIH

SEQ ID NO: 239622 - protein, 11 aa, Japanese encephalitis virus
PFPDSDAPIHD

SEQ ID NO: 239623 - protein, 11 aa, Japanese encephalitis virus
FPDSDAPIHDL

SEQ ID NO: 239624 - protein, 11 aa, Japanese encephalitis virus
PDSDAPIHDLQ

SEQ ID NO: 239625 - protein, 11 aa, Japanese encephalitis virus
DSDAPIHDLQD

SEQ ID NO: 239626 - protein, 11 aa, Japanese encephalitis virus
SNAPIHDLQDG

SEQ ID NO: 239627 - protein, 11 aa, Japanese encephalitis virus
NAPIHDLQDEV

SEQ ID NO: 239628 - protein, 11 aa, Japanese encephalitis virus
APIHDLQDETP

SEQ ID NO: 239629 - protein, 11 aa, Japanese encephalitis virus
PIHDLQDETPD

SEQ ID NO: 239630 - protein, 11 aa, Japanese encephalitis virus
IHDLQDEIPDW

SEQ ID NO: 239631 - protein, 11 aa, Japanese encephalitis virus
HDLQDEVPDRA

SEQ ID NO: 239632 - protein, 11 aa, Japanese encephalitis virus
DLQDETPDRAW

SEQ ID NO: 239633 - protein, 11 aa, Japanese encephalitis virus
LQDEVPDRAWS

SEQ ID NO: 239634 - protein, 11 aa, Japanese encephalitis virus
QDEVPDRAWSS

SEQ ID NO: 239635 - protein, 11 aa, Japanese encephalitis virus
DETPDRAWSSG

SEQ ID NO: 239636 - protein, 11 aa, Japanese encephalitis virus
WITDYAGKTVW

SEQ ID NO: 239637 - protein, 11 aa, Japanese encephalitis virus
ITDYAGKTVWF

SEQ ID NO: 239638 - protein, 11 aa, Japanese encephalitis virus
TDYAGKTVWFV

SEQ ID NO: 239639 - protein, 11 aa, Japanese encephalitis virus
DYAGKTVWFVA

SEQ ID NO: 239640 - protein, 11 aa, Japanese encephalitis virus
YSGKTVWFVAS

SEQ ID NO: 239641 - protein, 11 aa, Japanese encephalitis virus
SGKTVWFVASV

SEQ ID NO: 239642 - protein, 11 aa, Japanese encephalitis virus
GKTVWFVASVR

SEQ ID NO: 239643 - protein, 11 aa, Japanese encephalitis virus
KTVWFVASVRM

SEQ ID NO: 239644 - protein, 11 aa, Japanese encephalitis virus
TVWFVASVRMG

SEQ ID NO: 239645 - protein, 11 aa, Japanese encephalitis virus
VWFVASVRMGN

SEQ ID NO: 239646 - protein, 11 aa, Japanese encephalitis virus
WFVASVRMGNE

SEQ ID NO: 239647 - protein, 11 aa, Japanese encephalitis virus
FVASVRMGNEI

SEQ ID NO: 239648 - protein, 11 aa, Japanese encephalitis virus
VASVRMGNEIA

SEQ ID NO: 239649 - protein, 11 aa, Japanese encephalitis virus
ASVRMGNEIAM

SEQ ID NO: 239650 - protein, 11 aa, Japanese encephalitis virus
SVRMGNEIAMC

SEQ ID NO: 239651 - protein, 11 aa, Japanese encephalitis virus
VRMGNEIAMCL

SEQ ID NO: 239652 - protein, 11 aa, Japanese encephalitis virus
RMGNEIAMCLQ

SEQ ID NO: 239653 - protein, 11 aa, Japanese encephalitis virus
MGNEIAVCLQR

SEQ ID NO: 239654 - protein, 11 aa, Japanese encephalitis virus
GNEIAVCLQRA

SEQ ID NO: 239655 - protein, 11 aa, Japanese encephalitis virus
NEIAVCLQRAG

SEQ ID NO: 239656 - protein, 11 aa, Japanese encephalitis virus
EIAVCLQRAGK

SEQ ID NO: 239657 - protein, 11 aa, Japanese encephalitis virus
IAVCLQRAGKK

SEQ ID NO: 239658 - protein, 11 aa, Japanese encephalitis virus
AVCLQRAGKKV

SEQ ID NO: 239659 - protein, 11 aa, Japanese encephalitis virus
VCLQRAGKKVI

SEQ ID NO: 239660 - protein, 11 aa, Japanese encephalitis virus
CLQRAGKRVIQ

SEQ ID NO: 239661 - protein, 11 aa, Japanese encephalitis virus
LQRAGKRVIQL

SEQ ID NO: 239662 - protein, 11 aa, Japanese encephalitis virus
QRAGKRVIQLN

SEQ ID NO: 239663 - protein, 11 aa, Japanese encephalitis virus
RAGKKVIQLSR

SEQ ID NO: 239664 - protein, 11 aa, Japanese encephalitis virus
AGKKVIQLSRK

SEQ ID NO: 239665 - protein, 11 aa, Japanese encephalitis virus
GKRVIQLNRKS

SEQ ID NO: 239666 - protein, 11 aa, Japanese encephalitis virus
KKVIQLSRKSY

SEQ ID NO: 239667 - protein, 11 aa, Japanese encephalitis virus
RVIQLNRKSYD

SEQ ID NO: 239668 - protein, 11 aa, Japanese encephalitis virus
VIQLSRKSYDT

SEQ ID NO: 239669 - protein, 11 aa, Japanese encephalitis virus
IQLSRKSYDTE

SEQ ID NO: 239670 - protein, 11 aa, Japanese encephalitis virus
QLSRKSYDTEY

SEQ ID NO: 239671 - protein, 11 aa, Japanese encephalitis virus
LSRKSYDTEYP

SEQ ID NO: 239672 - protein, 11 aa, Japanese encephalitis virus
SRKSYDTEYPK

SEQ ID NO: 239673 - protein, 11 aa, Japanese encephalitis virus
DFVITTDISEV

SEQ ID NO: 239674 - protein, 11 aa, Japanese encephalitis virus
FVITTDISEVG

SEQ ID NO: 239675 - protein, 11 aa, Japanese encephalitis virus
VITTDISEVGA

SEQ ID NO: 239676 - protein, 11 aa, Japanese encephalitis virus
ITTDISEVGAN

SEQ ID NO: 239677 - protein, 11 aa, Japanese encephalitis virus
TTDISEVGANF

SEQ ID NO: 239678 - protein, 11 aa, Japanese encephalitis virus
TDISEVGANFG

SEQ ID NO: 239679 - protein, 11 aa, Japanese encephalitis virus
DISEVGANFGA

SEQ ID NO: 239680 - protein, 11 aa, Japanese encephalitis virus
ISEVGANFGAS

SEQ ID NO: 239681 - protein, 11 aa, Japanese encephalitis virus
SEVGANFGASR

SEQ ID NO: 239682 - protein, 11 aa, Japanese encephalitis virus
EVGANFGASRV

SEQ ID NO: 239683 - protein, 11 aa, Japanese encephalitis virus
VGANFGASRVI

SEQ ID NO: 239684 - protein, 11 aa, Japanese encephalitis virus
SRVIDCRKSVE

SEQ ID NO: 239685 - protein, 11 aa, Japanese encephalitis virus
RVIDCRKSVEP

SEQ ID NO: 239686 - protein, 11 aa, Japanese encephalitis virus
VIDCRKSVEPT

SEQ ID NO: 239687 - protein, 11 aa, Japanese encephalitis virus
IDCRKSVEPTI

SEQ ID NO: 239688 - protein, 11 aa, Japanese encephalitis virus
DCRKSVKPIIL

SEQ ID NO: 239689 - protein, 11 aa, Japanese encephalitis virus
CRKSVEPTILE

SEQ ID NO: 239690 - protein, 11 aa, Japanese encephalitis virus
RKSVEPTILEE

SEQ ID NO: 239691 - protein, 11 aa, Japanese encephalitis virus
KSVEPTILEEG

SEQ ID NO: 239692 - protein, 11 aa, Japanese encephalitis virus
SVKPTILEKEE

SEQ ID NO: 239693 - protein, 11 aa, Japanese encephalitis virus
VEPTILEEGEG

SEQ ID NO: 239694 - protein, 11 aa, Japanese encephalitis virus
KPIILEEGEGR

SEQ ID NO: 239695 - protein, 11 aa, Japanese encephalitis virus
PIILEEGEGRV

SEQ ID NO: 239696 - protein, 11 aa, Japanese encephalitis virus
IILEEGEGRVI

SEQ ID NO: 239697 - protein, 11 aa, Japanese encephalitis virus
ILEKEEGRVIL

SEQ ID NO: 239698 - protein, 11 aa, Japanese encephalitis virus
LEKEEGRVILG

SEQ ID NO: 239699 - protein, 11 aa, Japanese encephalitis virus
EEGEGRVFLGN

SEQ ID NO: 239700 - protein, 11 aa, Japanese encephalitis virus
KEEGRVILGNP

SEQ ID NO: 239701 - protein, 11 aa, Japanese encephalitis virus
EEGRVILGNPS

SEQ ID NO: 239702 - protein, 11 aa, Japanese encephalitis virus
EGRVFLGNPSP

SEQ ID NO: 239703 - protein, 11 aa, Japanese encephalitis virus
GRVFLGNPSPI

SEQ ID NO: 239704 - protein, 11 aa, Japanese encephalitis virus
RVFLGNPSPIT

SEQ ID NO: 239705 - protein, 11 aa, Japanese encephalitis virus
VFLGNPSPITS

SEQ ID NO: 239706 - protein, 11 aa, Japanese encephalitis virus
ILGNPSPITNA

SEQ ID NO: 239707 - protein, 11 aa, Japanese encephalitis virus
LGNPSPITNAS

SEQ ID NO: 239708 - protein, 11 aa, Japanese encephalitis virus
GNPSPITNASA

SEQ ID NO: 239709 - protein, 11 aa, Japanese encephalitis virus
NPSPITNASAA

SEQ ID NO: 239710 - protein, 11 aa, Japanese encephalitis virus
PSPITNASAAQ

SEQ ID NO: 239711 - protein, 11 aa, Japanese encephalitis virus
SPITNASAAQR

SEQ ID NO: 239712 - protein, 11 aa, Japanese encephalitis virus
PITNASAAQRR

SEQ ID NO: 239713 - protein, 11 aa, Japanese encephalitis virus
ITNASAAQRRG

SEQ ID NO: 239714 - protein, 11 aa, Japanese encephalitis virus
TNASAAQRRGR

SEQ ID NO: 239715 - protein, 11 aa, Japanese encephalitis virus
NASAAQRRGRV

SEQ ID NO: 239716 - protein, 11 aa, Japanese encephalitis virus
ASAAQRRGRVS

SEQ ID NO: 239717 - protein, 11 aa, Japanese encephalitis virus
SAAQRRGRVSR

SEQ ID NO: 239718 - protein, 11 aa, Japanese encephalitis virus
AAQRRGRVSRN

SEQ ID NO: 239719 - protein, 11 aa, Japanese encephalitis virus
AQRRGRVSRNP

SEQ ID NO: 239720 - protein, 11 aa, Japanese encephalitis virus
QRRGRVGRNPS

SEQ ID NO: 239721 - protein, 11 aa, Japanese encephalitis virus
RRGRVGRNPSQ

SEQ ID NO: 239722 - protein, 11 aa, Japanese encephalitis virus
RGRVSRNPNQV

SEQ ID NO: 239723 - protein, 11 aa, Japanese encephalitis virus
GRVSRNPNQVG

SEQ ID NO: 239724 - protein, 11 aa, Japanese encephalitis virus
RVSRNPNQVGD

SEQ ID NO: 239725 - protein, 11 aa, Japanese encephalitis virus
VGRNPSQVGDE

SEQ ID NO: 239726 - protein, 11 aa, Japanese encephalitis virus
GRNPSQVGDEY

SEQ ID NO: 239727 - protein, 11 aa, Japanese encephalitis virus
RNPNQVGDEYE

SEQ ID NO: 239728 - protein, 11 aa, Japanese encephalitis virus
NPSQVGDEYHY

SEQ ID NO: 239729 - protein, 11 aa, Japanese encephalitis virus
PSQVGDEYHYG

SEQ ID NO: 239730 - protein, 11 aa, Japanese encephalitis virus
NQVGDEYEYGG

SEQ ID NO: 239731 - protein, 11 aa, Japanese encephalitis virus
QVGDEYHYGGP

SEQ ID NO: 239732 - protein, 11 aa, Japanese encephalitis virus
VGDEYEYGGAT

SEQ ID NO: 239733 - protein, 11 aa, Japanese encephalitis virus
GDEYHYGGPTS

SEQ ID NO: 239734 - protein, 11 aa, Japanese encephalitis virus
DEYEYGGATSE

SEQ ID NO: 239735 - protein, 11 aa, Japanese encephalitis virus
EYHYGGPTSED

SEQ ID NO: 239736 - protein, 11 aa, Japanese encephalitis virus
YEYGGATSEDD

SEQ ID NO: 239737 - protein, 11 aa, Japanese encephalitis virus
HYGGATSEDDG

SEQ ID NO: 239738 - protein, 11 aa, Japanese encephalitis virus
YGGATSEGDSN

SEQ ID NO: 239739 - protein, 11 aa, Japanese encephalitis virus
GGPTSEDDSNL

SEQ ID NO: 239740 - protein, 11 aa, Japanese encephalitis virus
GATSEDDGNLA

SEQ ID NO: 239741 - protein, 11 aa, Japanese encephalitis virus
PTSEDDSNLAH

SEQ ID NO: 239742 - protein, 11 aa, Japanese encephalitis virus
TSEGDSNLAHW

SEQ ID NO: 239743 - protein, 11 aa, Japanese encephalitis virus
SEGDSNLAHWT

SEQ ID NO: 239744 - protein, 11 aa, Japanese encephalitis virus
EDDGNLAHWTE

SEQ ID NO: 239745 - protein, 11 aa, Japanese encephalitis virus
GDSNLAHWTEA

SEQ ID NO: 239746 - protein, 11 aa, Japanese encephalitis virus
DGNLAHWTEAK

SEQ ID NO: 239747 - protein, 11 aa, Japanese encephalitis virus
GNLAHWTEAKI

SEQ ID NO: 239748 - protein, 11 aa, Japanese encephalitis virus
NLAHWTEAKIL

SEQ ID NO: 239749 - protein, 11 aa, Japanese encephalitis virus
LAHWTEAKILL

SEQ ID NO: 239750 - protein, 11 aa, Japanese encephalitis virus
AHWTEAKILLD

SEQ ID NO: 239751 - protein, 11 aa, Japanese encephalitis virus
HWTEAKILLDN

SEQ ID NO: 239752 - protein, 11 aa, Japanese encephalitis virus
WTEAKILLDNI

SEQ ID NO: 239753 - protein, 11 aa, Japanese encephalitis virus
TEAKILLDNIH

SEQ ID NO: 239754 - protein, 11 aa, Japanese encephalitis virus
EAKILLDNIHM

SEQ ID NO: 239755 - protein, 11 aa, Japanese encephalitis virus
AKILLDNIHMP

SEQ ID NO: 239756 - protein, 11 aa, Japanese encephalitis virus
KILLDNIHMPN

SEQ ID NO: 239757 - protein, 11 aa, Japanese encephalitis virus
ILLDNIHMPNG

SEQ ID NO: 239758 - protein, 11 aa, Japanese encephalitis virus
LLDNIHMPNGL

SEQ ID NO: 239759 - protein, 11 aa, Japanese encephalitis virus
DNIHMPNGLVV

SEQ ID NO: 239760 - protein, 11 aa, Japanese encephalitis virus
NIHMPNGLVVQ

SEQ ID NO: 239761 - protein, 11 aa, Japanese encephalitis virus
IHMPNGLVVQL

SEQ ID NO: 239762 - protein, 11 aa, Japanese encephalitis virus
HMPNGLVVQLY

SEQ ID NO: 239763 - protein, 11 aa, Japanese encephalitis virus
MPNGLVVQLYG

SEQ ID NO: 239764 - protein, 11 aa, Japanese encephalitis virus
PNGLVVQLYGP

SEQ ID NO: 239765 - protein, 11 aa, Japanese encephalitis virus
NGLVVQLYGPE

SEQ ID NO: 239766 - protein, 11 aa, Japanese encephalitis virus
GLVVQLYGPER

SEQ ID NO: 239767 - protein, 11 aa, Japanese encephalitis virus
LVVQLYGPERE

SEQ ID NO: 239768 - protein, 11 aa, Japanese encephalitis virus
VVQLYGPEREK

SEQ ID NO: 239769 - protein, 11 aa, Japanese encephalitis virus
VQLYGPEREKA

SEQ ID NO: 239770 - protein, 11 aa, Japanese encephalitis virus
QLYGPEREKAS

SEQ ID NO: 239771 - protein, 11 aa, Japanese encephalitis virus
LYGPEREKAST

SEQ ID NO: 239772 - protein, 11 aa, Japanese encephalitis virus
YGPEREKASTM

SEQ ID NO: 239773 - protein, 11 aa, Japanese encephalitis virus
GPEREKASTMD

SEQ ID NO: 239774 - protein, 11 aa, Japanese encephalitis virus
PEREKASTMDG

SEQ ID NO: 239775 - protein, 11 aa, Japanese encephalitis virus
EREKASTMDGE

SEQ ID NO: 239776 - protein, 11 aa, Japanese encephalitis virus
REKASTMDGEY

SEQ ID NO: 239777 - protein, 11 aa, Japanese encephalitis virus
EKASTMDGEYR

SEQ ID NO: 239778 - protein, 11 aa, Japanese encephalitis virus
KASTMDGEYRL

SEQ ID NO: 239779 - protein, 11 aa, Japanese encephalitis virus
ASTMDGEYRLR

SEQ ID NO: 239780 - protein, 11 aa, Japanese encephalitis virus
STMDGEYRLRG

SEQ ID NO: 239781 - protein, 11 aa, Japanese encephalitis virus
TMDVEYRLRGE

SEQ ID NO: 239782 - protein, 11 aa, Japanese encephalitis virus
MDVEYRLRGEE

SEQ ID NO: 239783 - protein, 11 aa, Japanese encephalitis virus
DVEYRLRGEEK

SEQ ID NO: 239784 - protein, 11 aa, Japanese encephalitis virus
VEYRLRGEEKK

SEQ ID NO: 239785 - protein, 11 aa, Japanese encephalitis virus
TADLPVWLAYR

SEQ ID NO: 239786 - protein, 11 aa, Japanese encephalitis virus
ADLPVWLAYRV

SEQ ID NO: 239787 - protein, 11 aa, Japanese encephalitis virus
DLPVWLAYRVA

SEQ ID NO: 239788 - protein, 11 aa, Japanese encephalitis virus
LPVWLAYKVAP

SEQ ID NO: 239789 - protein, 11 aa, Japanese encephalitis virus
PVWLAYRVASN

SEQ ID NO: 239790 - protein, 11 aa, Japanese encephalitis virus
VWLAYRVASNG

SEQ ID NO: 239791 - protein, 11 aa, Japanese encephalitis virus
WLAYKVAPNGI

SEQ ID NO: 239792 - protein, 11 aa, Japanese encephalitis virus
LAYKVAPNGIQ

SEQ ID NO: 239793 - protein, 11 aa, Japanese encephalitis virus
AYRVASNGIQY

SEQ ID NO: 239794 - protein, 11 aa, Japanese encephalitis virus
YRVASNGIQYT

SEQ ID NO: 239795 - protein, 11 aa, Japanese encephalitis virus
RVASNGIQYTD

SEQ ID NO: 239796 - protein, 11 aa, Japanese encephalitis virus
VAPNGIQYTDR

SEQ ID NO: 239797 - protein, 11 aa, Japanese encephalitis virus
ASNGIQYTDRR

SEQ ID NO: 239798 - protein, 11 aa, Japanese encephalitis virus
SNGIQYTDRRW

SEQ ID NO: 239799 - protein, 11 aa, Japanese encephalitis virus
NGIQYTDRRWC

SEQ ID NO: 239800 - protein, 11 aa, Japanese encephalitis virus
GIQYTDRRWCF

SEQ ID NO: 239801 - protein, 11 aa, Japanese encephalitis virus
IQYTDRRWCFD

SEQ ID NO: 239802 - protein, 11 aa, Japanese encephalitis virus
QYTDRRWCFDG

SEQ ID NO: 239803 - protein, 11 aa, Japanese encephalitis virus
YTDRRWCFDGP

SEQ ID NO: 239804 - protein, 11 aa, Japanese encephalitis virus
TDRRWCFDGPR

SEQ ID NO: 239805 - protein, 11 aa, Japanese encephalitis virus
DRRWCFDGPRT

SEQ ID NO: 239806 - protein, 11 aa, Japanese encephalitis virus
RRWCFDGPRTN

SEQ ID NO: 239807 - protein, 11 aa, Japanese encephalitis virus
RWCFDGPRTNA

SEQ ID NO: 239808 - protein, 11 aa, Japanese encephalitis virus
GPRTNAILEDS

SEQ ID NO: 239809 - protein, 11 aa, Japanese encephalitis virus
PRTNAILEDNI

SEQ ID NO: 239810 - protein, 11 aa, Japanese encephalitis virus
RTNAILEDNIE

SEQ ID NO: 239811 - protein, 11 aa, Japanese encephalitis virus
TNAILEDNIEV

SEQ ID NO: 239812 - protein, 11 aa, Japanese encephalitis virus
NAILEDNIEVE

SEQ ID NO: 239813 - protein, 11 aa, Japanese encephalitis virus
AILEDNIEVEI

SEQ ID NO: 239814 - protein, 11 aa, Japanese encephalitis virus
ILEDNIEVEIV

SEQ ID NO: 239815 - protein, 11 aa, Japanese encephalitis virus
LEDNIEVEIVT

SEQ ID NO: 239816 - protein, 11 aa, Japanese encephalitis virus
EDNIEVEIVTR

SEQ ID NO: 239817 - protein, 11 aa, Japanese encephalitis virus
DNIEVEIVTRM

SEQ ID NO: 239818 - protein, 11 aa, Japanese encephalitis virus
NIEVEIVTRMG

SEQ ID NO: 239819 - protein, 11 aa, Japanese encephalitis virus
IEVEIVTRMGE

SEQ ID NO: 239820 - protein, 11 aa, Japanese encephalitis virus
EVEIVTRTGER

SEQ ID NO: 239821 - protein, 11 aa, Japanese encephalitis virus
VEIVTRTGERK

SEQ ID NO: 239822 - protein, 11 aa, Japanese encephalitis virus
EIVTRTGERKV

SEQ ID NO: 239823 - protein, 11 aa, Japanese encephalitis virus
IVTRTGERKVL

SEQ ID NO: 239824 - protein, 11 aa, Japanese encephalitis virus
VTRTGERKVLK

SEQ ID NO: 239825 - protein, 11 aa, Japanese encephalitis virus
TRTGERKVLKP

SEQ ID NO: 239826 - protein, 11 aa, Japanese encephalitis virus
RTGERKVLKPR

SEQ ID NO: 239827 - protein, 11 aa, Japanese encephalitis virus
TGERKVLKPRW

SEQ ID NO: 239828 - protein, 11 aa, Japanese encephalitis virus
GERKVLKPRWL

SEQ ID NO: 239829 - protein, 11 aa, Japanese encephalitis virus
ERKVLKPRWLD

SEQ ID NO: 239830 - protein, 11 aa, Japanese encephalitis virus
RKILKPRWLYA

SEQ ID NO: 239831 - protein, 11 aa, Japanese encephalitis virus
KILKPRWLYAR

SEQ ID NO: 239832 - protein, 11 aa, Japanese encephalitis virus
ILKPRWLYARV

SEQ ID NO: 239833 - protein, 11 aa, Japanese encephalitis virus
LKPRWLYARVY

SEQ ID NO: 239834 - protein, 11 aa, Japanese encephalitis virus
KPRWLYARVYA

SEQ ID NO: 239835 - protein, 11 aa, Japanese encephalitis virus
PRWLYARVYAD

SEQ ID NO: 239836 - protein, 11 aa, Japanese encephalitis virus
RWLYARVYADH

SEQ ID NO: 239837 - protein, 11 aa, Japanese encephalitis virus
WLYARVYADHQ

SEQ ID NO: 239838 - protein, 11 aa, Japanese encephalitis virus
LYARVYADHQA

SEQ ID NO: 239839 - protein, 11 aa, Japanese encephalitis virus
YARVYADHQAL

SEQ ID NO: 239840 - protein, 11 aa, Japanese encephalitis virus
QALKWFKDFAS

SEQ ID NO: 239841 - protein, 11 aa, Japanese encephalitis virus
ALKWFKDFASG

SEQ ID NO: 239842 - protein, 11 aa, Japanese encephalitis virus
LKWFKDFASGK

SEQ ID NO: 239843 - protein, 11 aa, Japanese encephalitis virus
KWFKDFASGKR

SEQ ID NO: 239844 - protein, 11 aa, Japanese encephalitis virus
WFKDFASGKRS

SEQ ID NO: 239845 - protein, 11 aa, Japanese encephalitis virus
FKDFASGKRSA

SEQ ID NO: 239846 - protein, 11 aa, Japanese encephalitis virus
KDFAAGKRSAI

SEQ ID NO: 239847 - protein, 11 aa, Japanese encephalitis virus
DFAAGKRSAIS

SEQ ID NO: 239848 - protein, 11 aa, Japanese encephalitis virus
FAAGKRSAISF

SEQ ID NO: 239849 - protein, 11 aa, Japanese encephalitis virus
AAGKRSAISFI

SEQ ID NO: 239850 - protein, 11 aa, Japanese encephalitis virus
AGKRSAISFIE

SEQ ID NO: 239851 - protein, 11 aa, Japanese encephalitis virus
GKRSAISFIEV

SEQ ID NO: 239852 - protein, 11 aa, Japanese encephalitis virus
KRSAISFIEVL

SEQ ID NO: 239853 - protein, 11 aa, Japanese encephalitis virus
RSAISFIEVLG

SEQ ID NO: 239854 - protein, 11 aa, Japanese encephalitis virus
SAISFIEVLGR

SEQ ID NO: 239855 - protein, 11 aa, Japanese encephalitis virus
AISFIEVLGRM

SEQ ID NO: 239856 - protein, 11 aa, Japanese encephalitis virus
ISFIEVLGRMP

SEQ ID NO: 239857 - protein, 11 aa, Japanese encephalitis virus
SFIEEPGRMPE

SEQ ID NO: 239858 - protein, 11 aa, Japanese encephalitis virus
FIEEPGRMPEH

SEQ ID NO: 239859 - protein, 11 aa, Japanese encephalitis virus
IEVRGRMPEHF

SEQ ID NO: 239860 - protein, 11 aa, Japanese encephalitis virus
EVLGRMPEHFA

SEQ ID NO: 239861 - protein, 11 aa, Japanese encephalitis virus
VRGRMPEHFMG

SEQ ID NO: 239862 - protein, 11 aa, Japanese encephalitis virus
PGRMPEHFMGK

SEQ ID NO: 239863 - protein, 11 aa, Japanese encephalitis virus
GRMPEHFAGKT

SEQ ID NO: 239864 - protein, 11 aa, Japanese encephalitis virus
RMPEHFAGKTR

SEQ ID NO: 239865 - protein, 11 aa, Japanese encephalitis virus
MPEHFAGKTRE

SEQ ID NO: 239866 - protein, 11 aa, Japanese encephalitis virus
PEHFAGKTREA

SEQ ID NO: 239867 - protein, 11 aa, Japanese encephalitis virus
EHFAGKTREAL

SEQ ID NO: 239868 - protein, 11 aa, Japanese encephalitis virus
HFAGKTREALD

SEQ ID NO: 239869 - protein, 11 aa, Japanese encephalitis virus
FAGKTREALDT

SEQ ID NO: 239870 - protein, 11 aa, Japanese encephalitis virus
AGKTREALDTM

SEQ ID NO: 239871 - protein, 11 aa, Japanese encephalitis virus
DTMYLVATAER

SEQ ID NO: 239872 - protein, 11 aa, Japanese encephalitis virus
TMYLVATAERG

SEQ ID NO: 239873 - protein, 11 aa, Japanese encephalitis virus
MYLVATAERGG

SEQ ID NO: 239874 - protein, 11 aa, Japanese encephalitis virus
YLVATAERGGK

SEQ ID NO: 239875 - protein, 11 aa, Japanese encephalitis virus
LVATAERGGKA

SEQ ID NO: 239876 - protein, 11 aa, Japanese encephalitis virus
VATAERGGKAH

SEQ ID NO: 239877 - protein, 11 aa, Japanese encephalitis virus
ATAERGGKAHR

SEQ ID NO: 239878 - protein, 11 aa, Japanese encephalitis virus
TAERGGKAHRM

SEQ ID NO: 239879 - protein, 11 aa, Japanese encephalitis virus
AERGGKAHRMA

SEQ ID NO: 239880 - protein, 11 aa, Japanese encephalitis virus
ERGGKAHRMAL

SEQ ID NO: 239881 - protein, 11 aa, Japanese encephalitis virus
RGGKAHRMALE

SEQ ID NO: 239882 - protein, 11 aa, Japanese encephalitis virus
GGKTHRMALEE

SEQ ID NO: 239883 - protein, 11 aa, Japanese encephalitis virus
GKTHRMALEEL

SEQ ID NO: 239884 - protein, 11 aa, Japanese encephalitis virus
KTHRMALEELP

SEQ ID NO: 239885 - protein, 11 aa, Japanese encephalitis virus
THRMALEELPD

SEQ ID NO: 239886 - protein, 11 aa, Japanese encephalitis virus
LEELPDALETV

SEQ ID NO: 239887 - protein, 11 aa, Japanese encephalitis virus
EELPDALETVT

SEQ ID NO: 239888 - protein, 11 aa, Japanese encephalitis virus
ELPDALETVTL

SEQ ID NO: 239889 - protein, 11 aa, Japanese encephalitis virus
LPDALETITLT

SEQ ID NO: 239890 - protein, 11 aa, Japanese encephalitis virus
PDALETITLIA

SEQ ID NO: 239891 - protein, 11 aa, Japanese encephalitis virus
DALETITLIAA

SEQ ID NO: 239892 - protein, 11 aa, Japanese encephalitis virus
ALETITLIAAI

SEQ ID NO: 239893 - protein, 11 aa, Japanese encephalitis virus
AIAVMTGGFFL

SEQ ID NO: 239894 - protein, 11 aa, Japanese encephalitis virus
ITAMTGGFFLL

SEQ ID NO: 239895 - protein, 11 aa, Japanese encephalitis virus
TVMTRGFFLLM

SEQ ID NO: 239896 - protein, 11 aa, Japanese encephalitis virus
VMTGGFFLLMK

SEQ ID NO: 239897 - protein, 11 aa, Japanese encephalitis virus
MTRGFFLLMMQ

SEQ ID NO: 239898 - protein, 11 aa, Japanese encephalitis virus
TRGFFLLMMQR

SEQ ID NO: 239899 - protein, 11 aa, Japanese encephalitis virus
GGFFLLMKQRK

SEQ ID NO: 239900 - protein, 11 aa, Japanese encephalitis virus
GFFLLMKQRKG

SEQ ID NO: 239901 - protein, 11 aa, Japanese encephalitis virus
FFLLMKQRKGI

SEQ ID NO: 239902 - protein, 11 aa, Japanese encephalitis virus
FLLMMQRKGIE

SEQ ID NO: 239903 - protein, 11 aa, Japanese encephalitis virus
LLMMQRKGIGR

SEQ ID NO: 239904 - protein, 11 aa, Japanese encephalitis virus
LMMQRKGIGRM

SEQ ID NO: 239905 - protein, 11 aa, Japanese encephalitis virus
MMQRKGIGRMG

SEQ ID NO: 239906 - protein, 11 aa, Japanese encephalitis virus
MQRKGIGRMGL

SEQ ID NO: 239907 - protein, 11 aa, Japanese encephalitis virus
QRKGIGRMGLG

SEQ ID NO: 239908 - protein, 11 aa, Japanese encephalitis virus
RKGIGRMGLGA

SEQ ID NO: 239909 - protein, 11 aa, Japanese encephalitis virus
KGIGRMGLGAL

SEQ ID NO: 239910 - protein, 11 aa, Japanese encephalitis virus
GIGRMGLGALV

SEQ ID NO: 239911 - protein, 11 aa, Japanese encephalitis virus
IGRMGLGALVL

SEQ ID NO: 239912 - protein, 11 aa, Japanese encephalitis virus
GRMGLGALVLT

SEQ ID NO: 239913 - protein, 11 aa, Japanese encephalitis virus
RMGLGALVLTL

SEQ ID NO: 239914 - protein, 11 aa, Japanese encephalitis virus
MGLGALVLVLA

SEQ ID NO: 239915 - protein, 11 aa, Japanese encephalitis virus
GLGALVLVLAT

SEQ ID NO: 239916 - protein, 11 aa, Japanese encephalitis virus
LGALVLVLATF

SEQ ID NO: 239917 - protein, 11 aa, Japanese encephalitis virus
GALVLVLATFF

SEQ ID NO: 239918 - protein, 11 aa, Japanese encephalitis virus
ALVLVLATFFL

SEQ ID NO: 239919 - protein, 11 aa, Japanese encephalitis virus
LVLVLATFFLW

SEQ ID NO: 239920 - protein, 11 aa, Japanese encephalitis virus
VLVLATFFLWA

SEQ ID NO: 239921 - protein, 11 aa, Japanese encephalitis virus
LVLATFFLWAA

SEQ ID NO: 239922 - protein, 11 aa, Japanese encephalitis virus
VLATFFLWAAE

SEQ ID NO: 239923 - protein, 11 aa, Japanese encephalitis virus
ATFFLWAAEVS

SEQ ID NO: 239924 - protein, 11 aa, Japanese encephalitis virus
TFFLWAAEVSG

SEQ ID NO: 239925 - protein, 11 aa, Japanese encephalitis virus
FFLWAAEVSGT

SEQ ID NO: 239926 - protein, 11 aa, Japanese encephalitis virus
FLWAAEVSGTK

SEQ ID NO: 239927 - protein, 11 aa, Japanese encephalitis virus
LWAAEVSGTKI

SEQ ID NO: 239928 - protein, 11 aa, Japanese encephalitis virus
WAAEVSGTKIA

SEQ ID NO: 239929 - protein, 11 aa, Japanese encephalitis virus
AAEVSGTKIAG

SEQ ID NO: 239930 - protein, 11 aa, Japanese encephalitis virus
AEVSGTKIAGT

SEQ ID NO: 239931 - protein, 11 aa, Japanese encephalitis virus
EVSGTKIAGTL

SEQ ID NO: 239932 - protein, 11 aa, Japanese encephalitis virus
VSGTKIAGTLL

SEQ ID NO: 239933 - protein, 11 aa, Japanese encephalitis virus
PGTKIAGTLLV

SEQ ID NO: 239934 - protein, 11 aa, Japanese encephalitis virus
GTKIAGTLLVA

SEQ ID NO: 239935 - protein, 11 aa, Japanese encephalitis virus
TKIAGTLLVAL

SEQ ID NO: 239936 - protein, 11 aa, Japanese encephalitis virus
KIAGTLLVALL

SEQ ID NO: 239937 - protein, 11 aa, Japanese encephalitis virus
IAGTLLVALLL

SEQ ID NO: 239938 - protein, 11 aa, Japanese encephalitis virus
AGTLLVALLLM

SEQ ID NO: 239939 - protein, 11 aa, Japanese encephalitis virus
GTLLVALLLMV

SEQ ID NO: 239940 - protein, 11 aa, Japanese encephalitis virus
TLLVALLLMVV

SEQ ID NO: 239941 - protein, 11 aa, Japanese encephalitis virus
LLVALLLMVVL

SEQ ID NO: 239942 - protein, 11 aa, Japanese encephalitis virus
LVALLLMVVLI

SEQ ID NO: 239943 - protein, 11 aa, Japanese encephalitis virus
VALLLMVVLIP

SEQ ID NO: 239944 - protein, 11 aa, Japanese encephalitis virus
LLMVVLIPEPG

SEQ ID NO: 239945 - protein, 11 aa, Japanese encephalitis virus
LMVVLIPEPGK

SEQ ID NO: 239946 - protein, 11 aa, Japanese encephalitis virus
MVVLIPEPGKQ

SEQ ID NO: 239947 - protein, 11 aa, Japanese encephalitis virus
VVLIPEPGKQR

SEQ ID NO: 239948 - protein, 11 aa, Japanese encephalitis virus
VLIPEPGKQRS

SEQ ID NO: 239949 - protein, 11 aa, Japanese encephalitis virus
LIPEPGKQRSQ

SEQ ID NO: 239950 - protein, 11 aa, Japanese encephalitis virus
IPEPGKQRSQT

SEQ ID NO: 239951 - protein, 11 aa, Japanese encephalitis virus
PEPGKQRSQTD

SEQ ID NO: 239952 - protein, 11 aa, Japanese encephalitis virus
EPGKQRSQTDN

SEQ ID NO: 239953 - protein, 11 aa, Japanese encephalitis virus
PGKQRSQTDNQ

SEQ ID NO: 239954 - protein, 11 aa, Japanese encephalitis virus
GKQRSQTDNQL

SEQ ID NO: 239955 - protein, 11 aa, Japanese encephalitis virus
KQKSQTDNQLA

SEQ ID NO: 239956 - protein, 11 aa, Japanese encephalitis virus
QRLQTDNQLAV

SEQ ID NO: 239957 - protein, 11 aa, Japanese encephalitis virus
KSQTDNQLAVF

SEQ ID NO: 239958 - protein, 11 aa, Japanese encephalitis virus
LQTDNQLAVFL

SEQ ID NO: 239959 - protein, 11 aa, Japanese encephalitis virus
QTGNQLAVFLI

SEQ ID NO: 239960 - protein, 11 aa, Japanese encephalitis virus
TGNQLAVFLIC

SEQ ID NO: 239961 - protein, 11 aa, Japanese encephalitis virus
GNQLAVFLICV

SEQ ID NO: 239962 - protein, 11 aa, Japanese encephalitis virus
FLICVLTVVGM

SEQ ID NO: 239963 - protein, 11 aa, Japanese encephalitis virus
LICVLTVVGMV

SEQ ID NO: 239964 - protein, 11 aa, Japanese encephalitis virus
ICVLTVVGMVA

SEQ ID NO: 239965 - protein, 11 aa, Japanese encephalitis virus
CVLTVVGVAAA

SEQ ID NO: 239966 - protein, 11 aa, Japanese encephalitis virus
VLTVVGVAAAN

SEQ ID NO: 239967 - protein, 11 aa, Japanese encephalitis virus
LTVVGMVAANE

SEQ ID NO: 239968 - protein, 11 aa, Japanese encephalitis virus
TVVGVAAANEY

SEQ ID NO: 239969 - protein, 11 aa, Japanese encephalitis virus
VVGMVAANEYG

SEQ ID NO: 239970 - protein, 11 aa, Japanese encephalitis virus
VGVAAANEYGM

SEQ ID NO: 239971 - protein, 11 aa, Japanese encephalitis virus
GMVAANEYGML

SEQ ID NO: 239972 - protein, 11 aa, Japanese encephalitis virus
MVAANEYGMLE

SEQ ID NO: 239973 - protein, 11 aa, Japanese encephalitis virus
AAANEYGMLEK

SEQ ID NO: 239974 - protein, 11 aa, Japanese encephalitis virus
AANEYGMLERT

SEQ ID NO: 239975 - protein, 11 aa, Japanese encephalitis virus
ANEYGMLERTK

SEQ ID NO: 239976 - protein, 11 aa, Japanese encephalitis virus
NEYGMLERTKA

SEQ ID NO: 239977 - protein, 11 aa, Japanese encephalitis virus
EYGMLERTKAD

SEQ ID NO: 239978 - protein, 11 aa, Japanese encephalitis virus
YGMLERTKADL

SEQ ID NO: 239979 - protein, 11 aa, Japanese encephalitis virus
GMLERTKADLK

SEQ ID NO: 239980 - protein, 11 aa, Japanese encephalitis virus
MLEKTKADIKS

SEQ ID NO: 239981 - protein, 11 aa, Japanese encephalitis virus
LEKTKADIKSM

SEQ ID NO: 239982 - protein, 11 aa, Japanese encephalitis virus
EKTKADIKSMF

SEQ ID NO: 239983 - protein, 11 aa, Japanese encephalitis virus
KTKADLKSMFA

SEQ ID NO: 239984 - protein, 11 aa, Japanese encephalitis virus
TKADLKSMFAG

SEQ ID NO: 239985 - protein, 11 aa, Japanese encephalitis virus
KADLKSMFGGR

SEQ ID NO: 239986 - protein, 11 aa, Japanese encephalitis virus
TQAPGLTGLPS

SEQ ID NO: 239987 - protein, 11 aa, Japanese encephalitis virus
QAPGLTGLPSM

SEQ ID NO: 239988 - protein, 11 aa, Japanese encephalitis virus
GMTGLPGMALD

SEQ ID NO: 239989 - protein, 11 aa, Japanese encephalitis virus
LTGLPSMTLDL

SEQ ID NO: 239990 - protein, 11 aa, Japanese encephalitis virus
TGLPSMTLDLR

SEQ ID NO: 239991 - protein, 11 aa, Japanese encephalitis virus
GLPGMALDLRP

SEQ ID NO: 239992 - protein, 11 aa, Japanese encephalitis virus
LPSVALDLRPA

SEQ ID NO: 239993 - protein, 11 aa, Japanese encephalitis virus
PSVALDLRPAT

SEQ ID NO: 239994 - protein, 11 aa, Japanese encephalitis virus
SMTLDLRPATA

SEQ ID NO: 239995 - protein, 11 aa, Japanese encephalitis virus
VALDLRPATAW

SEQ ID NO: 239996 - protein, 11 aa, Japanese encephalitis virus
TLDLRPATAWA

SEQ ID NO: 239997 - protein, 11 aa, Japanese encephalitis virus
LDLRPATAWAW

SEQ ID NO: 239998 - protein, 11 aa, Japanese encephalitis virus
DLRPATAWAWY

SEQ ID NO: 239999 - protein, 11 aa, Japanese encephalitis virus
LRPATAWAWYG

SEQ ID NO: 240000 - protein, 11 aa, Japanese encephalitis virus
RPATAWAWYGG

SEQ ID NO: 240001 - protein, 11 aa, Japanese encephalitis virus
PATAWAWYGGS

SEQ ID NO: 240002 - protein, 11 aa, Japanese encephalitis virus
ATAWAWYGGST

SEQ ID NO: 240003 - protein, 11 aa, Japanese encephalitis virus
TAWAWYGGSTV

SEQ ID NO: 240004 - protein, 11 aa, Japanese encephalitis virus
AWAWYGGSTVV

SEQ ID NO: 240005 - protein, 11 aa, Japanese encephalitis virus
WAWYGGSTVVL

SEQ ID NO: 240006 - protein, 11 aa, Japanese encephalitis virus
AWYGGSTVVLT

SEQ ID NO: 240007 - protein, 11 aa, Japanese encephalitis virus
WYGGSTVVLTP

SEQ ID NO: 240008 - protein, 11 aa, Japanese encephalitis virus
TVVLTPLLKHI

SEQ ID NO: 240009 - protein, 11 aa, Japanese encephalitis virus
VVLTPLLKHII

SEQ ID NO: 240010 - protein, 11 aa, Japanese encephalitis virus
VLTPLLKHIIT

SEQ ID NO: 240011 - protein, 11 aa, Japanese encephalitis virus
LTPLLKHIITS

SEQ ID NO: 240012 - protein, 11 aa, Japanese encephalitis virus
TPLLKHIITSE

SEQ ID NO: 240013 - protein, 11 aa, Japanese encephalitis virus
PLLKHIITSEY

SEQ ID NO: 240014 - protein, 11 aa, Japanese encephalitis virus
LLKHIITSEYV

SEQ ID NO: 240015 - protein, 11 aa, Japanese encephalitis virus
LKHIITSEYVT

SEQ ID NO: 240016 - protein, 11 aa, Japanese encephalitis virus
KHLITSEYVTP

SEQ ID NO: 240017 - protein, 11 aa, Japanese encephalitis virus
HIITSEYVTTS

SEQ ID NO: 240018 - protein, 11 aa, Japanese encephalitis virus
IITSEYVTTSL

SEQ ID NO: 240019 - protein, 11 aa, Japanese encephalitis virus
ITSEYVTPSLA

SEQ ID NO: 240020 - protein, 11 aa, Japanese encephalitis virus
TSEYVTPSLAS

SEQ ID NO: 240021 - protein, 11 aa, Japanese encephalitis virus
SEYVTPSLASI

SEQ ID NO: 240022 - protein, 11 aa, Japanese encephalitis virus
EYVTTSLASIS

SEQ ID NO: 240023 - protein, 11 aa, Japanese encephalitis virus
YVTTSLASISS

SEQ ID NO: 240024 - protein, 11 aa, Japanese encephalitis virus
VTTSLASISSQ

SEQ ID NO: 240025 - protein, 11 aa, Japanese encephalitis virus
TTSLASISSQA

SEQ ID NO: 240026 - protein, 11 aa, Japanese encephalitis virus
TSLASISSQAG

SEQ ID NO: 240027 - protein, 11 aa, Japanese encephalitis virus
SLASISSQAGS

SEQ ID NO: 240028 - protein, 11 aa, Japanese encephalitis virus
LASISSQAGSL

SEQ ID NO: 240029 - protein, 11 aa, Japanese encephalitis virus
ASISSQAGSLF

SEQ ID NO: 240030 - protein, 11 aa, Japanese encephalitis virus
SISSQAGSLFV

SEQ ID NO: 240031 - protein, 11 aa, Japanese encephalitis virus
ISSQAGSLFVL

SEQ ID NO: 240032 - protein, 11 aa, Japanese encephalitis virus
SSQAGSLFVLP

SEQ ID NO: 240033 - protein, 11 aa, Japanese encephalitis virus
SLFVLPRGVPS

SEQ ID NO: 240034 - protein, 11 aa, Japanese encephalitis virus
LFVLPRGVPST

SEQ ID NO: 240035 - protein, 11 aa, Japanese encephalitis virus
FVLPRGVPSTD

SEQ ID NO: 240036 - protein, 11 aa, Japanese encephalitis virus
VLPRGVPSTDL

SEQ ID NO: 240037 - protein, 11 aa, Japanese encephalitis virus
LPRGVPSTDLD

SEQ ID NO: 240038 - protein, 11 aa, Japanese encephalitis virus
PRGVPSTDLDL

SEQ ID NO: 240039 - protein, 11 aa, Japanese encephalitis virus
RGVPSTDLDLT

SEQ ID NO: 240040 - protein, 11 aa, Japanese encephalitis virus
GVPSTDLDLTV

SEQ ID NO: 240041 - protein, 11 aa, Japanese encephalitis virus
VPSTDLDLTVG

SEQ ID NO: 240042 - protein, 11 aa, Japanese encephalitis virus
PSTDLDLTVGL

SEQ ID NO: 240043 - protein, 11 aa, Japanese encephalitis virus
STDLDLTVGLV

SEQ ID NO: 240044 - protein, 11 aa, Japanese encephalitis virus
TDLDLTVGLVL

SEQ ID NO: 240045 - protein, 11 aa, Japanese encephalitis virus
DLDLTVGLVLL

SEQ ID NO: 240046 - protein, 11 aa, Japanese encephalitis virus
LDLTVGLVLLG

SEQ ID NO: 240047 - protein, 11 aa, Japanese encephalitis virus
DLTVGLVLLGC

SEQ ID NO: 240048 - protein, 11 aa, Japanese encephalitis virus
LTVGLVLLGCW

SEQ ID NO: 240049 - protein, 11 aa, Japanese encephalitis virus
TVGLVLLGCWG

SEQ ID NO: 240050 - protein, 11 aa, Japanese encephalitis virus
VGLVLLGCWGQ

SEQ ID NO: 240051 - protein, 11 aa, Japanese encephalitis virus
GLVFLGCWGQV

SEQ ID NO: 240052 - protein, 11 aa, Japanese encephalitis virus
LVFLGCWGQVT

SEQ ID NO: 240053 - protein, 11 aa, Japanese encephalitis virus
VFLGCWGQVTL

SEQ ID NO: 240054 - protein, 11 aa, Japanese encephalitis virus
FLGCWGQVTLT

SEQ ID NO: 240055 - protein, 11 aa, Japanese encephalitis virus
LGCWGQVTLTT

SEQ ID NO: 240056 - protein, 11 aa, Japanese encephalitis virus
GCWGQVTLTTF

SEQ ID NO: 240057 - protein, 11 aa, Japanese encephalitis virus
CWGQVTLTTFL

SEQ ID NO: 240058 - protein, 11 aa, Japanese encephalitis virus
WGQVTLTTFLT

SEQ ID NO: 240059 - protein, 11 aa, Japanese encephalitis virus
GQVTLTTFLTA

SEQ ID NO: 240060 - protein, 11 aa, Japanese encephalitis virus
QITLTTFLTAV

SEQ ID NO: 240061 - protein, 11 aa, Japanese encephalitis virus
ITLTTFLTAVV

SEQ ID NO: 240062 - protein, 11 aa, Japanese encephalitis virus
TLTTFLTAVVL

SEQ ID NO: 240063 - protein, 11 aa, Japanese encephalitis virus
LTAMVLVTLHY

SEQ ID NO: 240064 - protein, 11 aa, Japanese encephalitis virus
TAMVLVTLHYG

SEQ ID NO: 240065 - protein, 11 aa, Japanese encephalitis virus
VLVTLHYGYML

SEQ ID NO: 240066 - protein, 11 aa, Japanese encephalitis virus
LVTLHYGYMLP

SEQ ID NO: 240067 - protein, 11 aa, Japanese encephalitis virus
VTLHYGYMLPG

SEQ ID NO: 240068 - protein, 11 aa, Japanese encephalitis virus
TLHYGFMLPGW

SEQ ID NO: 240069 - protein, 11 aa, Japanese encephalitis virus
LHYGFMLPGWQ

SEQ ID NO: 240070 - protein, 11 aa, Japanese encephalitis virus
HYGFMLPGWQA

SEQ ID NO: 240071 - protein, 11 aa, Japanese encephalitis virus
YGFMLPGWQAQ

SEQ ID NO: 240072 - protein, 11 aa, Japanese encephalitis virus
GFMLPGWQAQA

SEQ ID NO: 240073 - protein, 11 aa, Japanese encephalitis virus
FMLPGWQAQAL

SEQ ID NO: 240074 - protein, 11 aa, Japanese encephalitis virus
MLPGWQAQALR

SEQ ID NO: 240075 - protein, 11 aa, Japanese encephalitis virus
LPGWQAQALRA

SEQ ID NO: 240076 - protein, 11 aa, Japanese encephalitis virus
PGWQAQALRAA

SEQ ID NO: 240077 - protein, 11 aa, Japanese encephalitis virus
GWQAQALRAAQ

SEQ ID NO: 240078 - protein, 11 aa, Japanese encephalitis virus
WQAQALRAAQR

SEQ ID NO: 240079 - protein, 11 aa, Japanese encephalitis virus
QAQALRAAQRR

SEQ ID NO: 240080 - protein, 11 aa, Japanese encephalitis virus
AQALRAAQRRT

SEQ ID NO: 240081 - protein, 11 aa, Japanese encephalitis virus
QALRAAQRRTA

SEQ ID NO: 240082 - protein, 11 aa, Japanese encephalitis virus
MVATDVPELEK

SEQ ID NO: 240083 - protein, 11 aa, Japanese encephalitis virus
VATDVPELEKT

SEQ ID NO: 240084 - protein, 11 aa, Japanese encephalitis virus
ATDVPELEKTT

SEQ ID NO: 240085 - protein, 11 aa, Japanese encephalitis virus
TDVPELEKTTP

SEQ ID NO: 240086 - protein, 11 aa, Japanese encephalitis virus
DVPELEKTTPL

SEQ ID NO: 240087 - protein, 11 aa, Japanese encephalitis virus
VPELEKTTPLM

SEQ ID NO: 240088 - protein, 11 aa, Japanese encephalitis virus
PELEKTTPLMQ

SEQ ID NO: 240089 - protein, 11 aa, Japanese encephalitis virus
ELEKTTPLMQK

SEQ ID NO: 240090 - protein, 11 aa, Japanese encephalitis virus
LEKTTPLMQKK

SEQ ID NO: 240091 - protein, 11 aa, Japanese encephalitis virus
EKTTPLMQKKI

SEQ ID NO: 240092 - protein, 11 aa, Japanese encephalitis virus
KTTPLMQKKIG

SEQ ID NO: 240093 - protein, 11 aa, Japanese encephalitis virus
TTPLMQKKIGQ

SEQ ID NO: 240094 - protein, 11 aa, Japanese encephalitis virus
TPLMQKKIGQV

SEQ ID NO: 240095 - protein, 11 aa, Japanese encephalitis virus
PLMQKKIGQVL

SEQ ID NO: 240096 - protein, 11 aa, Japanese encephalitis virus
LMQKKIGQVLL

SEQ ID NO: 240097 - protein, 11 aa, Japanese encephalitis virus
MQKKIGQVLLI

SEQ ID NO: 240098 - protein, 11 aa, Japanese encephalitis virus
QKKIGQVLLIG

SEQ ID NO: 240099 - protein, 11 aa, Japanese encephalitis virus
KKIGQVLLIGG

SEQ ID NO: 240100 - protein, 11 aa, Japanese encephalitis virus
KIGQVLLIGGS

SEQ ID NO: 240101 - protein, 11 aa, Japanese encephalitis virus
IGQVLLIGGSV

SEQ ID NO: 240102 - protein, 11 aa, Japanese encephalitis virus
GQVLLIGGSVA

SEQ ID NO: 240103 - protein, 11 aa, Japanese encephalitis virus
QVLLIGGSVAA

SEQ ID NO: 240104 - protein, 11 aa, Japanese encephalitis virus
VLLIGVSVAAL

SEQ ID NO: 240105 - protein, 11 aa, Japanese encephalitis virus
LLIGVSVAALL

SEQ ID NO: 240106 - protein, 11 aa, Japanese encephalitis virus
LIGVSVAALLV

SEQ ID NO: 240107 - protein, 11 aa, Japanese encephalitis virus
IGVSVAALLVN

SEQ ID NO: 240108 - protein, 11 aa, Japanese encephalitis virus
GVSVAALLVNP

SEQ ID NO: 240109 - protein, 11 aa, Japanese encephalitis virus
VSVAALLVNPN

SEQ ID NO: 240110 - protein, 11 aa, Japanese encephalitis virus
SVAALLVNPNV

SEQ ID NO: 240111 - protein, 11 aa, Japanese encephalitis virus
VAALLVNPNVT

SEQ ID NO: 240112 - protein, 11 aa, Japanese encephalitis virus
AALLVNPNVTT

SEQ ID NO: 240113 - protein, 11 aa, Japanese encephalitis virus
ALLVNPNVTTV

SEQ ID NO: 240114 - protein, 11 aa, Japanese encephalitis virus
LLVNPNVTTVR

SEQ ID NO: 240115 - protein, 11 aa, Japanese encephalitis virus
LVNPNVSTVRK

SEQ ID NO: 240116 - protein, 11 aa, Japanese encephalitis virus
VNPNVTTVKKP

SEQ ID NO: 240117 - protein, 11 aa, Japanese encephalitis virus
NPNVTTVKKPG

SEQ ID NO: 240118 - protein, 11 aa, Japanese encephalitis virus
PKITTVREAGV

SEQ ID NO: 240119 - protein, 11 aa, Japanese encephalitis virus
NVSTVRKAGVL

SEQ ID NO: 240120 - protein, 11 aa, Japanese encephalitis virus
ITTVREAGVLV

SEQ ID NO: 240121 - protein, 11 aa, Japanese encephalitis virus
TTVKKPGVLVT

SEQ ID NO: 240122 - protein, 11 aa, Japanese encephalitis virus
TVKKPGVLVTA

SEQ ID NO: 240123 - protein, 11 aa, Japanese encephalitis virus
VREAGVLVTAR

SEQ ID NO: 240124 - protein, 11 aa, Japanese encephalitis virus
REAGVLVTART

SEQ ID NO: 240125 - protein, 11 aa, Japanese encephalitis virus
EAGVLVTARTL

SEQ ID NO: 240126 - protein, 11 aa, Japanese encephalitis virus
AGVLVTARTLT

SEQ ID NO: 240127 - protein, 11 aa, Japanese encephalitis virus
GVLVTARTLTL

SEQ ID NO: 240128 - protein, 11 aa, Japanese encephalitis virus
VLVTARTLTLW

SEQ ID NO: 240129 - protein, 11 aa, Japanese encephalitis virus
LVTARTLTLWD

SEQ ID NO: 240130 - protein, 11 aa, Japanese encephalitis virus
VTARTLTLWDN

SEQ ID NO: 240131 - protein, 11 aa, Japanese encephalitis virus
TARTLTLWDNG

SEQ ID NO: 240132 - protein, 11 aa, Japanese encephalitis virus
ARTLTLWDNGA

SEQ ID NO: 240133 - protein, 11 aa, Japanese encephalitis virus
RTLTLWDNGAS

SEQ ID NO: 240134 - protein, 11 aa, Japanese encephalitis virus
TLSLWDNGASA

SEQ ID NO: 240135 - protein, 11 aa, Japanese encephalitis virus
LSLWDNGASAV

SEQ ID NO: 240136 - protein, 11 aa, Japanese encephalitis virus
TLWDNGASAAW

SEQ ID NO: 240137 - protein, 11 aa, Japanese encephalitis virus
LWDNGASAAWN

SEQ ID NO: 240138 - protein, 11 aa, Japanese encephalitis virus
WDNGASAAWNS

SEQ ID NO: 240139 - protein, 11 aa, Japanese encephalitis virus
DNGASAAWNST

SEQ ID NO: 240140 - protein, 11 aa, Japanese encephalitis virus
NGASAAWNSTT

SEQ ID NO: 240141 - protein, 11 aa, Japanese encephalitis virus
GASAAWNSTTA

SEQ ID NO: 240142 - protein, 11 aa, Japanese encephalitis virus
ASAAWNSTTAT

SEQ ID NO: 240143 - protein, 11 aa, Japanese encephalitis virus
SAAWNSTTATG

SEQ ID NO: 240144 - protein, 11 aa, Japanese encephalitis virus
AAWNSTTATGL

SEQ ID NO: 240145 - protein, 11 aa, Japanese encephalitis virus
AWNSTTATGLC

SEQ ID NO: 240146 - protein, 11 aa, Japanese encephalitis virus
LCHVMRGSYLR

SEQ ID NO: 240147 - protein, 11 aa, Japanese encephalitis virus
CHVMRGSYLRG

SEQ ID NO: 240148 - protein, 11 aa, Japanese encephalitis virus
HVMRGSYLRGG

SEQ ID NO: 240149 - protein, 11 aa, Japanese encephalitis virus
VMRGSYLRGGS

SEQ ID NO: 240150 - protein, 11 aa, Japanese encephalitis virus
MRGSYLRGGSI

SEQ ID NO: 240151 - protein, 11 aa, Japanese encephalitis virus
RGSYLRGGSIA

SEQ ID NO: 240152 - protein, 11 aa, Japanese encephalitis virus
GSYLRGGSIAW

SEQ ID NO: 240153 - protein, 11 aa, Japanese encephalitis virus
SYLRGGSIAWT

SEQ ID NO: 240154 - protein, 11 aa, Japanese encephalitis virus
YLRGGSIAWTL

SEQ ID NO: 240155 - protein, 11 aa, Japanese encephalitis virus
LRGGSIAWTLI

SEQ ID NO: 240156 - protein, 11 aa, Japanese encephalitis virus
RGGSIAWTLIK

SEQ ID NO: 240157 - protein, 11 aa, Japanese encephalitis virus
SIAWTLIKNAN

SEQ ID NO: 240158 - protein, 11 aa, Japanese encephalitis virus
IAWTLIKNANK

SEQ ID NO: 240159 - protein, 11 aa, Japanese encephalitis virus
AWTLIKNADNP

SEQ ID NO: 240160 - protein, 11 aa, Japanese encephalitis virus
WTLIKNANKPS

SEQ ID NO: 240161 - protein, 11 aa, Japanese encephalitis virus
TLIKNANKPSL

SEQ ID NO: 240162 - protein, 11 aa, Japanese encephalitis virus
LIKNANKPSLK

SEQ ID NO: 240163 - protein, 11 aa, Japanese encephalitis virus
IKNANKPSLKR

SEQ ID NO: 240164 - protein, 11 aa, Japanese encephalitis virus
KNANKPSLKRG

SEQ ID NO: 240165 - protein, 11 aa, Japanese encephalitis virus
NADKPSLKKGR

SEQ ID NO: 240166 - protein, 11 aa, Japanese encephalitis virus
KPSLKRGRSGG

SEQ ID NO: 240167 - protein, 11 aa, Japanese encephalitis virus
PSLKRGRSGGR

SEQ ID NO: 240168 - protein, 11 aa, Japanese encephalitis virus
SLKRGRSGGRT

SEQ ID NO: 240169 - protein, 11 aa, Japanese encephalitis virus
LKRGRSGGRTL

SEQ ID NO: 240170 - protein, 11 aa, Japanese encephalitis virus
KRGRSGGRTLG

SEQ ID NO: 240171 - protein, 11 aa, Japanese encephalitis virus
KGRPGGRTLGE

SEQ ID NO: 240172 - protein, 11 aa, Japanese encephalitis virus
GRSGGRTLGEQ

SEQ ID NO: 240173 - protein, 11 aa, Japanese encephalitis virus
RSGGRTLGEQW

SEQ ID NO: 240174 - protein, 11 aa, Japanese encephalitis virus
SGGRTLGEQWK

SEQ ID NO: 240175 - protein, 11 aa, Japanese encephalitis virus
GGRTLGEQWKR

SEQ ID NO: 240176 - protein, 11 aa, Japanese encephalitis virus
GRTLGEQWKRK

SEQ ID NO: 240177 - protein, 11 aa, Japanese encephalitis virus
RTLWEQWKEKL

SEQ ID NO: 240178 - protein, 11 aa, Japanese encephalitis virus
TLGEQWKERLN

SEQ ID NO: 240179 - protein, 11 aa, Japanese encephalitis virus
LGEQWKERLNA

SEQ ID NO: 240180 - protein, 11 aa, Japanese encephalitis virus
QWKERLNAMSR

SEQ ID NO: 240181 - protein, 11 aa, Japanese encephalitis virus
KLNAMSRDEFF

SEQ ID NO: 240182 - protein, 11 aa, Japanese encephalitis virus
LNAMSRDEFFK

SEQ ID NO: 240183 - protein, 11 aa, Japanese encephalitis virus
NAMSRDEFFKY

SEQ ID NO: 240184 - protein, 11 aa, Japanese encephalitis virus
AMSRDEFFKYR

SEQ ID NO: 240185 - protein, 11 aa, Japanese encephalitis virus
MSRDEFFKYRR

SEQ ID NO: 240186 - protein, 11 aa, Japanese encephalitis virus
SRDEFFKYRRE

SEQ ID NO: 240187 - protein, 11 aa, Japanese encephalitis virus
RDEFFKYRREA

SEQ ID NO: 240188 - protein, 11 aa, Japanese encephalitis virus
DEFFKYRREAI

SEQ ID NO: 240189 - protein, 11 aa, Japanese encephalitis virus
EFFQYRREAII

SEQ ID NO: 240190 - protein, 11 aa, Japanese encephalitis virus
FFKYRREGIIE

SEQ ID NO: 240191 - protein, 11 aa, Japanese encephalitis virus
FQYRREAIIEV

SEQ ID NO: 240192 - protein, 11 aa, Japanese encephalitis virus
KYRREGIIEVD

SEQ ID NO: 240193 - protein, 11 aa, Japanese encephalitis virus
YRREGIIEVDR

SEQ ID NO: 240194 - protein, 11 aa, Japanese encephalitis virus
RREGIIEVDRT

SEQ ID NO: 240195 - protein, 11 aa, Japanese encephalitis virus
REGIIEVDRTE

SEQ ID NO: 240196 - protein, 11 aa, Japanese encephalitis virus
EGIIEVDRTEA

SEQ ID NO: 240197 - protein, 11 aa, Japanese encephalitis virus
AIIEVDRTEAC

SEQ ID NO: 240198 - protein, 11 aa, Japanese encephalitis virus
IIEVDRTEACR

SEQ ID NO: 240199 - protein, 11 aa, Japanese encephalitis virus
IEVDRTEACRA

SEQ ID NO: 240200 - protein, 11 aa, Japanese encephalitis virus
EVDRTEACRAR

SEQ ID NO: 240201 - protein, 11 aa, Japanese encephalitis virus
VDRTEACRARR

SEQ ID NO: 240202 - protein, 11 aa, Japanese encephalitis virus
DRTEACRARRE

SEQ ID NO: 240203 - protein, 11 aa, Japanese encephalitis virus
RTEACRARREN

SEQ ID NO: 240204 - protein, 11 aa, Japanese encephalitis virus
TEACRARRENN

SEQ ID NO: 240205 - protein, 11 aa, Japanese encephalitis virus
EARRARRENNV

SEQ ID NO: 240206 - protein, 11 aa, Japanese encephalitis virus
ARRARRENNVV

SEQ ID NO: 240207 - protein, 11 aa, Japanese encephalitis virus
RRARRENNVVG

SEQ ID NO: 240208 - protein, 11 aa, Japanese encephalitis virus
RARRENNVVGG

SEQ ID NO: 240209 - protein, 11 aa, Japanese encephalitis virus
ARRENNVVGGH

SEQ ID NO: 240210 - protein, 11 aa, Japanese encephalitis virus
RRENNVVGGHP

SEQ ID NO: 240211 - protein, 11 aa, Japanese encephalitis virus
RENNVVGGHPV

SEQ ID NO: 240212 - protein, 11 aa, Japanese encephalitis virus
ENNVVGGHPVS

SEQ ID NO: 240213 - protein, 11 aa, Japanese encephalitis virus
NNVVGGHPVSR

SEQ ID NO: 240214 - protein, 11 aa, Japanese encephalitis virus
NVVGGHPVSRG

SEQ ID NO: 240215 - protein, 11 aa, Japanese encephalitis virus
VVGGHPVSRGS

SEQ ID NO: 240216 - protein, 11 aa, Japanese encephalitis virus
LRWLVEKGFVP

SEQ ID NO: 240217 - protein, 11 aa, Japanese encephalitis virus
RWLVEKGFVPP

SEQ ID NO: 240218 - protein, 11 aa, Japanese encephalitis virus
WLVEKGFVPPI

SEQ ID NO: 240219 - protein, 11 aa, Japanese encephalitis virus
LVEKGFVPPIG

SEQ ID NO: 240220 - protein, 11 aa, Japanese encephalitis virus
VEKGFVPPIGK

SEQ ID NO: 240221 - protein, 11 aa, Japanese encephalitis virus
EKGFVPPIGKV

SEQ ID NO: 240222 - protein, 11 aa, Japanese encephalitis virus
KGFVPPIGKVI

SEQ ID NO: 240223 - protein, 11 aa, Japanese encephalitis virus
GFVSPIGKVVD

SEQ ID NO: 240224 - protein, 11 aa, Japanese encephalitis virus
FVPPIGKVIDL

SEQ ID NO: 240225 - protein, 11 aa, Japanese encephalitis virus
VPPIGKVIDLG

SEQ ID NO: 240226 - protein, 11 aa, Japanese encephalitis virus
PPIGKVIDLGC

SEQ ID NO: 240227 - protein, 11 aa, Japanese encephalitis virus
PIGKVVDLGCG

SEQ ID NO: 240228 - protein, 11 aa, Japanese encephalitis virus
IGKVVDLGCGR

SEQ ID NO: 240229 - protein, 11 aa, Japanese encephalitis virus
GKVIDLGCGCG

SEQ ID NO: 240230 - protein, 11 aa, Japanese encephalitis virus
KVIDLGCGRGS

SEQ ID NO: 240231 - protein, 11 aa, Japanese encephalitis virus
VIDLGCGRGSW

SEQ ID NO: 240232 - protein, 11 aa, Japanese encephalitis virus
IDLGCGRGSWN

SEQ ID NO: 240233 - protein, 11 aa, Japanese encephalitis virus
DLGCGRGSWNY

SEQ ID NO: 240234 - protein, 11 aa, Japanese encephalitis virus
LGCGRGSWNYY

SEQ ID NO: 240235 - protein, 11 aa, Japanese encephalitis virus
GCGRGSWNYYA

SEQ ID NO: 240236 - protein, 11 aa, Japanese encephalitis virus
CGRGSWNYYAA

SEQ ID NO: 240237 - protein, 11 aa, Japanese encephalitis virus
GRGSWNYYAAT

SEQ ID NO: 240238 - protein, 11 aa, Japanese encephalitis virus
RGSWNYYAATL

SEQ ID NO: 240239 - protein, 11 aa, Japanese encephalitis virus
GSWNYYAATLK

SEQ ID NO: 240240 - protein, 11 aa, Japanese encephalitis virus
SWNYYAATLKK

SEQ ID NO: 240241 - protein, 11 aa, Japanese encephalitis virus
WNYYAATLKKV

SEQ ID NO: 240242 - protein, 11 aa, Japanese encephalitis virus
NYYAATLKKVQ

SEQ ID NO: 240243 - protein, 11 aa, Japanese encephalitis virus
YCAATLKKVQE

SEQ ID NO: 240244 - protein, 11 aa, Japanese encephalitis virus
YAATLKKVQEF

SEQ ID NO: 240245 - protein, 11 aa, Japanese encephalitis virus
AATLKKVQEVK

SEQ ID NO: 240246 - protein, 11 aa, Japanese encephalitis virus
ATLKKVQEVKG

SEQ ID NO: 240247 - protein, 11 aa, Japanese encephalitis virus
TLKKVQEVKGY

SEQ ID NO: 240248 - protein, 11 aa, Japanese encephalitis virus
LKKVQEVKGYT

SEQ ID NO: 240249 - protein, 11 aa, Japanese encephalitis virus
KKVQEVKGYTK

SEQ ID NO: 240250 - protein, 11 aa, Japanese encephalitis virus
KVQEVKGYTKG

SEQ ID NO: 240251 - protein, 11 aa, Japanese encephalitis virus
VQEVKGYTKGG

SEQ ID NO: 240252 - protein, 11 aa, Japanese encephalitis virus
QEVKGYTKGGA

SEQ ID NO: 240253 - protein, 11 aa, Japanese encephalitis virus
EVKGYTKGGAG

SEQ ID NO: 240254 - protein, 11 aa, Japanese encephalitis virus
VKGYTKGGAGH

SEQ ID NO: 240255 - protein, 11 aa, Japanese encephalitis virus
KGYTKGGAGHE

SEQ ID NO: 240256 - protein, 11 aa, Japanese encephalitis virus
KGGAGHEEPMP

SEQ ID NO: 240257 - protein, 11 aa, Japanese encephalitis virus
GGAGHEEPMPM

SEQ ID NO: 240258 - protein, 11 aa, Japanese encephalitis virus
GAGHEEPMPMQ

SEQ ID NO: 240259 - protein, 11 aa, Japanese encephalitis virus
AGHEEPMPMQS

SEQ ID NO: 240260 - protein, 11 aa, Japanese encephalitis virus
GHEEPMPMQSY

SEQ ID NO: 240261 - protein, 11 aa, Japanese encephalitis virus
HEEPMPMQSYG

SEQ ID NO: 240262 - protein, 11 aa, Japanese encephalitis virus
EEPMLMQSYGR

SEQ ID NO: 240263 - protein, 11 aa, Japanese encephalitis virus
EPMLMQSYGRN

SEQ ID NO: 240264 - protein, 11 aa, Japanese encephalitis virus
PMLMQSYGRNL

SEQ ID NO: 240265 - protein, 11 aa, Japanese encephalitis virus
MLMQSYGRNLV

SEQ ID NO: 240266 - protein, 11 aa, Japanese encephalitis virus
LMQSYGRNLVS

SEQ ID NO: 240267 - protein, 11 aa, Japanese encephalitis virus
MQSYGRNLVSL

SEQ ID NO: 240268 - protein, 11 aa, Japanese encephalitis virus
QSYGRNLVSLK

SEQ ID NO: 240269 - protein, 11 aa, Japanese encephalitis virus
SYGRNLVSLKS

SEQ ID NO: 240270 - protein, 11 aa, Japanese encephalitis virus
YGRNLVSLKSG

SEQ ID NO: 240271 - protein, 11 aa, Japanese encephalitis virus
GRNLVSLKSGV

SEQ ID NO: 240272 - protein, 11 aa, Japanese encephalitis virus
RNLVSLKSGVD

SEQ ID NO: 240273 - protein, 11 aa, Japanese encephalitis virus
NLVSMKSGVDV

SEQ ID NO: 240274 - protein, 11 aa, Japanese encephalitis virus
LVSLKSGVHVF

SEQ ID NO: 240275 - protein, 11 aa, Japanese encephalitis virus
VSMKSGVDVFY

SEQ ID NO: 240276 - protein, 11 aa, Japanese encephalitis virus
SLKSGVDVFYR

SEQ ID NO: 240277 - protein, 11 aa, Japanese encephalitis virus
MKSGVDVFYKP

SEQ ID NO: 240278 - protein, 11 aa, Japanese encephalitis virus
KSGVDVFYRPS

SEQ ID NO: 240279 - protein, 11 aa, Japanese encephalitis virus
SGVDVFYRPSE

SEQ ID NO: 240280 - protein, 11 aa, Japanese encephalitis virus
GVDVFYRPSEP

SEQ ID NO: 240281 - protein, 11 aa, Japanese encephalitis virus
VDVFYRPSEPS

SEQ ID NO: 240282 - protein, 11 aa, Japanese encephalitis virus
HVFYKPSEPSD

SEQ ID NO: 240283 - protein, 11 aa, Japanese encephalitis virus
VFYRPSEPSDT

SEQ ID NO: 240284 - protein, 11 aa, Japanese encephalitis virus
FYRPSEPSDTL

SEQ ID NO: 240285 - protein, 11 aa, Japanese encephalitis virus
YRPSEPSDTLL

SEQ ID NO: 240286 - protein, 11 aa, Japanese encephalitis virus
RPSEPSDTLLC

SEQ ID NO: 240287 - protein, 11 aa, Japanese encephalitis virus
PSEPSDTLLCD

SEQ ID NO: 240288 - protein, 11 aa, Japanese encephalitis virus
SEPSDTLLCDI

SEQ ID NO: 240289 - protein, 11 aa, Japanese encephalitis virus
EPSDTLLCDIG

SEQ ID NO: 240290 - protein, 11 aa, Japanese encephalitis virus
PSDTLLCDIGE

SEQ ID NO: 240291 - protein, 11 aa, Japanese encephalitis virus
SDTLLCDIGES

SEQ ID NO: 240292 - protein, 11 aa, Japanese encephalitis virus
DTLLCDIGESS

SEQ ID NO: 240293 - protein, 11 aa, Japanese encephalitis virus
TLLCDIGESSP

SEQ ID NO: 240294 - protein, 11 aa, Japanese encephalitis virus
LLCDIGESSPS

SEQ ID NO: 240295 - protein, 11 aa, Japanese encephalitis virus
LCDIGESSPSP

SEQ ID NO: 240296 - protein, 11 aa, Japanese encephalitis virus
CDIGESSPSPD

SEQ ID NO: 240297 - protein, 11 aa, Japanese encephalitis virus
DIGESSPSPDV

SEQ ID NO: 240298 - protein, 11 aa, Japanese encephalitis virus
IGESSPSPDVE

SEQ ID NO: 240299 - protein, 11 aa, Japanese encephalitis virus
GESSPSPDVEE

SEQ ID NO: 240300 - protein, 11 aa, Japanese encephalitis virus
ESSPSPDVEEQ

SEQ ID NO: 240301 - protein, 11 aa, Japanese encephalitis virus
SSPSPDVEEQR

SEQ ID NO: 240302 - protein, 11 aa, Japanese encephalitis virus
SPSPDVEEQRT

SEQ ID NO: 240303 - protein, 11 aa, Japanese encephalitis virus
PSPDVEEQRTL

SEQ ID NO: 240304 - protein, 11 aa, Japanese encephalitis virus
SPDVEEQRTLR

SEQ ID NO: 240305 - protein, 11 aa, Japanese encephalitis virus
PDVEEQRTLRV

SEQ ID NO: 240306 - protein, 11 aa, Japanese encephalitis virus
DVEEQRTLRVL

SEQ ID NO: 240307 - protein, 11 aa, Japanese encephalitis virus
MTSDWLHRGPI

SEQ ID NO: 240308 - protein, 11 aa, Japanese encephalitis virus
TSDWLHRGPIE

SEQ ID NO: 240309 - protein, 11 aa, Japanese encephalitis virus
SDWLHRGPIEF

SEQ ID NO: 240310 - protein, 11 aa, Japanese encephalitis virus
DWLHRGPIEFC

SEQ ID NO: 240311 - protein, 11 aa, Japanese encephalitis virus
WLHRGPIEFCI

SEQ ID NO: 240312 - protein, 11 aa, Japanese encephalitis virus
LHRGPIEFCIK

SEQ ID NO: 240313 - protein, 11 aa, Japanese encephalitis virus
HRGPIEFCIKV

SEQ ID NO: 240314 - protein, 11 aa, Japanese encephalitis virus
RGPIEFCIKVL

SEQ ID NO: 240315 - protein, 11 aa, Japanese encephalitis virus
GPIEFCIKVLC

SEQ ID NO: 240316 - protein, 11 aa, Japanese encephalitis virus
PIEFCIKVLCP

SEQ ID NO: 240317 - protein, 11 aa, Japanese encephalitis virus
IEFCIKVLCPY

SEQ ID NO: 240318 - protein, 11 aa, Japanese encephalitis virus
CPYMPKVIEKN

SEQ ID NO: 240319 - protein, 11 aa, Japanese encephalitis virus
PYMPKVIEKIE

SEQ ID NO: 240320 - protein, 11 aa, Japanese encephalitis virus
YMPKVIEKIEV

SEQ ID NO: 240321 - protein, 11 aa, Japanese encephalitis virus
MPKVIEKNEVL

SEQ ID NO: 240322 - protein, 11 aa, Japanese encephalitis virus
PKVIEKNEVLQ

SEQ ID NO: 240323 - protein, 11 aa, Japanese encephalitis virus
KVIEKNEVLQR

SEQ ID NO: 240324 - protein, 11 aa, Japanese encephalitis virus
VIEKIEVLQRR

SEQ ID NO: 240325 - protein, 11 aa, Japanese encephalitis virus
IEKIEVLQRRF

SEQ ID NO: 240326 - protein, 11 aa, Japanese encephalitis virus
EKNEVLQRRFG

SEQ ID NO: 240327 - protein, 11 aa, Japanese encephalitis virus
KIEVLQRRFGG

SEQ ID NO: 240328 - protein, 11 aa, Japanese encephalitis virus
NEVLQRRFGGG

SEQ ID NO: 240329 - protein, 11 aa, Japanese encephalitis virus
EVLQRRFGGGV

SEQ ID NO: 240330 - protein, 11 aa, Japanese encephalitis virus
VLQRRFGGGVV

SEQ ID NO: 240331 - protein, 11 aa, Japanese encephalitis virus
LQRRFGGGVVR

SEQ ID NO: 240332 - protein, 11 aa, Japanese encephalitis virus
QRRFGGGVVRL

SEQ ID NO: 240333 - protein, 11 aa, Japanese encephalitis virus
RRFGGGVVRLP

SEQ ID NO: 240334 - protein, 11 aa, Japanese encephalitis virus
RFGGGVVRLPL

SEQ ID NO: 240335 - protein, 11 aa, Japanese encephalitis virus
FGGGVVRLPLS

SEQ ID NO: 240336 - protein, 11 aa, Japanese encephalitis virus
GGGVVRLPLSR

SEQ ID NO: 240337 - protein, 11 aa, Japanese encephalitis virus
GGVVRLPLSRN

SEQ ID NO: 240338 - protein, 11 aa, Japanese encephalitis virus
GVVRLPLSRNS

SEQ ID NO: 240339 - protein, 11 aa, Japanese encephalitis virus
VVRLPLSRNSN

SEQ ID NO: 240340 - protein, 11 aa, Japanese encephalitis virus
SNHEMYWVSGP

SEQ ID NO: 240341 - protein, 11 aa, Japanese encephalitis virus
NHEMYWVSGPA

SEQ ID NO: 240342 - protein, 11 aa, Japanese encephalitis virus
HEMYWVSGPAG

SEQ ID NO: 240343 - protein, 11 aa, Japanese encephalitis virus
EMYWVSGPAGN

SEQ ID NO: 240344 - protein, 11 aa, Japanese encephalitis virus
MYWVSGPAGNV

SEQ ID NO: 240345 - protein, 11 aa, Japanese encephalitis virus
YWVSGPAGNVV

SEQ ID NO: 240346 - protein, 11 aa, Japanese encephalitis virus
WVSGPAGNVVH

SEQ ID NO: 240347 - protein, 11 aa, Japanese encephalitis virus
VSGPAGNVVHA

SEQ ID NO: 240348 - protein, 11 aa, Japanese encephalitis virus
SGPAGNVVHAV

SEQ ID NO: 240349 - protein, 11 aa, Japanese encephalitis virus
GPAGNVVHAVN

SEQ ID NO: 240350 - protein, 11 aa, Japanese encephalitis virus
PAGNVVHAVNM

SEQ ID NO: 240351 - protein, 11 aa, Japanese encephalitis virus
MTSQVLLGRMN

SEQ ID NO: 240352 - protein, 11 aa, Japanese encephalitis virus
TSQVLLGRMNR

SEQ ID NO: 240353 - protein, 11 aa, Japanese encephalitis virus
SQVLLGRMDRA

SEQ ID NO: 240354 - protein, 11 aa, Japanese encephalitis virus
QVLLGRMNRTV

SEQ ID NO: 240355 - protein, 11 aa, Japanese encephalitis virus
VLLGRMDRAVW

SEQ ID NO: 240356 - protein, 11 aa, Japanese encephalitis virus
LLGRMNRTVWR

SEQ ID NO: 240357 - protein, 11 aa, Japanese encephalitis virus
LGRMNRTVWRG

SEQ ID NO: 240358 - protein, 11 aa, Japanese encephalitis virus
GRMDRAVWRGP

SEQ ID NO: 240359 - protein, 11 aa, Japanese encephalitis virus
RMDRAVWRGPK

SEQ ID NO: 240360 - protein, 11 aa, Japanese encephalitis virus
MNRTVWRGPKY

SEQ ID NO: 240361 - protein, 11 aa, Japanese encephalitis virus
DRTVWRGPKYK

SEQ ID NO: 240362 - protein, 11 aa, Japanese encephalitis virus
RTVWRGPRYEE

SEQ ID NO: 240363 - protein, 11 aa, Japanese encephalitis virus
AVWRGPKYEED

SEQ ID NO: 240364 - protein, 11 aa, Japanese encephalitis virus
VWRGPKYKEDV

SEQ ID NO: 240365 - protein, 11 aa, Japanese encephalitis virus
WRGPRYEEDVN

SEQ ID NO: 240366 - protein, 11 aa, Japanese encephalitis virus
RGPRYEEDVNL

SEQ ID NO: 240367 - protein, 11 aa, Japanese encephalitis virus
GPKYKEDVNLG

SEQ ID NO: 240368 - protein, 11 aa, Japanese encephalitis virus
PRYEEDVNLGS

SEQ ID NO: 240369 - protein, 11 aa, Japanese encephalitis virus
KYKEDVNLGSG

SEQ ID NO: 240370 - protein, 11 aa, Japanese encephalitis virus
YKEDVNLGSGT

SEQ ID NO: 240371 - protein, 11 aa, Japanese encephalitis virus
KEDVNLGSGTR

SEQ ID NO: 240372 - protein, 11 aa, Japanese encephalitis virus
SGTRAVGKGEI

SEQ ID NO: 240373 - protein, 11 aa, Japanese encephalitis virus
GTRAVGKGEIH

SEQ ID NO: 240374 - protein, 11 aa, Japanese encephalitis virus
TRAVGKGEIHS

SEQ ID NO: 240375 - protein, 11 aa, Japanese encephalitis virus
RAVGKGEIHSN

SEQ ID NO: 240376 - protein, 11 aa, Japanese encephalitis virus
AVGKGEIHSNQ

SEQ ID NO: 240377 - protein, 11 aa, Japanese encephalitis virus
KIRKRIQKLRE

SEQ ID NO: 240378 - protein, 11 aa, Japanese encephalitis virus
KRIQKLREEFA

SEQ ID NO: 240379 - protein, 11 aa, Japanese encephalitis virus
RIQKLREEFAT

SEQ ID NO: 240380 - protein, 11 aa, Japanese encephalitis virus
IQKLREEFATT

SEQ ID NO: 240381 - protein, 11 aa, Japanese encephalitis virus
QKLREEFATTW

SEQ ID NO: 240382 - protein, 11 aa, Japanese encephalitis virus
KLREEFATTWH

SEQ ID NO: 240383 - protein, 11 aa, Japanese encephalitis virus
REEFATTWHKD

SEQ ID NO: 240384 - protein, 11 aa, Japanese encephalitis virus
EEFATTWHRDP

SEQ ID NO: 240385 - protein, 11 aa, Japanese encephalitis virus
EFATTWHRDPE

SEQ ID NO: 240386 - protein, 11 aa, Japanese encephalitis virus
FATTWHRDPEH

SEQ ID NO: 240387 - protein, 11 aa, Japanese encephalitis virus
GTTWHKDPEHP

SEQ ID NO: 240388 - protein, 11 aa, Japanese encephalitis virus
TTWHRDPEHPY

SEQ ID NO: 240389 - protein, 11 aa, Japanese encephalitis virus
TWHRDPEHPYR

SEQ ID NO: 240390 - protein, 11 aa, Japanese encephalitis virus
WHKDHEHPYRT

SEQ ID NO: 240391 - protein, 11 aa, Japanese encephalitis virus
HKDPEHPYRNW

SEQ ID NO: 240392 - protein, 11 aa, Japanese encephalitis virus
KDPEHPYRNWT

SEQ ID NO: 240393 - protein, 11 aa, Japanese encephalitis virus
DHEHPYRTWTY

SEQ ID NO: 240394 - protein, 11 aa, Japanese encephalitis virus
HEHPYRTWTYH

SEQ ID NO: 240395 - protein, 11 aa, Japanese encephalitis virus
EHPYRNWTYHG

SEQ ID NO: 240396 - protein, 11 aa, Japanese encephalitis virus
HPYRNWTYHGS

SEQ ID NO: 240397 - protein, 11 aa, Japanese encephalitis virus
PYRNWTYHGSY

SEQ ID NO: 240398 - protein, 11 aa, Japanese encephalitis virus
YRNWTYHGSYE

SEQ ID NO: 240399 - protein, 11 aa, Japanese encephalitis virus
RNWTYHGSYEV

SEQ ID NO: 240400 - protein, 11 aa, Japanese encephalitis virus
NWTYHGSYEVK

SEQ ID NO: 240401 - protein, 11 aa, Japanese encephalitis virus
WTYHGSYEVRA

SEQ ID NO: 240402 - protein, 11 aa, Japanese encephalitis virus
TYHGSYEVRAT

SEQ ID NO: 240403 - protein, 11 aa, Japanese encephalitis virus
YHGSYEVKANG

SEQ ID NO: 240404 - protein, 11 aa, Japanese encephalitis virus
HGSYEVRATGS

SEQ ID NO: 240405 - protein, 11 aa, Japanese encephalitis virus
GSYEVRATGSA

SEQ ID NO: 240406 - protein, 11 aa, Japanese encephalitis virus
SYEVRATGSAS

SEQ ID NO: 240407 - protein, 11 aa, Japanese encephalitis virus
YEVKANGSASS

SEQ ID NO: 240408 - protein, 11 aa, Japanese encephalitis virus
EVKANGSASSL

SEQ ID NO: 240409 - protein, 11 aa, Japanese encephalitis virus
VKANGSASSLV

SEQ ID NO: 240410 - protein, 11 aa, Japanese encephalitis virus
RATGSASSLVN

SEQ ID NO: 240411 - protein, 11 aa, Japanese encephalitis virus
ANGSASSLVNG

SEQ ID NO: 240412 - protein, 11 aa, Japanese encephalitis virus
NGSASSLVNGV

SEQ ID NO: 240413 - protein, 11 aa, Japanese encephalitis virus
SASSLVNGVVE

SEQ ID NO: 240414 - protein, 11 aa, Japanese encephalitis virus
ASSLVNGVVEL

SEQ ID NO: 240415 - protein, 11 aa, Japanese encephalitis virus
SSLVNGVVELM

SEQ ID NO: 240416 - protein, 11 aa, Japanese encephalitis virus
SLVNGVVELMS

SEQ ID NO: 240417 - protein, 11 aa, Japanese encephalitis virus
LVNGVVELMSK

SEQ ID NO: 240418 - protein, 11 aa, Japanese encephalitis virus
VNGVVELMSKP

SEQ ID NO: 240419 - protein, 11 aa, Japanese encephalitis virus
NGVVELMSKPW

SEQ ID NO: 240420 - protein, 11 aa, Japanese encephalitis virus
GVVELMSKPWD

SEQ ID NO: 240421 - protein, 11 aa, Japanese encephalitis virus
VVELMSKPWDA

SEQ ID NO: 240422 - protein, 11 aa, Japanese encephalitis virus
VELMSKPWDAI

SEQ ID NO: 240423 - protein, 11 aa, Japanese encephalitis virus
ELMSKPWDAIA

SEQ ID NO: 240424 - protein, 11 aa, Japanese encephalitis virus
LMSKPWDAISY

SEQ ID NO: 240425 - protein, 11 aa, Japanese encephalitis virus
MSKPWDAISYV

SEQ ID NO: 240426 - protein, 11 aa, Japanese encephalitis virus
SKPWDAISYVT

SEQ ID NO: 240427 - protein, 11 aa, Japanese encephalitis virus
KPWDTIANVTT

SEQ ID NO: 240428 - protein, 11 aa, Japanese encephalitis virus
PWDTIANVTTM

SEQ ID NO: 240429 - protein, 11 aa, Japanese encephalitis virus
WDTIANVTTMA

SEQ ID NO: 240430 - protein, 11 aa, Japanese encephalitis virus
DTIANVTTMAM

SEQ ID NO: 240431 - protein, 11 aa, Japanese encephalitis virus
TIANVTTMAMT

SEQ ID NO: 240432 - protein, 11 aa, Japanese encephalitis virus
ISYVTTMPMTD

SEQ ID NO: 240433 - protein, 11 aa, Japanese encephalitis virus
SYVTTMPMTDT

SEQ ID NO: 240434 - protein, 11 aa, Japanese encephalitis virus
YVTTMPMTDTT

SEQ ID NO: 240435 - protein, 11 aa, Japanese encephalitis virus
VTTMPMTDTTP

SEQ ID NO: 240436 - protein, 11 aa, Japanese encephalitis virus
TTMPMTDTTPF

SEQ ID NO: 240437 - protein, 11 aa, Japanese encephalitis virus
TMPMTDTTPFG

SEQ ID NO: 240438 - protein, 11 aa, Japanese encephalitis virus
MPMTDTTPFGQ

SEQ ID NO: 240439 - protein, 11 aa, Japanese encephalitis virus
PMTDTTPFGQQ

SEQ ID NO: 240440 - protein, 11 aa, Japanese encephalitis virus
GQQRVFKEKVG

SEQ ID NO: 240441 - protein, 11 aa, Japanese encephalitis virus
QQRVFKEKVGT

SEQ ID NO: 240442 - protein, 11 aa, Japanese encephalitis virus
QRVFKEKVGTM

SEQ ID NO: 240443 - protein, 11 aa, Japanese encephalitis virus
RVFKEKVGTMA

SEQ ID NO: 240444 - protein, 11 aa, Japanese encephalitis virus
VFKEKVGTKAP

SEQ ID NO: 240445 - protein, 11 aa, Japanese encephalitis virus
FKEKVGTKAPE

SEQ ID NO: 240446 - protein, 11 aa, Japanese encephalitis virus
KEKVGTKAPEP

SEQ ID NO: 240447 - protein, 11 aa, Japanese encephalitis virus
EKVGTKAPEPP

SEQ ID NO: 240448 - protein, 11 aa, Japanese encephalitis virus
GVKEVLNETTN

SEQ ID NO: 240449 - protein, 11 aa, Japanese encephalitis virus
VKEVLNETTNW

SEQ ID NO: 240450 - protein, 11 aa, Japanese encephalitis virus
REVLNETTNWL

SEQ ID NO: 240451 - protein, 11 aa, Japanese encephalitis virus
LNETTNWLWAY

SEQ ID NO: 240452 - protein, 11 aa, Japanese encephalitis virus
NETTNWLWAYL

SEQ ID NO: 240453 - protein, 11 aa, Japanese encephalitis virus
ETTNWLWAYLS

SEQ ID NO: 240454 - protein, 11 aa, Japanese encephalitis virus
TTNWLWAYLSR

SEQ ID NO: 240455 - protein, 11 aa, Japanese encephalitis virus
TNWLWAYLSRE

SEQ ID NO: 240456 - protein, 11 aa, Japanese encephalitis virus
NWLWAYLSREK

SEQ ID NO: 240457 - protein, 11 aa, Japanese encephalitis virus
WLWAYLSREKR

SEQ ID NO: 240458 - protein, 11 aa, Japanese encephalitis virus
LWAYLSREKRP

SEQ ID NO: 240459 - protein, 11 aa, Japanese encephalitis virus
WAYLSREKRPR

SEQ ID NO: 240460 - protein, 11 aa, Japanese encephalitis virus
AYLSREKRPRL

SEQ ID NO: 240461 - protein, 11 aa, Japanese encephalitis virus
YLSREKRPRLC

SEQ ID NO: 240462 - protein, 11 aa, Japanese encephalitis virus
LSRKKRPRLCT

SEQ ID NO: 240463 - protein, 11 aa, Japanese encephalitis virus
SRKKRPRLCTK

SEQ ID NO: 240464 - protein, 11 aa, Japanese encephalitis virus
RKKRPRLCTKE

SEQ ID NO: 240465 - protein, 11 aa, Japanese encephalitis virus
KKRPRLCTKEE

SEQ ID NO: 240466 - protein, 11 aa, Japanese encephalitis virus
PRLCTKEEFIR

SEQ ID NO: 240467 - protein, 11 aa, Japanese encephalitis virus
RLCTKEEFIRK

SEQ ID NO: 240468 - protein, 11 aa, Japanese encephalitis virus
LCTKEEFIRKV

SEQ ID NO: 240469 - protein, 11 aa, Japanese encephalitis virus
CTKEEFIRKVN

SEQ ID NO: 240470 - protein, 11 aa, Japanese encephalitis virus
TKEEFIRKVNS

SEQ ID NO: 240471 - protein, 11 aa, Japanese encephalitis virus
KEEFIRKVNSN

SEQ ID NO: 240472 - protein, 11 aa, Japanese encephalitis virus
EEFIRKVNSNA

SEQ ID NO: 240473 - protein, 11 aa, Japanese encephalitis virus
KVNSNASLGTV

SEQ ID NO: 240474 - protein, 11 aa, Japanese encephalitis virus
VNSNASLGAVF

SEQ ID NO: 240475 - protein, 11 aa, Japanese encephalitis virus
NSNASLGTVFA

SEQ ID NO: 240476 - protein, 11 aa, Japanese encephalitis virus
SDAALGAVFAE

SEQ ID NO: 240477 - protein, 11 aa, Japanese encephalitis virus
NASLGAVFAEQ

SEQ ID NO: 240478 - protein, 11 aa, Japanese encephalitis virus
ASLGTVFAEQN

SEQ ID NO: 240479 - protein, 11 aa, Japanese encephalitis virus
SLGTVFAEQNQ

SEQ ID NO: 240480 - protein, 11 aa, Japanese encephalitis virus
LGTVFAEQNQW

SEQ ID NO: 240481 - protein, 11 aa, Japanese encephalitis virus
GTVFAEQNQWS

SEQ ID NO: 240482 - protein, 11 aa, Japanese encephalitis virus
TVFAEQNQWST

SEQ ID NO: 240483 - protein, 11 aa, Japanese encephalitis virus
NQWSTAREAVG

SEQ ID NO: 240484 - protein, 11 aa, Japanese encephalitis virus
QWSTAREAVGD

SEQ ID NO: 240485 - protein, 11 aa, Japanese encephalitis virus
WSTAREAVGDP

SEQ ID NO: 240486 - protein, 11 aa, Japanese encephalitis virus
FWEMVNEEREN

SEQ ID NO: 240487 - protein, 11 aa, Japanese encephalitis virus
WEMVNEERENH

SEQ ID NO: 240488 - protein, 11 aa, Japanese encephalitis virus
EMVNEERENHL

SEQ ID NO: 240489 - protein, 11 aa, Japanese encephalitis virus
MVNEERENHLR

SEQ ID NO: 240490 - protein, 11 aa, Japanese encephalitis virus
VNEERENHLRG

SEQ ID NO: 240491 - protein, 11 aa, Japanese encephalitis virus
NEERENHLRGE

SEQ ID NO: 240492 - protein, 11 aa, Japanese encephalitis virus
VERENHLRGEC

SEQ ID NO: 240493 - protein, 11 aa, Japanese encephalitis virus
ENHLRGECHTR

SEQ ID NO: 240494 - protein, 11 aa, Japanese encephalitis virus
NHLRGECHTCV

SEQ ID NO: 240495 - protein, 11 aa, Japanese encephalitis virus
HLRGECHTCVY

SEQ ID NO: 240496 - protein, 11 aa, Japanese encephalitis virus
LRGECHTCVYN

SEQ ID NO: 240497 - protein, 11 aa, Japanese encephalitis virus
RGECHTCVYNM

SEQ ID NO: 240498 - protein, 11 aa, Japanese encephalitis virus
GECHTCVYNMM

SEQ ID NO: 240499 - protein, 11 aa, Japanese encephalitis virus
ECHTCVYNMMG

SEQ ID NO: 240500 - protein, 11 aa, Japanese encephalitis virus
CHTCVYNMMGK

SEQ ID NO: 240501 - protein, 11 aa, Japanese encephalitis virus
HTCVYNMMGKR

SEQ ID NO: 240502 - protein, 11 aa, Japanese encephalitis virus
TCVYNMMGKRE

SEQ ID NO: 240503 - protein, 11 aa, Japanese encephalitis virus
CVYNMMGKREK

SEQ ID NO: 240504 - protein, 11 aa, Japanese encephalitis virus
VYNMMGKREKK

SEQ ID NO: 240505 - protein, 11 aa, Japanese encephalitis virus
YHMMGKREKKP

SEQ ID NO: 240506 - protein, 11 aa, Japanese encephalitis virus
HMMGKREKKPG

SEQ ID NO: 240507 - protein, 11 aa, Japanese encephalitis virus
ARYLEFEALGS

SEQ ID NO: 240508 - protein, 11 aa, Japanese encephalitis virus
RYLEFEALGSL

SEQ ID NO: 240509 - protein, 11 aa, Japanese encephalitis virus
YLEFEALGSLN

SEQ ID NO: 240510 - protein, 11 aa, Japanese encephalitis virus
LEFEALGFLNL

SEQ ID NO: 240511 - protein, 11 aa, Japanese encephalitis virus
EFEALGFLNLD

SEQ ID NO: 240512 - protein, 11 aa, Japanese encephalitis virus
FEALGSLNEDH

SEQ ID NO: 240513 - protein, 11 aa, Japanese encephalitis virus
EALGFLNLDHW

SEQ ID NO: 240514 - protein, 11 aa, Japanese encephalitis virus
ALGFLNLDHWL

SEQ ID NO: 240515 - protein, 11 aa, Japanese encephalitis virus
LGSLNEDHWLS

SEQ ID NO: 240516 - protein, 11 aa, Japanese encephalitis virus
GFLNLDHWLSR

SEQ ID NO: 240517 - protein, 11 aa, Japanese encephalitis virus
FLNENHWLSRE

SEQ ID NO: 240518 - protein, 11 aa, Japanese encephalitis virus
LNLDHWLSREN

SEQ ID NO: 240519 - protein, 11 aa, Japanese encephalitis virus
NLDHWLSRENS

SEQ ID NO: 240520 - protein, 11 aa, Japanese encephalitis virus
LDHWLSRENSR

SEQ ID NO: 240521 - protein, 11 aa, Japanese encephalitis virus
DHWLSRENSRG

SEQ ID NO: 240522 - protein, 11 aa, Japanese encephalitis virus
HWLSRRNSGGG

SEQ ID NO: 240523 - protein, 11 aa, Japanese encephalitis virus
WLSRENSGGGE

SEQ ID NO: 240524 - protein, 11 aa, Japanese encephalitis virus
LSRENSGGGEE

SEQ ID NO: 240525 - protein, 11 aa, Japanese encephalitis virus
SRENSGGGEEG

SEQ ID NO: 240526 - protein, 11 aa, Japanese encephalitis virus
RRNSGGGVEGS

SEQ ID NO: 240527 - protein, 11 aa, Japanese encephalitis virus
NSGGGVEGSSV

SEQ ID NO: 240528 - protein, 11 aa, Japanese encephalitis virus
SGGGVEGSSVQ

SEQ ID NO: 240529 - protein, 11 aa, Japanese encephalitis virus
RGGVEGSSVQK

SEQ ID NO: 240530 - protein, 11 aa, Japanese encephalitis virus
GGVEGSSVQKL

SEQ ID NO: 240531 - protein, 11 aa, Japanese encephalitis virus
GVEGSSVQKLG

SEQ ID NO: 240532 - protein, 11 aa, Japanese encephalitis virus
VEGSSVQKLGY

SEQ ID NO: 240533 - protein, 11 aa, Japanese encephalitis virus
EGSSVQKLGYI

SEQ ID NO: 240534 - protein, 11 aa, Japanese encephalitis virus
SVQKLGYILRD

SEQ ID NO: 240535 - protein, 11 aa, Japanese encephalitis virus
VQKLGYIFRDI

SEQ ID NO: 240536 - protein, 11 aa, Japanese encephalitis virus
QKLGYISGDIT

SEQ ID NO: 240537 - protein, 11 aa, Japanese encephalitis virus
RDIARKEGGKM

SEQ ID NO: 240538 - protein, 11 aa, Japanese encephalitis virus
DIAVKQGGKMY

SEQ ID NO: 240539 - protein, 11 aa, Japanese encephalitis virus
IARKEGGKMYA

SEQ ID NO: 240540 - protein, 11 aa, Japanese encephalitis virus
ARKEGGKMYAD

SEQ ID NO: 240541 - protein, 11 aa, Japanese encephalitis virus
VKQGGKMYADD

SEQ ID NO: 240542 - protein, 11 aa, Japanese encephalitis virus
KEGGKMYADDT

SEQ ID NO: 240543 - protein, 11 aa, Japanese encephalitis virus
QGGKMYADDPA

SEQ ID NO: 240544 - protein, 11 aa, Japanese encephalitis virus
GGKMYADDPAG

SEQ ID NO: 240545 - protein, 11 aa, Japanese encephalitis virus
GKMYADDPAGW

SEQ ID NO: 240546 - protein, 11 aa, Japanese encephalitis virus
KMYADDPAGWD

SEQ ID NO: 240547 - protein, 11 aa, Japanese encephalitis virus
MYADDPAGWDT

SEQ ID NO: 240548 - protein, 11 aa, Japanese encephalitis virus
YADDPAGWDTR

SEQ ID NO: 240549 - protein, 11 aa, Japanese encephalitis virus
ADDPAGWDTRI

SEQ ID NO: 240550 - protein, 11 aa, Japanese encephalitis virus
DDPAGWDTRIT

SEQ ID NO: 240551 - protein, 11 aa, Japanese encephalitis virus
DPAGWDTRITR

SEQ ID NO: 240552 - protein, 11 aa, Japanese encephalitis virus
TAGWDTRITRA

SEQ ID NO: 240553 - protein, 11 aa, Japanese encephalitis virus
AGWDTRITRAD

SEQ ID NO: 240554 - protein, 11 aa, Japanese encephalitis virus
GWDTRITRADL

SEQ ID NO: 240555 - protein, 11 aa, Japanese encephalitis virus
WDTRITRADLE

SEQ ID NO: 240556 - protein, 11 aa, Japanese encephalitis virus
DTRITRADLEN

SEQ ID NO: 240557 - protein, 11 aa, Japanese encephalitis virus
TRITRADLENE

SEQ ID NO: 240558 - protein, 11 aa, Japanese encephalitis virus
RITRADLENEA

SEQ ID NO: 240559 - protein, 11 aa, Japanese encephalitis virus
ITRADLENEAK

SEQ ID NO: 240560 - protein, 11 aa, Japanese encephalitis virus
TRADLENEAKV

SEQ ID NO: 240561 - protein, 11 aa, Japanese encephalitis virus
RADLENEAKVL

SEQ ID NO: 240562 - protein, 11 aa, Japanese encephalitis virus
ADLENEAKVLE

SEQ ID NO: 240563 - protein, 11 aa, Japanese encephalitis virus
VLELLDGEHRK

SEQ ID NO: 240564 - protein, 11 aa, Japanese encephalitis virus
LELLDGEHRKL

SEQ ID NO: 240565 - protein, 11 aa, Japanese encephalitis virus
ELLDGEHRKLA

SEQ ID NO: 240566 - protein, 11 aa, Japanese encephalitis virus
LLDGEHRKLAR

SEQ ID NO: 240567 - protein, 11 aa, Japanese encephalitis virus
LDGEHRKLARA

SEQ ID NO: 240568 - protein, 11 aa, Japanese encephalitis virus
DGEHRKLARAI

SEQ ID NO: 240569 - protein, 11 aa, Japanese encephalitis virus
GEHRKLARAII

SEQ ID NO: 240570 - protein, 11 aa, Japanese encephalitis virus
EHRKLARAIIE

SEQ ID NO: 240571 - protein, 11 aa, Japanese encephalitis virus
HRKLARAIIEL

SEQ ID NO: 240572 - protein, 11 aa, Japanese encephalitis virus
RKLARAIIELT

SEQ ID NO: 240573 - protein, 11 aa, Japanese encephalitis virus
KLARAIIELTY

SEQ ID NO: 240574 - protein, 11 aa, Japanese encephalitis virus
LARAIIELTYK

SEQ ID NO: 240575 - protein, 11 aa, Japanese encephalitis virus
ARAIIELTYKH

SEQ ID NO: 240576 - protein, 11 aa, Japanese encephalitis virus
RAIIELTYRHQ

SEQ ID NO: 240577 - protein, 11 aa, Japanese encephalitis virus
AIIELTYKHKV

SEQ ID NO: 240578 - protein, 11 aa, Japanese encephalitis virus
IIELTYRHQVF

SEQ ID NO: 240579 - protein, 11 aa, Japanese encephalitis virus
IELTYRHQVFK

SEQ ID NO: 240580 - protein, 11 aa, Japanese encephalitis virus
ELTYKHKVVKV

SEQ ID NO: 240581 - protein, 11 aa, Japanese encephalitis virus
LTYRHQVFKVM

SEQ ID NO: 240582 - protein, 11 aa, Japanese encephalitis virus
TYRHQVFKVMR

SEQ ID NO: 240583 - protein, 11 aa, Japanese encephalitis virus
YRHQVFKVMRP

SEQ ID NO: 240584 - protein, 11 aa, Japanese encephalitis virus
KHKVVKVMRPS

SEQ ID NO: 240585 - protein, 11 aa, Japanese encephalitis virus
HQVFKVMRPAA

SEQ ID NO: 240586 - protein, 11 aa, Japanese encephalitis virus
KVMRPAAGGKT

SEQ ID NO: 240587 - protein, 11 aa, Japanese encephalitis virus
VMRPAAGGKTV

SEQ ID NO: 240588 - protein, 11 aa, Japanese encephalitis virus
MRPAAGGKTVM

SEQ ID NO: 240589 - protein, 11 aa, Japanese encephalitis virus
GGKTVMDVISR

SEQ ID NO: 240590 - protein, 11 aa, Japanese encephalitis virus
GKTVMVVYSRE

SEQ ID NO: 240591 - protein, 11 aa, Japanese encephalitis virus
KTGMAVISREN

SEQ ID NO: 240592 - protein, 11 aa, Japanese encephalitis virus
TGMAVISRENQ

SEQ ID NO: 240593 - protein, 11 aa, Japanese encephalitis virus
GMAVISRENQR

SEQ ID NO: 240594 - protein, 11 aa, Japanese encephalitis virus
MVVYSREDQRG

SEQ ID NO: 240595 - protein, 11 aa, Japanese encephalitis virus
AVISRENQRGS

SEQ ID NO: 240596 - protein, 11 aa, Japanese encephalitis virus
VISRENQRGSG

SEQ ID NO: 240597 - protein, 11 aa, Japanese encephalitis virus
YSREDQRGSGQ

SEQ ID NO: 240598 - protein, 11 aa, Japanese encephalitis virus
SRENQRGSGQV

SEQ ID NO: 240599 - protein, 11 aa, Japanese encephalitis virus
RENQRGSGQVV

SEQ ID NO: 240600 - protein, 11 aa, Japanese encephalitis virus
ENQRGSGQVVT

SEQ ID NO: 240601 - protein, 11 aa, Japanese encephalitis virus
NQRGSGQVVTY

SEQ ID NO: 240602 - protein, 11 aa, Japanese encephalitis virus
LNTFTNIAVQF

SEQ ID NO: 240603 - protein, 11 aa, Japanese encephalitis virus
NTFTNIAVQFV

SEQ ID NO: 240604 - protein, 11 aa, Japanese encephalitis virus
TFTNIAVQFVR

SEQ ID NO: 240605 - protein, 11 aa, Japanese encephalitis virus
FTNIAVQFVRL

SEQ ID NO: 240606 - protein, 11 aa, Japanese encephalitis virus
TNIAVQLVRLV

SEQ ID NO: 240607 - protein, 11 aa, Japanese encephalitis virus
NIAVQFVRLMK

SEQ ID NO: 240608 - protein, 11 aa, Japanese encephalitis virus
IAVQFVRLMKV

SEQ ID NO: 240609 - protein, 11 aa, Japanese encephalitis virus
AVQLVRLVEAE

SEQ ID NO: 240610 - protein, 11 aa, Japanese encephalitis virus
VQFVRLMKVEG

SEQ ID NO: 240611 - protein, 11 aa, Japanese encephalitis virus
QLVRLVEAEGV

SEQ ID NO: 240612 - protein, 11 aa, Japanese encephalitis virus
LVRLVEAEGVI

SEQ ID NO: 240613 - protein, 11 aa, Japanese encephalitis virus
VRLMKVEGVIG

SEQ ID NO: 240614 - protein, 11 aa, Japanese encephalitis virus
RLMKVEGVIGP

SEQ ID NO: 240615 - protein, 11 aa, Japanese encephalitis virus
LMKVEGVIGPQ

SEQ ID NO: 240616 - protein, 11 aa, Japanese encephalitis virus
MKVEGVIGPQH

SEQ ID NO: 240617 - protein, 11 aa, Japanese encephalitis virus
KVEGVIGPQHL

SEQ ID NO: 240618 - protein, 11 aa, Japanese encephalitis virus
VEGVIGPQHLE

SEQ ID NO: 240619 - protein, 11 aa, Japanese encephalitis virus
EGVIGPQHLEH

SEQ ID NO: 240620 - protein, 11 aa, Japanese encephalitis virus
GVIGPQHVEQL

SEQ ID NO: 240621 - protein, 11 aa, Japanese encephalitis virus
VIGPQHLEHLP

SEQ ID NO: 240622 - protein, 11 aa, Japanese encephalitis virus
IGPQHVEQLPR

SEQ ID NO: 240623 - protein, 11 aa, Japanese encephalitis virus
GPQHLEHLPRK

SEQ ID NO: 240624 - protein, 11 aa, Japanese encephalitis virus
EQLPRKTKIAV

SEQ ID NO: 240625 - protein, 11 aa, Japanese encephalitis virus
QLPRKTKIAVR

SEQ ID NO: 240626 - protein, 11 aa, Japanese encephalitis virus
LPRKTKIAVRT

SEQ ID NO: 240627 - protein, 11 aa, Japanese encephalitis virus
PRKTKIAVRTW

SEQ ID NO: 240628 - protein, 11 aa, Japanese encephalitis virus
RKTKIAVRTWL

SEQ ID NO: 240629 - protein, 11 aa, Japanese encephalitis virus
KTKIAVRTWLF

SEQ ID NO: 240630 - protein, 11 aa, Japanese encephalitis virus
TKIAVRTWLFE

SEQ ID NO: 240631 - protein, 11 aa, Japanese encephalitis virus
AVRTWLFENGG

SEQ ID NO: 240632 - protein, 11 aa, Japanese encephalitis virus
VRTWLFENGGE

SEQ ID NO: 240633 - protein, 11 aa, Japanese encephalitis virus
RTWLFENGGER

SEQ ID NO: 240634 - protein, 11 aa, Japanese encephalitis virus
TWLFENGGERV

SEQ ID NO: 240635 - protein, 11 aa, Japanese encephalitis virus
WLFENGEERVS

SEQ ID NO: 240636 - protein, 11 aa, Japanese encephalitis virus
LFENGEERVSR

SEQ ID NO: 240637 - protein, 11 aa, Japanese encephalitis virus
FENGEERVSRM

SEQ ID NO: 240638 - protein, 11 aa, Japanese encephalitis virus
ENGEERVSRMA

SEQ ID NO: 240639 - protein, 11 aa, Japanese encephalitis virus
NGEERVSRMAI

SEQ ID NO: 240640 - protein, 11 aa, Japanese encephalitis virus
GEERVSRMAIS

SEQ ID NO: 240641 - protein, 11 aa, Japanese encephalitis virus
EERVSRMAISG

SEQ ID NO: 240642 - protein, 11 aa, Japanese encephalitis virus
ERVSRMAISGD

SEQ ID NO: 240643 - protein, 11 aa, Japanese encephalitis virus
RVSRMAISGDD

SEQ ID NO: 240644 - protein, 11 aa, Japanese encephalitis virus
VSRMAISGDDC

SEQ ID NO: 240645 - protein, 11 aa, Japanese encephalitis virus
SRMAISGDDCV

SEQ ID NO: 240646 - protein, 11 aa, Japanese encephalitis virus
RMAISGDDCAV

SEQ ID NO: 240647 - protein, 11 aa, Japanese encephalitis virus
MAISGDDCAVK

SEQ ID NO: 240648 - protein, 11 aa, Japanese encephalitis virus
AISGDDCAVKP

SEQ ID NO: 240649 - protein, 11 aa, Japanese encephalitis virus
ISGDDCAVKPL

SEQ ID NO: 240650 - protein, 11 aa, Japanese encephalitis virus
SGDDCAVKPLD

SEQ ID NO: 240651 - protein, 11 aa, Japanese encephalitis virus
GDDCAVKPLDD

SEQ ID NO: 240652 - protein, 11 aa, Japanese encephalitis virus
DDCAVKPLDDR

SEQ ID NO: 240653 - protein, 11 aa, Japanese encephalitis virus
DCAVKPLDDRF

SEQ ID NO: 240654 - protein, 11 aa, Japanese encephalitis virus
CAVKPLDDRFA

SEQ ID NO: 240655 - protein, 11 aa, Japanese encephalitis virus
AVKPLDDRFAT

SEQ ID NO: 240656 - protein, 11 aa, Japanese encephalitis virus
VKPLDDRFATS

SEQ ID NO: 240657 - protein, 11 aa, Japanese encephalitis virus
KPLDDRFATSL

SEQ ID NO: 240658 - protein, 11 aa, Japanese encephalitis virus
PLDDRFATALY

SEQ ID NO: 240659 - protein, 11 aa, Japanese encephalitis virus
LDDRFATALYF

SEQ ID NO: 240660 - protein, 11 aa, Japanese encephalitis virus
DDRFATALYFL

SEQ ID NO: 240661 - protein, 11 aa, Japanese encephalitis virus
DRFATSLHFLN

SEQ ID NO: 240662 - protein, 11 aa, Japanese encephalitis virus
RFATSLHFLNA

SEQ ID NO: 240663 - protein, 11 aa, Japanese encephalitis virus
FATSLHFLNAM

SEQ ID NO: 240664 - protein, 11 aa, Japanese encephalitis virus
ATSLHFLNAMS

SEQ ID NO: 240665 - protein, 11 aa, Japanese encephalitis virus
TALYFLNAMSK

SEQ ID NO: 240666 - protein, 11 aa, Japanese encephalitis virus
SLHFLNAMSKV

SEQ ID NO: 240667 - protein, 11 aa, Japanese encephalitis virus
LYFLNAMSKVR

SEQ ID NO: 240668 - protein, 11 aa, Japanese encephalitis virus
HFLNAMSKVRR

SEQ ID NO: 240669 - protein, 11 aa, Japanese encephalitis virus
FLNAMSKVTKD

SEQ ID NO: 240670 - protein, 11 aa, Japanese encephalitis virus
LNAMSKVRRDI

SEQ ID NO: 240671 - protein, 11 aa, Japanese encephalitis virus
NAMSKVRKDIL

SEQ ID NO: 240672 - protein, 11 aa, Japanese encephalitis virus
AMSKVTKDIQQ

SEQ ID NO: 240673 - protein, 11 aa, Japanese encephalitis virus
MSKVRRDIQEW

SEQ ID NO: 240674 - protein, 11 aa, Japanese encephalitis virus
SKVTKDIQQWK

SEQ ID NO: 240675 - protein, 11 aa, Japanese encephalitis virus
KVTKDIQQWKP

SEQ ID NO: 240676 - protein, 11 aa, Japanese encephalitis virus
VRKDILEWKPS

SEQ ID NO: 240677 - protein, 11 aa, Japanese encephalitis virus
TKDIQQWKPSH

SEQ ID NO: 240678 - protein, 11 aa, Japanese encephalitis virus
RDIQEWKPSHG

SEQ ID NO: 240679 - protein, 11 aa, Japanese encephalitis virus
DILEWKPSHGW

SEQ ID NO: 240680 - protein, 11 aa, Japanese encephalitis virus
IQQWKPSHGWH

SEQ ID NO: 240681 - protein, 11 aa, Japanese encephalitis virus
QQWKPSHGWHD

SEQ ID NO: 240682 - protein, 11 aa, Japanese encephalitis virus
EWKPSHGWLDW

SEQ ID NO: 240683 - protein, 11 aa, Japanese encephalitis virus
WKPSHGWHDWL

SEQ ID NO: 240684 - protein, 11 aa, Japanese encephalitis virus
KPSHGWLDWQQ

SEQ ID NO: 240685 - protein, 11 aa, Japanese encephalitis virus
PSHGWHDWLHV

SEQ ID NO: 240686 - protein, 11 aa, Japanese encephalitis virus
SHGWHDWLHVP

SEQ ID NO: 240687 - protein, 11 aa, Japanese encephalitis virus
HGWHDWLHVPF

SEQ ID NO: 240688 - protein, 11 aa, Japanese encephalitis virus
GWLDWQQVPFC

SEQ ID NO: 240689 - protein, 11 aa, Japanese encephalitis virus
WLDWQQVPFCS

SEQ ID NO: 240690 - protein, 11 aa, Japanese encephalitis virus
HDWLHVPFCSN

SEQ ID NO: 240691 - protein, 11 aa, Japanese encephalitis virus
DWLHVPFCSNH

SEQ ID NO: 240692 - protein, 11 aa, Japanese encephalitis virus
WLHVPFCSNHF

SEQ ID NO: 240693 - protein, 11 aa, Japanese encephalitis virus
LHVPFCSNHFH

SEQ ID NO: 240694 - protein, 11 aa, Japanese encephalitis virus
HVPFCSNHFHE

SEQ ID NO: 240695 - protein, 11 aa, Japanese encephalitis virus
VPFCSNHFHEI

SEQ ID NO: 240696 - protein, 11 aa, Japanese encephalitis virus
PFCSNHFHEIV

SEQ ID NO: 240697 - protein, 11 aa, Japanese encephalitis virus
FCSNHFHEIVM

SEQ ID NO: 240698 - protein, 11 aa, Japanese encephalitis virus
CSNHFHEIVMK

SEQ ID NO: 240699 - protein, 11 aa, Japanese encephalitis virus
SNHFHEIVMKD

SEQ ID NO: 240700 - protein, 11 aa, Japanese encephalitis virus
NHFHEIVMKDG

SEQ ID NO: 240701 - protein, 11 aa, Japanese encephalitis virus
HFHEIVMKDGR

SEQ ID NO: 240702 - protein, 11 aa, Japanese encephalitis virus
FHEIVMKDGRS

SEQ ID NO: 240703 - protein, 11 aa, Japanese encephalitis virus
HEIVMKDGRSL

SEQ ID NO: 240704 - protein, 11 aa, Japanese encephalitis virus
EIVMKDGRSLL

SEQ ID NO: 240705 - protein, 11 aa, Japanese encephalitis virus
IVMKDGRSLLV

SEQ ID NO: 240706 - protein, 11 aa, Japanese encephalitis virus
VMKDGRSLLVP

SEQ ID NO: 240707 - protein, 11 aa, Japanese encephalitis virus
MKDGRSLLVPC

SEQ ID NO: 240708 - protein, 11 aa, Japanese encephalitis virus
KDGRSIVDPCR

SEQ ID NO: 240709 - protein, 11 aa, Japanese encephalitis virus
DGRSIVDPCRG

SEQ ID NO: 240710 - protein, 11 aa, Japanese encephalitis virus
GRSIVDPCRGQ

SEQ ID NO: 240711 - protein, 11 aa, Japanese encephalitis virus
RSIVDPCRGQD

SEQ ID NO: 240712 - protein, 11 aa, Japanese encephalitis virus
SLLVPCRGQDE

SEQ ID NO: 240713 - protein, 11 aa, Japanese encephalitis virus
LLVPCRGQDEL

SEQ ID NO: 240714 - protein, 11 aa, Japanese encephalitis virus
VDPCRGQDELI

SEQ ID NO: 240715 - protein, 11 aa, Japanese encephalitis virus
VPCRGQDELID

SEQ ID NO: 240716 - protein, 11 aa, Japanese encephalitis virus
PCRGQDELIDR

SEQ ID NO: 240717 - protein, 11 aa, Japanese encephalitis virus
CRGQDELIDRA

SEQ ID NO: 240718 - protein, 11 aa, Japanese encephalitis virus
RGQDELIDRAR

SEQ ID NO: 240719 - protein, 11 aa, Japanese encephalitis virus
GQDELIDRARI

SEQ ID NO: 240720 - protein, 11 aa, Japanese encephalitis virus
QDELIDRARIS

SEQ ID NO: 240721 - protein, 11 aa, Japanese encephalitis virus
DELIDRARISP

SEQ ID NO: 240722 - protein, 11 aa, Japanese encephalitis virus
ELIDRARISPG

SEQ ID NO: 240723 - protein, 11 aa, Japanese encephalitis virus
LIDRARISPGA

SEQ ID NO: 240724 - protein, 11 aa, Japanese encephalitis virus
IDRARISPGAG

SEQ ID NO: 240725 - protein, 11 aa, Japanese encephalitis virus
GRARISPGAGC

SEQ ID NO: 240726 - protein, 11 aa, Japanese encephalitis virus
RARISPGAGCN

SEQ ID NO: 240727 - protein, 11 aa, Japanese encephalitis virus
ARISPGAGCNV

SEQ ID NO: 240728 - protein, 11 aa, Japanese encephalitis virus
RISPGAGCNVK

SEQ ID NO: 240729 - protein, 11 aa, Japanese encephalitis virus
ISPGAGCNVKD

SEQ ID NO: 240730 - protein, 11 aa, Japanese encephalitis virus
SPGAGCNVKDT

SEQ ID NO: 240731 - protein, 11 aa, Japanese encephalitis virus
PGAGCNVKDTA

SEQ ID NO: 240732 - protein, 11 aa, Japanese encephalitis virus
GAGCNVKDTAC

SEQ ID NO: 240733 - protein, 11 aa, Japanese encephalitis virus
AGCNVKDTACL

SEQ ID NO: 240734 - protein, 11 aa, Japanese encephalitis virus
GCNVKDTACLA

SEQ ID NO: 240735 - protein, 11 aa, Japanese encephalitis virus
CNVKDTACLAK

SEQ ID NO: 240736 - protein, 11 aa, Japanese encephalitis virus
NVKDTACLPKA

SEQ ID NO: 240737 - protein, 11 aa, Japanese encephalitis virus
VKDTACLPKAY

SEQ ID NO: 240738 - protein, 11 aa, Japanese encephalitis virus
MDTACLAKAYA

SEQ ID NO: 240739 - protein, 11 aa, Japanese encephalitis virus
DTACLPKAYAQ

SEQ ID NO: 240740 - protein, 11 aa, Japanese encephalitis virus
TACLPKAYAQM

SEQ ID NO: 240741 - protein, 11 aa, Japanese encephalitis virus
ACLAKAYAQMR

SEQ ID NO: 240742 - protein, 11 aa, Japanese encephalitis virus
CLAKAYAQMRL

SEQ ID NO: 240743 - protein, 11 aa, Japanese encephalitis virus
LAKAYAQMRLL

SEQ ID NO: 240744 - protein, 11 aa, Japanese encephalitis virus
AKAYAQMRLLL

SEQ ID NO: 240745 - protein, 11 aa, Japanese encephalitis virus
KAYAQMRLLLY

SEQ ID NO: 240746 - protein, 11 aa, Japanese encephalitis virus
AYAQMRLLLYF

SEQ ID NO: 240747 - protein, 11 aa, Japanese encephalitis virus
YAQMRLLLYFH

SEQ ID NO: 240748 - protein, 11 aa, Japanese encephalitis virus
AQMRLLLYFHR

SEQ ID NO: 240749 - protein, 11 aa, Japanese encephalitis virus
QMRLLLYFHRR

SEQ ID NO: 240750 - protein, 11 aa, Japanese encephalitis virus
MRLLLYFHRRD

SEQ ID NO: 240751 - protein, 11 aa, Japanese encephalitis virus
WLLLYFHRRYL

SEQ ID NO: 240752 - protein, 11 aa, Japanese encephalitis virus
LLLYFHRRYLR

SEQ ID NO: 240753 - protein, 11 aa, Japanese encephalitis virus
LLYFHRRYLRL

SEQ ID NO: 240754 - protein, 11 aa, Japanese encephalitis virus
LYFHRRYLRLM

SEQ ID NO: 240755 - protein, 11 aa, Japanese encephalitis virus
YFHRRYLRLMA

SEQ ID NO: 240756 - protein, 11 aa, Japanese encephalitis virus
FHRRYLRLMAN

SEQ ID NO: 240757 - protein, 11 aa, Japanese encephalitis virus
HRRYLRLMANA

SEQ ID NO: 240758 - protein, 11 aa, Japanese encephalitis virus
RRYLRLMANAI

SEQ ID NO: 240759 - protein, 11 aa, Japanese encephalitis virus
RYLRLMANAIC

SEQ ID NO: 240760 - protein, 11 aa, Japanese encephalitis virus
YLRLMANAICS

SEQ ID NO: 240761 - protein, 11 aa, Japanese encephalitis virus
QRLMANAICSA

SEQ ID NO: 240762 - protein, 11 aa, Japanese encephalitis virus
CLMANAICSAV

SEQ ID NO: 240763 - protein, 11 aa, Japanese encephalitis virus
LMANAICSTVP

SEQ ID NO: 240764 - protein, 11 aa, Japanese encephalitis virus
MANAICSTVPV

SEQ ID NO: 240765 - protein, 11 aa, Japanese encephalitis virus
ANAICSTVPVD

SEQ ID NO: 240766 - protein, 11 aa, Japanese encephalitis virus
NAICSAVPVNW

SEQ ID NO: 240767 - protein, 11 aa, Japanese encephalitis virus
AICSAVPVNWV

SEQ ID NO: 240768 - protein, 11 aa, Japanese encephalitis virus
ICSAVPVNWVP

SEQ ID NO: 240769 - protein, 11 aa, Japanese encephalitis virus
CSTVPVDWVPT

SEQ ID NO: 240770 - protein, 11 aa, Japanese encephalitis virus
STVPVDWVPTG

SEQ ID NO: 240771 - protein, 11 aa, Japanese encephalitis virus
AVPLDWVPTGR

SEQ ID NO: 240772 - protein, 11 aa, Japanese encephalitis virus
VPLDWVPTGRT

SEQ ID NO: 240773 - protein, 11 aa, Japanese encephalitis virus
PVNWVPTGRTS

SEQ ID NO: 240774 - protein, 11 aa, Japanese encephalitis virus
VNWVPTGRTSW

SEQ ID NO: 240775 - protein, 11 aa, Japanese encephalitis virus
NWVPTGRTSWS

SEQ ID NO: 240776 - protein, 11 aa, Japanese encephalitis virus
WVPTGRTSWSK

SEQ ID NO: 240777 - protein, 11 aa, Japanese encephalitis virus
VPTGRTSWSKH

SEQ ID NO: 240778 - protein, 11 aa, Japanese encephalitis virus
PTGRTSWSKHS

SEQ ID NO: 240779 - protein, 11 aa, Japanese encephalitis virus
TGRTSWSKHSK

SEQ ID NO: 240780 - protein, 11 aa, Japanese encephalitis virus
GRTSWSKHSKG

SEQ ID NO: 240781 - protein, 11 aa, Japanese encephalitis virus
RTSWSKHSKGE

SEQ ID NO: 240782 - protein, 11 aa, Japanese encephalitis virus
TSWSKHSKGEW

SEQ ID NO: 240783 - protein, 11 aa, Japanese encephalitis virus
SWSKHSKGEWM

SEQ ID NO: 240784 - protein, 11 aa, Japanese encephalitis virus
WSKHSKGEWMT

SEQ ID NO: 240785 - protein, 11 aa, Japanese encephalitis virus
SKHSKGEWMTT

SEQ ID NO: 240786 - protein, 11 aa, Japanese encephalitis virus
KHSKGEWMTTE

SEQ ID NO: 240787 - protein, 11 aa, Japanese encephalitis virus
HSKGEWMTTEN

SEQ ID NO: 240788 - protein, 11 aa, Japanese encephalitis virus
SKGEWMTTENM

SEQ ID NO: 240789 - protein, 11 aa, Japanese encephalitis virus
KGEWMTTENML

SEQ ID NO: 240790 - protein, 11 aa, Japanese encephalitis virus
GEWMTTENMLQ

SEQ ID NO: 240791 - protein, 11 aa, Japanese encephalitis virus
EWMTTENMLQV

SEQ ID NO: 240792 - protein, 11 aa, Japanese encephalitis virus
WMTTENMLQVW

SEQ ID NO: 240793 - protein, 11 aa, Japanese encephalitis virus
MTTENMLQVWN

SEQ ID NO: 240794 - protein, 11 aa, Japanese encephalitis virus
TTENMLQVWNK

SEQ ID NO: 240795 - protein, 11 aa, Japanese encephalitis virus
TENMLQVWNKV

SEQ ID NO: 240796 - protein, 11 aa, Japanese encephalitis virus
ENMLQVWNKVW

SEQ ID NO: 240797 - protein, 11 aa, Japanese encephalitis virus
NMLQVWNKVWI

SEQ ID NO: 240798 - protein, 11 aa, Japanese encephalitis virus
MLQVWNKVWIE

SEQ ID NO: 240799 - protein, 11 aa, Japanese encephalitis virus
LQVWNKVWIEE

SEQ ID NO: 240800 - protein, 11 aa, Japanese encephalitis virus
QVWNKVWIEEN

SEQ ID NO: 240801 - protein, 11 aa, Japanese encephalitis virus
VWNKVWIEENE

SEQ ID NO: 240802 - protein, 11 aa, Japanese encephalitis virus
WNKVWIEENEW

SEQ ID NO: 240803 - protein, 11 aa, Japanese encephalitis virus
NKVWIEENEWM

SEQ ID NO: 240804 - protein, 11 aa, Japanese encephalitis virus
KVWIEENEWMM

SEQ ID NO: 240805 - protein, 11 aa, Japanese encephalitis virus
VWIEENEWMVD

SEQ ID NO: 240806 - protein, 11 aa, Japanese encephalitis virus
WIEENEWMVDK

SEQ ID NO: 240807 - protein, 11 aa, Japanese encephalitis virus
IEENEWMVDKT

SEQ ID NO: 240808 - protein, 11 aa, Japanese encephalitis virus
EENEWMVDKTP

SEQ ID NO: 240809 - protein, 11 aa, Japanese encephalitis virus
DKTPVTSWTDV

SEQ ID NO: 240810 - protein, 11 aa, Japanese encephalitis virus
KTPVTSWTDVP

SEQ ID NO: 240811 - protein, 11 aa, Japanese encephalitis virus
TPVTSWTDVPY

SEQ ID NO: 240812 - protein, 11 aa, Japanese encephalitis virus
PVTSWTDVPYV

SEQ ID NO: 240813 - protein, 11 aa, Japanese encephalitis virus
VTSWTDVPYVG

SEQ ID NO: 240814 - protein, 11 aa, Japanese encephalitis virus
ASWTDVPYVGK

SEQ ID NO: 240815 - protein, 11 aa, Japanese encephalitis virus
VGKREDIWCGN

SEQ ID NO: 240816 - protein, 11 aa, Japanese encephalitis virus
GKREDIWCGNL

SEQ ID NO: 240817 - protein, 11 aa, Japanese encephalitis virus
KREDIWCGNLI

SEQ ID NO: 240818 - protein, 11 aa, Japanese encephalitis virus
REDIWCGNLIG

SEQ ID NO: 240819 - protein, 11 aa, Japanese encephalitis virus
EDIWCGNLIGT

SEQ ID NO: 240820 - protein, 11 aa, Japanese encephalitis virus
DIWCGNLIGTR

SEQ ID NO: 240821 - protein, 11 aa, Japanese encephalitis virus
IWCGSLIGTRT

SEQ ID NO: 240822 - protein, 11 aa, Japanese encephalitis virus
WCGSLIGTRTR

SEQ ID NO: 240823 - protein, 11 aa, Japanese encephalitis virus
CGSLIGTRTRA

SEQ ID NO: 240824 - protein, 11 aa, Japanese encephalitis virus
GSLIGTRTRAT

SEQ ID NO: 240825 - protein, 11 aa, Japanese encephalitis virus
SLIGTRTRATW

SEQ ID NO: 240826 - protein, 11 aa, Japanese encephalitis virus
LIGTRTRATWA

SEQ ID NO: 240827 - protein, 11 aa, Japanese encephalitis virus
IGTRTRATWAE

SEQ ID NO: 240828 - protein, 11 aa, Japanese encephalitis virus
GTRTRATWAEN

SEQ ID NO: 240829 - protein, 11 aa, Japanese encephalitis virus
TRTRATWAENI

SEQ ID NO: 240830 - protein, 11 aa, Japanese encephalitis virus
RTRATWAENIY

SEQ ID NO: 240831 - protein, 11 aa, Japanese encephalitis virus
TRATWAENIYA

SEQ ID NO: 240832 - protein, 11 aa, Japanese encephalitis virus
KATWAENIYAA

SEQ ID NO: 240833 - protein, 11 aa, Japanese encephalitis virus
ATWAENVYAAI

SEQ ID NO: 240834 - protein, 11 aa, Japanese encephalitis virus
TWAENVYAAIN

SEQ ID NO: 240835 - protein, 11 aa, Japanese encephalitis virus
WAENVYAAINQ

SEQ ID NO: 240836 - protein, 11 aa, Japanese encephalitis virus
AENVYAAINQV

SEQ ID NO: 240837 - protein, 11 aa, Japanese encephalitis virus
ENVYAAINQVR

SEQ ID NO: 240838 - protein, 11 aa, Japanese encephalitis virus
NVYAAINQVRA

SEQ ID NO: 240839 - protein, 11 aa, Japanese encephalitis virus
IYAAINQVRAI

SEQ ID NO: 240840 - protein, 11 aa, Japanese encephalitis virus
YAAINQVRAII

SEQ ID NO: 240841 - protein, 11 aa, Japanese encephalitis virus
AAINQVRAIIG

SEQ ID NO: 240842 - protein, 11 aa, Japanese encephalitis virus
AINQVRAIIGK

SEQ ID NO: 240843 - protein, 11 aa, Japanese encephalitis virus
INQVRAIIGKE

SEQ ID NO: 240844 - protein, 11 aa, Japanese encephalitis virus
NQVRAIIGKEN

SEQ ID NO: 240845 - protein, 11 aa, Japanese encephalitis virus
QVRAIIGKENY

SEQ ID NO: 240846 - protein, 11 aa, Japanese encephalitis virus
VRAIIGKENYV

SEQ ID NO: 240847 - protein, 11 aa, Japanese encephalitis virus
RAIIGKENYVD

SEQ ID NO: 240848 - protein, 11 aa, Japanese encephalitis virus
AIIGKENYVDY

SEQ ID NO: 240849 - protein, 11 aa, Japanese encephalitis virus
IIGKENYVDYM

SEQ ID NO: 240850 - protein, 11 aa, Japanese encephalitis virus
IGKEDYVDYMT

SEQ ID NO: 240851 - protein, 11 aa, Japanese encephalitis virus
GKETYVDYMTS

SEQ ID NO: 240852 - protein, 11 aa, Japanese encephalitis virus
KENYVDYMDFP

SEQ ID NO: 240853 - protein, 11 aa, Japanese encephalitis virus
ENYVDYMLSLR

SEQ ID NO: 240854 - protein, 11 aa, Japanese encephalitis virus
TYVDYMTSLRR

SEQ ID NO: 240855 - protein, 11 aa, Japanese encephalitis virus
YVDYMDFPQRI

SEQ ID NO: 240856 - protein, 11 aa, Japanese encephalitis virus
VDYMDFPQRIE

SEQ ID NO: 240857 - protein, 11 aa, Japanese encephalitis virus
DYMLSLRRYED

SEQ ID NO: 240858 - protein, 11 aa, Japanese encephalitis virus
YMLSLRRYEDV

SEQ ID NO: 240859 - protein, 11 aa, Japanese encephalitis virus
MLSLRRYEDVL

SEQ ID NO: 240860 - protein, 11 aa, Japanese encephalitis virus
SLRRYEDVLVQ

SEQ ID NO: 240861 - protein, 11 aa, Japanese encephalitis virus
LRRYEDVLVQE

SEQ ID NO: 240862 - protein, 11 aa, Japanese encephalitis virus
RRYEDVLVQED

SEQ ID NO: 240863 - protein, 11 aa, Japanese encephalitis virus
RYEDVLVQEDR

SEQ ID NO: 240864 - protein, 11 aa, Japanese encephalitis virus
YEDVLVQEDRV

SEQ ID NO: 240865 - protein, 11 aa, Japanese encephalitis virus
EDVLVQEDRVI

SEQ ID NO: 240866 - protein, 11 aa, Japanese encephalitis virus
MTKKPRGPGIN

SEQ ID NO: 240867 - protein, 11 aa, Japanese encephalitis virus
TKKPRGPGINR

SEQ ID NO: 240868 - protein, 11 aa, Japanese encephalitis virus
KKPRGPGINRA

SEQ ID NO: 240869 - protein, 11 aa, Japanese encephalitis virus
KPRGPGINRAI

SEQ ID NO: 240870 - protein, 11 aa, Japanese encephalitis virus
PRGPGINRAIY

SEQ ID NO: 240871 - protein, 11 aa, Japanese encephalitis virus
RGPGINRAIYM

SEQ ID NO: 240872 - protein, 11 aa, Japanese encephalitis virus
GPGKSRAINML

SEQ ID NO: 240873 - protein, 11 aa, Japanese encephalitis virus
PGKSRAINMLK

SEQ ID NO: 240874 - protein, 11 aa, Japanese encephalitis virus
GKSRAINMLKR

SEQ ID NO: 240875 - protein, 11 aa, Japanese encephalitis virus
KSRAINMLKRG

SEQ ID NO: 240876 - protein, 11 aa, Japanese encephalitis virus
SRAINMLKRGL

SEQ ID NO: 240877 - protein, 11 aa, Japanese encephalitis virus
PRVFPLVRVKR

SEQ ID NO: 240878 - protein, 11 aa, Japanese encephalitis virus
RVFPLVGVKKV

SEQ ID NO: 240879 - protein, 11 aa, Japanese encephalitis virus
VFPLVRVKRVV

SEQ ID NO: 240880 - protein, 11 aa, Japanese encephalitis virus
FPLVGVKKVVM

SEQ ID NO: 240881 - protein, 11 aa, Japanese encephalitis virus
PLVGVKKVVMS

SEQ ID NO: 240882 - protein, 11 aa, Japanese encephalitis virus
LVRVKRVVMSL

SEQ ID NO: 240883 - protein, 11 aa, Japanese encephalitis virus
VGVKRVVISLL

SEQ ID NO: 240884 - protein, 11 aa, Japanese encephalitis virus
RVKRVVMSLLD

SEQ ID NO: 240885 - protein, 11 aa, Japanese encephalitis virus
VKKVVMSLLDG

SEQ ID NO: 240886 - protein, 11 aa, Japanese encephalitis virus
KKVVMSLLDGR

SEQ ID NO: 240887 - protein, 11 aa, Japanese encephalitis virus
RVVISLLDGIG

SEQ ID NO: 240888 - protein, 11 aa, Japanese encephalitis virus
VISLLDGIGPL

SEQ ID NO: 240889 - protein, 11 aa, Japanese encephalitis virus
ISLLDGIGPLR

SEQ ID NO: 240890 - protein, 11 aa, Japanese encephalitis virus
SLLDGIGPLRF

SEQ ID NO: 240891 - protein, 11 aa, Japanese encephalitis virus
LLDGIGPLRFV

SEQ ID NO: 240892 - protein, 11 aa, Japanese encephalitis virus
LDGIGPLRFVL

SEQ ID NO: 240893 - protein, 11 aa, Japanese encephalitis virus
DGIGPLRFVLA

SEQ ID NO: 240894 - protein, 11 aa, Japanese encephalitis virus
GRGPVRFVLAF

SEQ ID NO: 240895 - protein, 11 aa, Japanese encephalitis virus
RGPARFVLALI

SEQ ID NO: 240896 - protein, 11 aa, Japanese encephalitis virus
GPVRFVLALTT

SEQ ID NO: 240897 - protein, 11 aa, Japanese encephalitis virus
PARFVLALITF

SEQ ID NO: 240898 - protein, 11 aa, Japanese encephalitis virus
ARFVLALITFF

SEQ ID NO: 240899 - protein, 11 aa, Japanese encephalitis virus
RFVLAFITFFK

SEQ ID NO: 240900 - protein, 11 aa, Japanese encephalitis virus
FVLALVSFFKF

SEQ ID NO: 240901 - protein, 11 aa, Japanese encephalitis virus
VLAFITFFKFT

SEQ ID NO: 240902 - protein, 11 aa, Japanese encephalitis virus
LAFITFFKFTA

SEQ ID NO: 240903 - protein, 11 aa, Japanese encephalitis virus
AFITFFKFTAL

SEQ ID NO: 240904 - protein, 11 aa, Japanese encephalitis virus
LVSFFKFTALS

SEQ ID NO: 240905 - protein, 11 aa, Japanese encephalitis virus
VSFFKFTALSP

SEQ ID NO: 240906 - protein, 11 aa, Japanese encephalitis virus
FTALSPTKALL

SEQ ID NO: 240907 - protein, 11 aa, Japanese encephalitis virus
TALSPTKALLG

SEQ ID NO: 240908 - protein, 11 aa, Japanese encephalitis virus
ALSPTKALLGR

SEQ ID NO: 240909 - protein, 11 aa, Japanese encephalitis virus
LSPTKALLGRW

SEQ ID NO: 240910 - protein, 11 aa, Japanese encephalitis virus
APTKALSGRWK

SEQ ID NO: 240911 - protein, 11 aa, Japanese encephalitis virus
PTKALSGRWKA

SEQ ID NO: 240912 - protein, 11 aa, Japanese encephalitis virus
TKALSGRWKAV

SEQ ID NO: 240913 - protein, 11 aa, Japanese encephalitis virus
KALSGRWKAVE

SEQ ID NO: 240914 - protein, 11 aa, Japanese encephalitis virus
ALSGRWKAVEK

SEQ ID NO: 240915 - protein, 11 aa, Japanese encephalitis virus
LSGRWKAVEKS

SEQ ID NO: 240916 - protein, 11 aa, Japanese encephalitis virus
SGRWKAVEKSV

SEQ ID NO: 240917 - protein, 11 aa, Japanese encephalitis virus
GRWRALEKSVA

SEQ ID NO: 240918 - protein, 11 aa, Japanese encephalitis virus
RWKAVERSVAM

SEQ ID NO: 240919 - protein, 11 aa, Japanese encephalitis virus
WRALEKSVAMK

SEQ ID NO: 240920 - protein, 11 aa, Japanese encephalitis virus
KAVERSVAMKH

SEQ ID NO: 240921 - protein, 11 aa, Japanese encephalitis virus
AVERSVAMKHL

SEQ ID NO: 240922 - protein, 11 aa, Japanese encephalitis virus
VERSVAMKHLT

SEQ ID NO: 240923 - protein, 11 aa, Japanese encephalitis virus
HLTSFKRELGI

SEQ ID NO: 240924 - protein, 11 aa, Japanese encephalitis virus
LTSFKRELGIL

SEQ ID NO: 240925 - protein, 11 aa, Japanese encephalitis virus
TSFKGELGTLI

SEQ ID NO: 240926 - protein, 11 aa, Japanese encephalitis virus
SFKGELGTLID

SEQ ID NO: 240927 - protein, 11 aa, Japanese encephalitis virus
FKGELGTLIDG

SEQ ID NO: 240928 - protein, 11 aa, Japanese encephalitis virus
KGELGTLIDGV

SEQ ID NO: 240929 - protein, 11 aa, Japanese encephalitis virus
RELGTLIDVVN

SEQ ID NO: 240930 - protein, 11 aa, Japanese encephalitis virus
ELGTLIDGVNK

SEQ ID NO: 240931 - protein, 11 aa, Japanese encephalitis virus
LGTLIDGVNKR

SEQ ID NO: 240932 - protein, 11 aa, Japanese encephalitis virus
GTLIDGVNKRG

SEQ ID NO: 240933 - protein, 11 aa, Japanese encephalitis virus
LIDTVNKRGRK

SEQ ID NO: 240934 - protein, 11 aa, Japanese encephalitis virus
VNKRGRKRNKR

SEQ ID NO: 240935 - protein, 11 aa, Japanese encephalitis virus
NKRGRKRNKRG

SEQ ID NO: 240936 - protein, 11 aa, Japanese encephalitis virus
KRGRKRNKRGG

SEQ ID NO: 240937 - protein, 11 aa, Japanese encephalitis virus
RGRKRNKRGGN

SEQ ID NO: 240938 - protein, 11 aa, Japanese encephalitis virus
GRKRNKRGGNE

SEQ ID NO: 240939 - protein, 11 aa, Japanese encephalitis virus
AGAMRLSNFQG

SEQ ID NO: 240940 - protein, 11 aa, Japanese encephalitis virus
GAIKLSNFQGK

SEQ ID NO: 240941 - protein, 11 aa, Japanese encephalitis virus
AIKLSNFQGKL

SEQ ID NO: 240942 - protein, 11 aa, Japanese encephalitis virus
IKLSNFQGKLL

SEQ ID NO: 240943 - protein, 11 aa, Japanese encephalitis virus
SNFQGKLLMAV

SEQ ID NO: 240944 - protein, 11 aa, Japanese encephalitis virus
NFQGKLLMAVN

SEQ ID NO: 240945 - protein, 11 aa, Japanese encephalitis virus
FQGKLLMAVNN

SEQ ID NO: 240946 - protein, 11 aa, Japanese encephalitis virus
QGKLLMAVNNT

SEQ ID NO: 240947 - protein, 11 aa, Japanese encephalitis virus
GKLLMAVNNTD

SEQ ID NO: 240948 - protein, 11 aa, Japanese encephalitis virus
KLLMAVNNTDI

SEQ ID NO: 240949 - protein, 11 aa, Japanese encephalitis virus
LLMAVNNTDIA

SEQ ID NO: 240950 - protein, 11 aa, Japanese encephalitis virus
LMAVNNTDIAD

SEQ ID NO: 240951 - protein, 11 aa, Japanese encephalitis virus
MAVNNTDIADV

SEQ ID NO: 240952 - protein, 11 aa, Japanese encephalitis virus
AVNNTDIADVI

SEQ ID NO: 240953 - protein, 11 aa, Japanese encephalitis virus
CWVRAIDVGYL

SEQ ID NO: 240954 - protein, 11 aa, Japanese encephalitis virus
WVRAIDVGYLC

SEQ ID NO: 240955 - protein, 11 aa, Japanese encephalitis virus
VRAIDVGYLCE

SEQ ID NO: 240956 - protein, 11 aa, Japanese encephalitis virus
RAIDVGYLCED

SEQ ID NO: 240957 - protein, 11 aa, Japanese encephalitis virus
AIDVGHMCEDT

SEQ ID NO: 240958 - protein, 11 aa, Japanese encephalitis virus
IDVGYLCEDTI

SEQ ID NO: 240959 - protein, 11 aa, Japanese encephalitis virus
DVGYLCEDTIT

SEQ ID NO: 240960 - protein, 11 aa, Japanese encephalitis virus
VGYLCEDTITY

SEQ ID NO: 240961 - protein, 11 aa, Japanese encephalitis virus
GHMCEDTITYE

SEQ ID NO: 240962 - protein, 11 aa, Japanese encephalitis virus
YLCEDTITYEC

SEQ ID NO: 240963 - protein, 11 aa, Japanese encephalitis virus
AGNDPEDVDCW

SEQ ID NO: 240964 - protein, 11 aa, Japanese encephalitis virus
QDVDCWCDHQE

SEQ ID NO: 240965 - protein, 11 aa, Japanese encephalitis virus
DVDCWCDHQEV

SEQ ID NO: 240966 - protein, 11 aa, Japanese encephalitis virus
VDCWCDHQEVY

SEQ ID NO: 240967 - protein, 11 aa, Japanese encephalitis virus
DCWCDHQEVYV

SEQ ID NO: 240968 - protein, 11 aa, Japanese encephalitis virus
CWCDHQEVYVQ

SEQ ID NO: 240969 - protein, 11 aa, Japanese encephalitis virus
WCDNQEVYIQY

SEQ ID NO: 240970 - protein, 11 aa, Japanese encephalitis virus
CDHQEVYVQYG

SEQ ID NO: 240971 - protein, 11 aa, Japanese encephalitis virus
DNQEVYIQYGR

SEQ ID NO: 240972 - protein, 11 aa, Japanese encephalitis virus
HQEVYVQYGRC

SEQ ID NO: 240973 - protein, 11 aa, Japanese encephalitis virus
QEVYIQYGRCT

SEQ ID NO: 240974 - protein, 11 aa, Japanese encephalitis virus
EVYIQYGRCTR

SEQ ID NO: 240975 - protein, 11 aa, Japanese encephalitis virus
VYIQYGRCTRT

SEQ ID NO: 240976 - protein, 11 aa, Japanese encephalitis virus
YVQYGRCTRTS

SEQ ID NO: 240977 - protein, 11 aa, Japanese encephalitis virus
VQYGRCTRTSH

SEQ ID NO: 240978 - protein, 11 aa, Japanese encephalitis virus
QYGRCTRTSHS

SEQ ID NO: 240979 - protein, 11 aa, Japanese encephalitis virus
YGRCTRTSHSQ

SEQ ID NO: 240980 - protein, 11 aa, Japanese encephalitis virus
GRCTRTSHSQT

SEQ ID NO: 240981 - protein, 11 aa, Japanese encephalitis virus
PCTRTRHSKRS

SEQ ID NO: 240982 - protein, 11 aa, Japanese encephalitis virus
CTRTSHSQTSR

SEQ ID NO: 240983 - protein, 11 aa, Japanese encephalitis virus
TRTRHSKRSKR

SEQ ID NO: 240984 - protein, 11 aa, Japanese encephalitis virus
RTRHSKRSKRS

SEQ ID NO: 240985 - protein, 11 aa, Japanese encephalitis virus
TRHSKRSKRSV

SEQ ID NO: 240986 - protein, 11 aa, Japanese encephalitis virus
SHSQTSRRSVS

SEQ ID NO: 240987 - protein, 11 aa, Japanese encephalitis virus
HSQTSRRSVSV

SEQ ID NO: 240988 - protein, 11 aa, Japanese encephalitis virus
SKRSKRSVSVQ

SEQ ID NO: 240989 - protein, 11 aa, Japanese encephalitis virus
KRSKRSVSVQT

SEQ ID NO: 240990 - protein, 11 aa, Japanese encephalitis virus
RSRRSVSVQPN

SEQ ID NO: 240991 - protein, 11 aa, Japanese encephalitis virus
SKRSVSVQTHG

SEQ ID NO: 240992 - protein, 11 aa, Japanese encephalitis virus
RRSVSVHTHGE

SEQ ID NO: 240993 - protein, 11 aa, Japanese encephalitis virus
RSVSVQPNGER

SEQ ID NO: 240994 - protein, 11 aa, Japanese encephalitis virus
SVSVHTHGESS

SEQ ID NO: 240995 - protein, 11 aa, Japanese encephalitis virus
VSVQPNGERSL

SEQ ID NO: 240996 - protein, 11 aa, Japanese encephalitis virus
SVHTHGESSLV

SEQ ID NO: 240997 - protein, 11 aa, Japanese encephalitis virus
VHTHGESSLVN

SEQ ID NO: 240998 - protein, 11 aa, Japanese encephalitis virus
HTHGESSLVNK

SEQ ID NO: 240999 - protein, 11 aa, Japanese encephalitis virus
THGESSLENKK

SEQ ID NO: 241000 - protein, 11 aa, Japanese encephalitis virus
HGESSLVNKKK

SEQ ID NO: 241001 - protein, 11 aa, Japanese encephalitis virus
GERSLVNKKEA

SEQ ID NO: 241002 - protein, 11 aa, Japanese encephalitis virus
ERSLVNKKEAW

SEQ ID NO: 241003 - protein, 11 aa, Japanese encephalitis virus
RSLVNKKEAWL

SEQ ID NO: 241004 - protein, 11 aa, Japanese encephalitis virus
SLENKKEAWLD

SEQ ID NO: 241005 - protein, 11 aa, Japanese encephalitis virus
LENKKEAWLDS

SEQ ID NO: 241006 - protein, 11 aa, Japanese encephalitis virus
VNKKEAWLNST

SEQ ID NO: 241007 - protein, 11 aa, Japanese encephalitis virus
NKKKAWLDSTR

SEQ ID NO: 241008 - protein, 11 aa, Japanese encephalitis virus
KKKAWLDSTRA

SEQ ID NO: 241009 - protein, 11 aa, Japanese encephalitis virus
KKAWLDSTRAT

SEQ ID NO: 241010 - protein, 11 aa, Japanese encephalitis virus
KAWLDSTRATR

SEQ ID NO: 241011 - protein, 11 aa, Japanese encephalitis virus
AWLNSTKATRY

SEQ ID NO: 241012 - protein, 11 aa, Japanese encephalitis virus
WLNSTKATRYL

SEQ ID NO: 241013 - protein, 11 aa, Japanese encephalitis virus
LDSTRATRYLM

SEQ ID NO: 241014 - protein, 11 aa, Japanese encephalitis virus
DSTRATRYLMK

SEQ ID NO: 241015 - protein, 11 aa, Japanese encephalitis virus
STRATRYLMKT

SEQ ID NO: 241016 - protein, 11 aa, Japanese encephalitis virus
TRATRYLMKTE

SEQ ID NO: 241017 - protein, 11 aa, Japanese encephalitis virus
RATRYLMKTEN

SEQ ID NO: 241018 - protein, 11 aa, Japanese encephalitis virus
ATRYLVKTENW

SEQ ID NO: 241019 - protein, 11 aa, Japanese encephalitis virus
TRYLVKTENWI

SEQ ID NO: 241020 - protein, 11 aa, Japanese encephalitis virus
RYLMKTENWIV

SEQ ID NO: 241021 - protein, 11 aa, Japanese encephalitis virus
YLMKTENWIVR

SEQ ID NO: 241022 - protein, 11 aa, Japanese encephalitis virus
LTKTENWIIRN

SEQ ID NO: 241023 - protein, 11 aa, Japanese encephalitis virus
MKTENWIVRNP

SEQ ID NO: 241024 - protein, 11 aa, Japanese encephalitis virus
IRNPGYAFLAV

SEQ ID NO: 241025 - protein, 11 aa, Japanese encephalitis virus
GQRLGFTILLL

SEQ ID NO: 241026 - protein, 11 aa, Japanese encephalitis virus
PRVVFTILLLL

SEQ ID NO: 241027 - protein, 11 aa, Japanese encephalitis virus
RLGFTILLLLV

SEQ ID NO: 241028 - protein, 11 aa, Japanese encephalitis virus
VVFTILPLLVA

SEQ ID NO: 241029 - protein, 11 aa, Japanese encephalitis virus
VFTILPLLVAP

SEQ ID NO: 241030 - protein, 11 aa, Japanese encephalitis virus
PLLVAPAYSFN

SEQ ID NO: 241031 - protein, 11 aa, Japanese encephalitis virus
NCLGMGNRDFV

SEQ ID NO: 241032 - protein, 11 aa, Japanese encephalitis virus
CLGMGNRDFIQ

SEQ ID NO: 241033 - protein, 11 aa, Japanese encephalitis virus
LGMGNRDFIQG

SEQ ID NO: 241034 - protein, 11 aa, Japanese encephalitis virus
GMGNRDFIQGA

SEQ ID NO: 241035 - protein, 11 aa, Japanese encephalitis virus
MGNRDFIEGVS

SEQ ID NO: 241036 - protein, 11 aa, Japanese encephalitis virus
GNRDFIERASG

SEQ ID NO: 241037 - protein, 11 aa, Japanese encephalitis virus
NRDFIEGVSGA

SEQ ID NO: 241038 - protein, 11 aa, Japanese encephalitis virus
RDFIQGASGAT

SEQ ID NO: 241039 - protein, 11 aa, Japanese encephalitis virus
DFIEGVSGATW

SEQ ID NO: 241040 - protein, 11 aa, Japanese encephalitis virus
FIEGVSGATWV

SEQ ID NO: 241041 - protein, 11 aa, Japanese encephalitis virus
VEGASGATWVD

SEQ ID NO: 241042 - protein, 11 aa, Japanese encephalitis virus
EGVSGATWVDL

SEQ ID NO: 241043 - protein, 11 aa, Japanese encephalitis virus
RASGATWVDLV

SEQ ID NO: 241044 - protein, 11 aa, Japanese encephalitis virus
DSCLTIMANDR

SEQ ID NO: 241045 - protein, 11 aa, Japanese encephalitis virus
SCLTIMANDRP

SEQ ID NO: 241046 - protein, 11 aa, Japanese encephalitis virus
CLTIMANDRPT

SEQ ID NO: 241047 - protein, 11 aa, Japanese encephalitis virus
LTIMANDRPTL

SEQ ID NO: 241048 - protein, 11 aa, Japanese encephalitis virus
TIMANDRPTLD

SEQ ID NO: 241049 - protein, 11 aa, Japanese encephalitis virus
IMANDKPTLDR

SEQ ID NO: 241050 - protein, 11 aa, Japanese encephalitis virus
MANDRPTLDVR

SEQ ID NO: 241051 - protein, 11 aa, Japanese encephalitis virus
ANDRPTLDVRM

SEQ ID NO: 241052 - protein, 11 aa, Japanese encephalitis virus
NDRPTLDVRMI

SEQ ID NO: 241053 - protein, 11 aa, Japanese encephalitis virus
DRPTLDVRMIN

SEQ ID NO: 241054 - protein, 11 aa, Japanese encephalitis virus
KPTLDRRMINI

SEQ ID NO: 241055 - protein, 11 aa, Japanese encephalitis virus
PTLDVRMTNIE

SEQ ID NO: 241056 - protein, 11 aa, Japanese encephalitis virus
TLDRRMINIEA

SEQ ID NO: 241057 - protein, 11 aa, Japanese encephalitis virus
LDVRMTNIEAS

SEQ ID NO: 241058 - protein, 11 aa, Japanese encephalitis virus
DVRMTNIEASQ

SEQ ID NO: 241059 - protein, 11 aa, Japanese encephalitis virus
VRMTNIEASQL

SEQ ID NO: 241060 - protein, 11 aa, Japanese encephalitis virus
RMTNIEASQLA

SEQ ID NO: 241061 - protein, 11 aa, Japanese encephalitis virus
MTNIEASQLAE

SEQ ID NO: 241062 - protein, 11 aa, Japanese encephalitis virus
TNIEASQLAEV

SEQ ID NO: 241063 - protein, 11 aa, Japanese encephalitis virus
ASQLAEVRSYY

SEQ ID NO: 241064 - protein, 11 aa, Japanese encephalitis virus
SQLAEVRSYYY

SEQ ID NO: 241065 - protein, 11 aa, Japanese encephalitis virus
QLAEVRSYYYH

SEQ ID NO: 241066 - protein, 11 aa, Japanese encephalitis virus
LAEVRSYYYHA

SEQ ID NO: 241067 - protein, 11 aa, Japanese encephalitis virus
AEVRSYYYHAS

SEQ ID NO: 241068 - protein, 11 aa, Japanese encephalitis virus
EVRSYYYHASV

SEQ ID NO: 241069 - protein, 11 aa, Japanese encephalitis virus
VRSYYYHASVT

SEQ ID NO: 241070 - protein, 11 aa, Japanese encephalitis virus
RSYYYHASVTD

SEQ ID NO: 241071 - protein, 11 aa, Japanese encephalitis virus
SYYYHASVTDI

SEQ ID NO: 241072 - protein, 11 aa, Japanese encephalitis virus
YCYRASVTDIS

SEQ ID NO: 241073 - protein, 11 aa, Japanese encephalitis virus
CYRASVTDIST

SEQ ID NO: 241074 - protein, 11 aa, Japanese encephalitis virus
RCPTTGEAHNK

SEQ ID NO: 241075 - protein, 11 aa, Japanese encephalitis virus
CPTTGEAHNKK

SEQ ID NO: 241076 - protein, 11 aa, Japanese encephalitis virus
PTTGEAHNEKG

SEQ ID NO: 241077 - protein, 11 aa, Japanese encephalitis virus
TTGEAHNKKRA

SEQ ID NO: 241078 - protein, 11 aa, Japanese encephalitis virus
TGEAHNEKQAD

SEQ ID NO: 241079 - protein, 11 aa, Japanese encephalitis virus
GEAHNKKRADS

SEQ ID NO: 241080 - protein, 11 aa, Japanese encephalitis virus
EAHNEKQADSS

SEQ ID NO: 241081 - protein, 11 aa, Japanese encephalitis virus
AHNEKGADSSY

SEQ ID NO: 241082 - protein, 11 aa, Japanese encephalitis virus
HNEKGADSSYV

SEQ ID NO: 241083 - protein, 11 aa, Japanese encephalitis virus
NEKQADSSYVC

SEQ ID NO: 241084 - protein, 11 aa, Japanese encephalitis virus
EKGADSSYVCK

SEQ ID NO: 241085 - protein, 11 aa, Japanese encephalitis virus
KQADSSYVCKQ

SEQ ID NO: 241086 - protein, 11 aa, Japanese encephalitis virus
QADSSYVCKQG

SEQ ID NO: 241087 - protein, 11 aa, Japanese encephalitis virus
KQGFTDRGWGK

SEQ ID NO: 241088 - protein, 11 aa, Japanese encephalitis virus
QGFTDRGWRNG

SEQ ID NO: 241089 - protein, 11 aa, Japanese encephalitis virus
GFTDRGWGKGC

SEQ ID NO: 241090 - protein, 11 aa, Japanese encephalitis virus
FTDRGWRNGCG

SEQ ID NO: 241091 - protein, 11 aa, Japanese encephalitis virus
TDRGWGKGCGL

SEQ ID NO: 241092 - protein, 11 aa, Japanese encephalitis virus
DRGWGKGCGLF

SEQ ID NO: 241093 - protein, 11 aa, Japanese encephalitis virus
RGWGNGCGLSG

SEQ ID NO: 241094 - protein, 11 aa, Japanese encephalitis virus
GWRNGCGLFGK

SEQ ID NO: 241095 - protein, 11 aa, Japanese encephalitis virus
WRNGCGLFGKG

SEQ ID NO: 241096 - protein, 11 aa, Japanese encephalitis virus
GKGCGLFGKGS

SEQ ID NO: 241097 - protein, 11 aa, Japanese encephalitis virus
KGCGLFGKGSI

SEQ ID NO: 241098 - protein, 11 aa, Japanese encephalitis virus
GCGLSGKGSID

SEQ ID NO: 241099 - protein, 11 aa, Japanese encephalitis virus
CGLSGKGSIDT

SEQ ID NO: 241100 - protein, 11 aa, Japanese encephalitis virus
GLSGKGSIDTC

SEQ ID NO: 241101 - protein, 11 aa, Japanese encephalitis virus
LSGKGSIDTCA

SEQ ID NO: 241102 - protein, 11 aa, Japanese encephalitis virus
IDTCAKFSCTN

SEQ ID NO: 241103 - protein, 11 aa, Japanese encephalitis virus
DTCAKFSCTNK

SEQ ID NO: 241104 - protein, 11 aa, Japanese encephalitis virus
TCAKFSCTNKA

SEQ ID NO: 241105 - protein, 11 aa, Japanese encephalitis virus
CAKFSCTSKAT

SEQ ID NO: 241106 - protein, 11 aa, Japanese encephalitis virus
AKFSCTNKAIG

SEQ ID NO: 241107 - protein, 11 aa, Japanese encephalitis virus
KFSCTNKAIGR

SEQ ID NO: 241108 - protein, 11 aa, Japanese encephalitis virus
IQSENIKYEVG

SEQ ID NO: 241109 - protein, 11 aa, Japanese encephalitis virus
QPENSKYEVGI

SEQ ID NO: 241110 - protein, 11 aa, Japanese encephalitis virus
PENSKYEVGIF

SEQ ID NO: 241111 - protein, 11 aa, Japanese encephalitis virus
ENSKYEVGIFV

SEQ ID NO: 241112 - protein, 11 aa, Japanese encephalitis virus
NSKYEVGIFVH

SEQ ID NO: 241113 - protein, 11 aa, Japanese encephalitis virus
SKYEVGIFVHG

SEQ ID NO: 241114 - protein, 11 aa, Japanese encephalitis virus
KYKVGIFVHGA

SEQ ID NO: 241115 - protein, 11 aa, Japanese encephalitis virus
YKVGIFVHGAT

SEQ ID NO: 241116 - protein, 11 aa, Japanese encephalitis virus
KVGIFVHGATT

SEQ ID NO: 241117 - protein, 11 aa, Japanese encephalitis virus
TTTSENHGNYT

SEQ ID NO: 241118 - protein, 11 aa, Japanese encephalitis virus
NHGNYSAQVGV

SEQ ID NO: 241119 - protein, 11 aa, Japanese encephalitis virus
HGNYTAQIGAS

SEQ ID NO: 241120 - protein, 11 aa, Japanese encephalitis virus
GNYTAQIGASQ

SEQ ID NO: 241121 - protein, 11 aa, Japanese encephalitis virus
NYTAQIGASQA

SEQ ID NO: 241122 - protein, 11 aa, Japanese encephalitis virus
YSAQVGVSQAA

SEQ ID NO: 241123 - protein, 11 aa, Japanese encephalitis virus
SAQVGVSQAAK

SEQ ID NO: 241124 - protein, 11 aa, Japanese encephalitis virus
AQIGASQAAKF

SEQ ID NO: 241125 - protein, 11 aa, Japanese encephalitis virus
QVGVSQAAKFT

SEQ ID NO: 241126 - protein, 11 aa, Japanese encephalitis virus
GTSQAAKFTVT

SEQ ID NO: 241127 - protein, 11 aa, Japanese encephalitis virus
TSQAAKFTVTP

SEQ ID NO: 241128 - protein, 11 aa, Japanese encephalitis virus
SQAARFTVTPN

SEQ ID NO: 241129 - protein, 11 aa, Japanese encephalitis virus
QAARFTVTPNA

SEQ ID NO: 241130 - protein, 11 aa, Japanese encephalitis virus
AARFTVTPNAP

SEQ ID NO: 241131 - protein, 11 aa, Japanese encephalitis virus
ARFTVTPNAPS

SEQ ID NO: 241132 - protein, 11 aa, Japanese encephalitis virus
KFTVTPNAPST

SEQ ID NO: 241133 - protein, 11 aa, Japanese encephalitis virus
FTITPNAPSIT

SEQ ID NO: 241134 - protein, 11 aa, Japanese encephalitis virus
TVTPNAPSTTL

SEQ ID NO: 241135 - protein, 11 aa, Japanese encephalitis virus
TPNAPSVALKL

SEQ ID NO: 241136 - protein, 11 aa, Japanese encephalitis virus
PNAPSVALKLG

SEQ ID NO: 241137 - protein, 11 aa, Japanese encephalitis virus
NAPSVALKLGD

SEQ ID NO: 241138 - protein, 11 aa, Japanese encephalitis virus
TLKLGDFGEVT

SEQ ID NO: 241139 - protein, 11 aa, Japanese encephalitis virus
LKLGDFGEVTL

SEQ ID NO: 241140 - protein, 11 aa, Japanese encephalitis virus
ELGDYGEVTLD

SEQ ID NO: 241141 - protein, 11 aa, Japanese encephalitis virus
DFGEVTLDCEP

SEQ ID NO: 241142 - protein, 11 aa, Japanese encephalitis virus
YGEVTLDCEAR

SEQ ID NO: 241143 - protein, 11 aa, Japanese encephalitis virus
GEVTLDCEPKS

SEQ ID NO: 241144 - protein, 11 aa, Japanese encephalitis virus
EVTLDCEPKSG

SEQ ID NO: 241145 - protein, 11 aa, Japanese encephalitis virus
VTLDCEPKSGL

SEQ ID NO: 241146 - protein, 11 aa, Japanese encephalitis virus
TLDCEPKSGLN

SEQ ID NO: 241147 - protein, 11 aa, Japanese encephalitis virus
LDCEPKSGLNT

SEQ ID NO: 241148 - protein, 11 aa, Japanese encephalitis virus
DCEPKSGLNTE

SEQ ID NO: 241149 - protein, 11 aa, Japanese encephalitis virus
CEARSGLNTEA

SEQ ID NO: 241150 - protein, 11 aa, Japanese encephalitis virus
EARSGLNTEAF

SEQ ID NO: 241151 - protein, 11 aa, Japanese encephalitis virus
ARSGLNTEAFY

SEQ ID NO: 241152 - protein, 11 aa, Japanese encephalitis virus
EAFYVMTVGPK

SEQ ID NO: 241153 - protein, 11 aa, Japanese encephalitis virus
AFYVMTVGPKS

SEQ ID NO: 241154 - protein, 11 aa, Japanese encephalitis virus
FYVMTVGPKSF

SEQ ID NO: 241155 - protein, 11 aa, Japanese encephalitis virus
YVMTVGSKSLL

SEQ ID NO: 241156 - protein, 11 aa, Japanese encephalitis virus
VMTVGSKSLLV

SEQ ID NO: 241157 - protein, 11 aa, Japanese encephalitis virus
MTVGSKSLLVH

SEQ ID NO: 241158 - protein, 11 aa, Japanese encephalitis virus
TVGSKSLLVHR

SEQ ID NO: 241159 - protein, 11 aa, Japanese encephalitis virus
VGPKSFLVHRE

SEQ ID NO: 241160 - protein, 11 aa, Japanese encephalitis virus
GSKSLLVHREW

SEQ ID NO: 241161 - protein, 11 aa, Japanese encephalitis virus
SKSLLVHREWF

SEQ ID NO: 241162 - protein, 11 aa, Japanese encephalitis virus
KSLLVHREWFH

SEQ ID NO: 241163 - protein, 11 aa, Japanese encephalitis virus
EWFHDLALPWS

SEQ ID NO: 241164 - protein, 11 aa, Japanese encephalitis virus
WFHDLALPWTP

SEQ ID NO: 241165 - protein, 11 aa, Japanese encephalitis virus
FHDLALPWTPP

SEQ ID NO: 241166 - protein, 11 aa, Japanese encephalitis virus
HDLALPWTPPS

SEQ ID NO: 241167 - protein, 11 aa, Japanese encephalitis virus
DLALPWTPPSS

SEQ ID NO: 241168 - protein, 11 aa, Japanese encephalitis virus
LALPWTPPSST

SEQ ID NO: 241169 - protein, 11 aa, Japanese encephalitis virus
ALPWTPPSSTA

SEQ ID NO: 241170 - protein, 11 aa, Japanese encephalitis virus
LPWTSSSNTAW

SEQ ID NO: 241171 - protein, 11 aa, Japanese encephalitis virus
PWTSSSNTAWR

SEQ ID NO: 241172 - protein, 11 aa, Japanese encephalitis virus
WTSSSNTAWRN

SEQ ID NO: 241173 - protein, 11 aa, Japanese encephalitis virus
SSPSSTAWRNR

SEQ ID NO: 241174 - protein, 11 aa, Japanese encephalitis virus
SSSNTAWRNRE

SEQ ID NO: 241175 - protein, 11 aa, Japanese encephalitis virus
RNRELLMEFEQ

SEQ ID NO: 241176 - protein, 11 aa, Japanese encephalitis virus
NRELLMEFEQA

SEQ ID NO: 241177 - protein, 11 aa, Japanese encephalitis virus
RELLMEFEQAH

SEQ ID NO: 241178 - protein, 11 aa, Japanese encephalitis virus
ELLMEFEQAHA

SEQ ID NO: 241179 - protein, 11 aa, Japanese encephalitis virus
LLMEFEQAHAT

SEQ ID NO: 241180 - protein, 11 aa, Japanese encephalitis virus
LMEFEQAHATK

SEQ ID NO: 241181 - protein, 11 aa, Japanese encephalitis virus
MEFEQAHATKQ

SEQ ID NO: 241182 - protein, 11 aa, Japanese encephalitis virus
EFEQAHATKQS

SEQ ID NO: 241183 - protein, 11 aa, Japanese encephalitis virus
FEQAHATKQSV

SEQ ID NO: 241184 - protein, 11 aa, Japanese encephalitis virus
EQAHATKQSVV

SEQ ID NO: 241185 - protein, 11 aa, Japanese encephalitis virus
QAHATKQSVVA

SEQ ID NO: 241186 - protein, 11 aa, Japanese encephalitis virus
QSVVALGSQER

SEQ ID NO: 241187 - protein, 11 aa, Japanese encephalitis virus
SVVALGSQEGS

SEQ ID NO: 241188 - protein, 11 aa, Japanese encephalitis virus
VVALGSREGGL

SEQ ID NO: 241189 - protein, 11 aa, Japanese encephalitis virus
VALGSQERALH

SEQ ID NO: 241190 - protein, 11 aa, Japanese encephalitis virus
ALGSREGGLHQ

SEQ ID NO: 241191 - protein, 11 aa, Japanese encephalitis virus
LGSQERALHQA

SEQ ID NO: 241192 - protein, 11 aa, Japanese encephalitis virus
GSQERALHQAL

SEQ ID NO: 241193 - protein, 11 aa, Japanese encephalitis virus
SREGGLHQALA

SEQ ID NO: 241194 - protein, 11 aa, Japanese encephalitis virus
QEGSLHQALAG

SEQ ID NO: 241195 - protein, 11 aa, Japanese encephalitis virus
EGSLHQALAGA

SEQ ID NO: 241196 - protein, 11 aa, Japanese encephalitis virus
RALHQALAGAI

SEQ ID NO: 241197 - protein, 11 aa, Japanese encephalitis virus
ALHQALAGAIV

SEQ ID NO: 241198 - protein, 11 aa, Japanese encephalitis virus
LAGAIVVEYPS

SEQ ID NO: 241199 - protein, 11 aa, Japanese encephalitis virus
AGAIVVEYSNS

SEQ ID NO: 241200 - protein, 11 aa, Japanese encephalitis virus
GAIVVEYSNSV

SEQ ID NO: 241201 - protein, 11 aa, Japanese encephalitis virus
AIVVEYSNSVK

SEQ ID NO: 241202 - protein, 11 aa, Japanese encephalitis virus
IVVEYPSSVKL

SEQ ID NO: 241203 - protein, 11 aa, Japanese encephalitis virus
VVEYPSSVKLT

SEQ ID NO: 241204 - protein, 11 aa, Japanese encephalitis virus
VEYPSSVKLTS

SEQ ID NO: 241205 - protein, 11 aa, Japanese encephalitis virus
EYPSSVKLTSG

SEQ ID NO: 241206 - protein, 11 aa, Japanese encephalitis virus
YSNSVKLTSGH

SEQ ID NO: 241207 - protein, 11 aa, Japanese encephalitis virus
SSSVKLTSGHV

SEQ ID NO: 241208 - protein, 11 aa, Japanese encephalitis virus
SSVKLTSGHVK

SEQ ID NO: 241209 - protein, 11 aa, Japanese encephalitis virus
SVKLTSGHVKR

SEQ ID NO: 241210 - protein, 11 aa, Japanese encephalitis virus
VKLTSGHVKRR

SEQ ID NO: 241211 - protein, 11 aa, Japanese encephalitis virus
KLTSGHVKRRL

SEQ ID NO: 241212 - protein, 11 aa, Japanese encephalitis virus
LTSGHVKRRLK

SEQ ID NO: 241213 - protein, 11 aa, Japanese encephalitis virus
TSGHVKRRLKM

SEQ ID NO: 241214 - protein, 11 aa, Japanese encephalitis virus
SGHVKRRLKMD

SEQ ID NO: 241215 - protein, 11 aa, Japanese encephalitis virus
GHLKCRLRMDK

SEQ ID NO: 241216 - protein, 11 aa, Japanese encephalitis virus
HLKCRLRMDKL

SEQ ID NO: 241217 - protein, 11 aa, Japanese encephalitis virus
LKCRLRMDKLA

SEQ ID NO: 241218 - protein, 11 aa, Japanese encephalitis virus
KRRLKMDKLAL

SEQ ID NO: 241219 - protein, 11 aa, Japanese encephalitis virus
RRLKMDKLALK

SEQ ID NO: 241220 - protein, 11 aa, Japanese encephalitis virus
LKGTTYGMCTK

SEQ ID NO: 241221 - protein, 11 aa, Japanese encephalitis virus
KGTTYGMCTKK

SEQ ID NO: 241222 - protein, 11 aa, Japanese encephalitis virus
GTTYGMCTKKF

SEQ ID NO: 241223 - protein, 11 aa, Japanese encephalitis virus
TTYGMCTKKFS

SEQ ID NO: 241224 - protein, 11 aa, Japanese encephalitis virus
TYGMCTKKFSF

SEQ ID NO: 241225 - protein, 11 aa, Japanese encephalitis virus
YGMCTKKFSFA

SEQ ID NO: 241226 - protein, 11 aa, Japanese encephalitis virus
GMCTKKFSFAK

SEQ ID NO: 241227 - protein, 11 aa, Japanese encephalitis virus
MCTKKFSFAKN

SEQ ID NO: 241228 - protein, 11 aa, Japanese encephalitis virus
CTKKFSFAKNP

SEQ ID NO: 241229 - protein, 11 aa, Japanese encephalitis virus
TEKFSFAKNPV

SEQ ID NO: 241230 - protein, 11 aa, Japanese encephalitis virus
EKFSFAKNPVD

SEQ ID NO: 241231 - protein, 11 aa, Japanese encephalitis virus
NSSFRKNPADT

SEQ ID NO: 241232 - protein, 11 aa, Japanese encephalitis virus
SSFRKNPADTG

SEQ ID NO: 241233 - protein, 11 aa, Japanese encephalitis virus
SFRKNPADTGH

SEQ ID NO: 241234 - protein, 11 aa, Japanese encephalitis virus
FRKNPADTGHG

SEQ ID NO: 241235 - protein, 11 aa, Japanese encephalitis virus
RKNPADTGHGT

SEQ ID NO: 241236 - protein, 11 aa, Japanese encephalitis virus
TGHGTVVIELL

SEQ ID NO: 241237 - protein, 11 aa, Japanese encephalitis virus
GHGTVVIELLY

SEQ ID NO: 241238 - protein, 11 aa, Japanese encephalitis virus
HGTVVIELLYS

SEQ ID NO: 241239 - protein, 11 aa, Japanese encephalitis virus
GTVVIELLYSG

SEQ ID NO: 241240 - protein, 11 aa, Japanese encephalitis virus
TVVIELSYSGR

SEQ ID NO: 241241 - protein, 11 aa, Japanese encephalitis virus
VVIELSYSGRD

SEQ ID NO: 241242 - protein, 11 aa, Japanese encephalitis virus
VIELSYSGRDG

SEQ ID NO: 241243 - protein, 11 aa, Japanese encephalitis virus
IELSYSGSDGS

SEQ ID NO: 241244 - protein, 11 aa, Japanese encephalitis virus
ELSYSGSDGSC

SEQ ID NO: 241245 - protein, 11 aa, Japanese encephalitis virus
LSYSGSDGSCK

SEQ ID NO: 241246 - protein, 11 aa, Japanese encephalitis virus
SYSGRDGPCKI

SEQ ID NO: 241247 - protein, 11 aa, Japanese encephalitis virus
YSGSDGSCKIP

SEQ ID NO: 241248 - protein, 11 aa, Japanese encephalitis virus
SGRDGPCKIPI

SEQ ID NO: 241249 - protein, 11 aa, Japanese encephalitis virus
GSDGSCKIPIV

SEQ ID NO: 241250 - protein, 11 aa, Japanese encephalitis virus
RDGPCKIPIVS

SEQ ID NO: 241251 - protein, 11 aa, Japanese encephalitis virus
GPCKIPIVSVV

SEQ ID NO: 241252 - protein, 11 aa, Japanese encephalitis virus
PCKIPIVSVVS

SEQ ID NO: 241253 - protein, 11 aa, Japanese encephalitis virus
CKIPIVSVVSL

SEQ ID NO: 241254 - protein, 11 aa, Japanese encephalitis virus
KIPIVSVANLN

SEQ ID NO: 241255 - protein, 11 aa, Japanese encephalitis virus
IPIVSVANLND

SEQ ID NO: 241256 - protein, 11 aa, Japanese encephalitis virus
PIVSVANLNDM

SEQ ID NO: 241257 - protein, 11 aa, Japanese encephalitis virus
IVSVVSLNDMT

SEQ ID NO: 241258 - protein, 11 aa, Japanese encephalitis virus
VSVVSLNDMTP

SEQ ID NO: 241259 - protein, 11 aa, Japanese encephalitis virus
SVVSLNDMTPV

SEQ ID NO: 241260 - protein, 11 aa, Japanese encephalitis virus
VANLNDMTPVG

SEQ ID NO: 241261 - protein, 11 aa, Japanese encephalitis virus
VSLNDMTPVGR

SEQ ID NO: 241262 - protein, 11 aa, Japanese encephalitis virus
NLNDMTPVGRL

SEQ ID NO: 241263 - protein, 11 aa, Japanese encephalitis virus
LNDMTPAGRLV

SEQ ID NO: 241264 - protein, 11 aa, Japanese encephalitis virus
NDMTPAGRLVT

SEQ ID NO: 241265 - protein, 11 aa, Japanese encephalitis virus
DMTPAGRLVTV

SEQ ID NO: 241266 - protein, 11 aa, Japanese encephalitis virus
MTPAGRLVTVN

SEQ ID NO: 241267 - protein, 11 aa, Japanese encephalitis virus
TVNPFVAASSA

SEQ ID NO: 241268 - protein, 11 aa, Japanese encephalitis virus
VNPFVAASSAN

SEQ ID NO: 241269 - protein, 11 aa, Japanese encephalitis virus
NPFVAASSANS

SEQ ID NO: 241270 - protein, 11 aa, Japanese encephalitis virus
PFVAASSANSK

SEQ ID NO: 241271 - protein, 11 aa, Japanese encephalitis virus
FVAASSANSKV

SEQ ID NO: 241272 - protein, 11 aa, Japanese encephalitis virus
VAASSANSKVL

SEQ ID NO: 241273 - protein, 11 aa, Japanese encephalitis virus
SSSNSKVLLEI

SEQ ID NO: 241274 - protein, 11 aa, Japanese encephalitis virus
SSNSKVLLEIE

SEQ ID NO: 241275 - protein, 11 aa, Japanese encephalitis virus
SNSKVLLEIEP

SEQ ID NO: 241276 - protein, 11 aa, Japanese encephalitis virus
NSQVLVEMEPP

SEQ ID NO: 241277 - protein, 11 aa, Japanese encephalitis virus
SQVLVEMEPPF

SEQ ID NO: 241278 - protein, 11 aa, Japanese encephalitis virus
QVLVEMEPPFG

SEQ ID NO: 241279 - protein, 11 aa, Japanese encephalitis virus
VLLEIEPPFGD

SEQ ID NO: 241280 - protein, 11 aa, Japanese encephalitis virus
PFGDSYIVVGM

SEQ ID NO: 241281 - protein, 11 aa, Japanese encephalitis virus
FGDSYIVVGRE

SEQ ID NO: 241282 - protein, 11 aa, Japanese encephalitis virus
HHRHKAGSTLG

SEQ ID NO: 241283 - protein, 11 aa, Japanese encephalitis virus
HRHKAGSTLGK

SEQ ID NO: 241284 - protein, 11 aa, Japanese encephalitis virus
WHKPGSTLGKA

SEQ ID NO: 241285 - protein, 11 aa, Japanese encephalitis virus
YKAGSTLGKAF

SEQ ID NO: 241286 - protein, 11 aa, Japanese encephalitis virus
RAGSTLGKAFS

SEQ ID NO: 241287 - protein, 11 aa, Japanese encephalitis virus
PGSTLGKAFST

SEQ ID NO: 241288 - protein, 11 aa, Japanese encephalitis virus
STTLKGAQRLV

SEQ ID NO: 241289 - protein, 11 aa, Japanese encephalitis virus
TAWDFGSIGGI

SEQ ID NO: 241290 - protein, 11 aa, Japanese encephalitis virus
AWDFGSIGGAF

SEQ ID NO: 241291 - protein, 11 aa, Japanese encephalitis virus
WDFGSIGGIFN

SEQ ID NO: 241292 - protein, 11 aa, Japanese encephalitis virus
DFGSIGRVFNS

SEQ ID NO: 241293 - protein, 11 aa, Japanese encephalitis virus
FGSIGRVFNSI

SEQ ID NO: 241294 - protein, 11 aa, Japanese encephalitis virus
GSIGGIFNSIG

SEQ ID NO: 241295 - protein, 11 aa, Japanese encephalitis virus
SIGGIFNSIGK

SEQ ID NO: 241296 - protein, 11 aa, Japanese encephalitis virus
IGGAFNSIGKA

SEQ ID NO: 241297 - protein, 11 aa, Japanese encephalitis virus
GRVFNSIGKAV

SEQ ID NO: 241298 - protein, 11 aa, Japanese encephalitis virus
GIFNSIGKAVH

SEQ ID NO: 241299 - protein, 11 aa, Japanese encephalitis virus
IFNSIGKAVHQ

SEQ ID NO: 241300 - protein, 11 aa, Japanese encephalitis virus
IGRAVHQVFGD

SEQ ID NO: 241301 - protein, 11 aa, Japanese encephalitis virus
GRAVHQVFGDA

SEQ ID NO: 241302 - protein, 11 aa, Japanese encephalitis virus
RAVHQVFGDAF

SEQ ID NO: 241303 - protein, 11 aa, Japanese encephalitis virus
LMGVLLLWMGI

SEQ ID NO: 241304 - protein, 11 aa, Japanese encephalitis virus
MGVLLLWMGIN

SEQ ID NO: 241305 - protein, 11 aa, Japanese encephalitis virus
GVLLLWMGINA

SEQ ID NO: 241306 - protein, 11 aa, Japanese encephalitis virus
VLLLWMGINAR

SEQ ID NO: 241307 - protein, 11 aa, Japanese encephalitis virus
LLLWMGVNARN

SEQ ID NO: 241308 - protein, 11 aa, Japanese encephalitis virus
LLWMGVNARNR

SEQ ID NO: 241309 - protein, 11 aa, Japanese encephalitis virus
LWMGVNARNRS

SEQ ID NO: 241310 - protein, 11 aa, Japanese encephalitis virus
WMGVNARNRSI

SEQ ID NO: 241311 - protein, 11 aa, Japanese encephalitis virus
MGVNARNRSIA

SEQ ID NO: 241312 - protein, 11 aa, Japanese encephalitis virus
GINARDRSIAM

SEQ ID NO: 241313 - protein, 11 aa, Japanese encephalitis virus
INARDRSIAMA

SEQ ID NO: 241314 - protein, 11 aa, Japanese encephalitis virus
NARNRSIALAF

SEQ ID NO: 241315 - protein, 11 aa, Japanese encephalitis virus
ARNRSIALAFL

SEQ ID NO: 241316 - protein, 11 aa, Japanese encephalitis virus
RNRSIALAFLA

SEQ ID NO: 241317 - protein, 11 aa, Japanese encephalitis virus
NRSIALAFLAT

SEQ ID NO: 241318 - protein, 11 aa, Japanese encephalitis virus
VHADTGSAIDI

SEQ ID NO: 241319 - protein, 11 aa, Japanese encephalitis virus
HADTGCAIDTT

SEQ ID NO: 241320 - protein, 11 aa, Japanese encephalitis virus
ADTGCAIDTTR

SEQ ID NO: 241321 - protein, 11 aa, Japanese encephalitis virus
ARKEMRCGSGI

SEQ ID NO: 241322 - protein, 11 aa, Japanese encephalitis virus
RNQMRCGSGIF

SEQ ID NO: 241323 - protein, 11 aa, Japanese encephalitis virus
NQMRCGSGIFV

SEQ ID NO: 241324 - protein, 11 aa, Japanese encephalitis virus
RYKYLPETPKS

SEQ ID NO: 241325 - protein, 11 aa, Japanese encephalitis virus
YKYLPETPRAL

SEQ ID NO: 241326 - protein, 11 aa, Japanese encephalitis virus
KYLPETPRALA

SEQ ID NO: 241327 - protein, 11 aa, Japanese encephalitis virus
YLPETPRALAK

SEQ ID NO: 241328 - protein, 11 aa, Japanese encephalitis virus
LPETPKSLAKI

SEQ ID NO: 241329 - protein, 11 aa, Japanese encephalitis virus
PETPRALAKIV

SEQ ID NO: 241330 - protein, 11 aa, Japanese encephalitis virus
ETPKSLAKIVH

SEQ ID NO: 241331 - protein, 11 aa, Japanese encephalitis virus
TPKSLAKIVHK

SEQ ID NO: 241332 - protein, 11 aa, Japanese encephalitis virus
PKSLAKIVHKA

SEQ ID NO: 241333 - protein, 11 aa, Japanese encephalitis virus
KSLAKIVHKAY

SEQ ID NO: 241334 - protein, 11 aa, Japanese encephalitis virus
SLAKIVHKAYK

SEQ ID NO: 241335 - protein, 11 aa, Japanese encephalitis virus
LAKIVHKAHME

SEQ ID NO: 241336 - protein, 11 aa, Japanese encephalitis virus
AKIVHKAHMEG

SEQ ID NO: 241337 - protein, 11 aa, Japanese encephalitis virus
KIVHKAHMEGV

SEQ ID NO: 241338 - protein, 11 aa, Japanese encephalitis virus
IVHKAYKEGVC

SEQ ID NO: 241339 - protein, 11 aa, Japanese encephalitis virus
VHKAHMEGVCG

SEQ ID NO: 241340 - protein, 11 aa, Japanese encephalitis virus
HKAYKEGVCGI

SEQ ID NO: 241341 - protein, 11 aa, Japanese encephalitis virus
KAHMEGICGVR

SEQ ID NO: 241342 - protein, 11 aa, Japanese encephalitis virus
AHMEGICGVRS

SEQ ID NO: 241343 - protein, 11 aa, Japanese encephalitis virus
YKEGVCGIRSV

SEQ ID NO: 241344 - protein, 11 aa, Japanese encephalitis virus
KEGVCGIRSVT

SEQ ID NO: 241345 - protein, 11 aa, Japanese encephalitis virus
EGICGVRSVTR

SEQ ID NO: 241346 - protein, 11 aa, Japanese encephalitis virus
GVCGIRSVTRL

SEQ ID NO: 241347 - protein, 11 aa, Japanese encephalitis virus
VCGIRSVTRLE

SEQ ID NO: 241348 - protein, 11 aa, Japanese encephalitis virus
WEAVRDELNVP

SEQ ID NO: 241349 - protein, 11 aa, Japanese encephalitis virus
EAVRDELNVPL

SEQ ID NO: 241350 - protein, 11 aa, Japanese encephalitis virus
AVRDELNVPLK

SEQ ID NO: 241351 - protein, 11 aa, Japanese encephalitis virus
GRYRSAPKRLF

SEQ ID NO: 241352 - protein, 11 aa, Japanese encephalitis virus
RYRSTPKRLSM

SEQ ID NO: 241353 - protein, 11 aa, Japanese encephalitis virus
YRSAPKRLFMT

SEQ ID NO: 241354 - protein, 11 aa, Japanese encephalitis virus
RSAPKRLSMTR

SEQ ID NO: 241355 - protein, 11 aa, Japanese encephalitis virus
STPKRLSMTQE

SEQ ID NO: 241356 - protein, 11 aa, Japanese encephalitis virus
APKRLSMTREK

SEQ ID NO: 241357 - protein, 11 aa, Japanese encephalitis virus
PKRLSMTREKF

SEQ ID NO: 241358 - protein, 11 aa, Japanese encephalitis virus
KRLFMTQEKVE

SEQ ID NO: 241359 - protein, 11 aa, Japanese encephalitis virus
RLSMTREKFEM

SEQ ID NO: 241360 - protein, 11 aa, Japanese encephalitis virus
LFMTQEKVEMG

SEQ ID NO: 241361 - protein, 11 aa, Japanese encephalitis virus
FMTQEKVEMGW

SEQ ID NO: 241362 - protein, 11 aa, Japanese encephalitis virus
MTQEKVEMGWK

SEQ ID NO: 241363 - protein, 11 aa, Japanese encephalitis virus
TQEKVEMGWKA

SEQ ID NO: 241364 - protein, 11 aa, Japanese encephalitis virus
QEKVEMGWKAW

SEQ ID NO: 241365 - protein, 11 aa, Japanese encephalitis virus
EMGWKAWGKSM

SEQ ID NO: 241366 - protein, 11 aa, Japanese encephalitis virus
MGWKAWGKSLL

SEQ ID NO: 241367 - protein, 11 aa, Japanese encephalitis virus
GWKAWGKSMLF

SEQ ID NO: 241368 - protein, 11 aa, Japanese encephalitis virus
WKAWGKSLLFA

SEQ ID NO: 241369 - protein, 11 aa, Japanese encephalitis virus
KAWGKSLLFAP

SEQ ID NO: 241370 - protein, 11 aa, Japanese encephalitis virus
AWGKSLLFAPE

SEQ ID NO: 241371 - protein, 11 aa, Japanese encephalitis virus
WGKSILFAPEM

SEQ ID NO: 241372 - protein, 11 aa, Japanese encephalitis virus
GKSMLFAPELA

SEQ ID NO: 241373 - protein, 11 aa, Japanese encephalitis virus
KSILFAPEMAN

SEQ ID NO: 241374 - protein, 11 aa, Japanese encephalitis virus
SLLFAPELANS

SEQ ID NO: 241375 - protein, 11 aa, Japanese encephalitis virus
LLFAPELANSS

SEQ ID NO: 241376 - protein, 11 aa, Japanese encephalitis virus
LFAPEMANSTF

SEQ ID NO: 241377 - protein, 11 aa, Japanese encephalitis virus
FAPEMANSTFV

SEQ ID NO: 241378 - protein, 11 aa, Japanese encephalitis virus
APELANSSFVV

SEQ ID NO: 241379 - protein, 11 aa, Japanese encephalitis virus
PELANSSFVVD

SEQ ID NO: 241380 - protein, 11 aa, Japanese encephalitis virus
ELANSSFVVDG

SEQ ID NO: 241381 - protein, 11 aa, Japanese encephalitis virus
LANSSFVVDGP

SEQ ID NO: 241382 - protein, 11 aa, Japanese encephalitis virus
GPETKECPVVH

SEQ ID NO: 241383 - protein, 11 aa, Japanese encephalitis virus
PETKECPDEQR

SEQ ID NO: 241384 - protein, 11 aa, Japanese encephalitis virus
ETKECPDEQRA

SEQ ID NO: 241385 - protein, 11 aa, Japanese encephalitis virus
TKECPDEQRAW

SEQ ID NO: 241386 - protein, 11 aa, Japanese encephalitis virus
KECPVVHRAWN

SEQ ID NO: 241387 - protein, 11 aa, Japanese encephalitis virus
ECPVVHRAWNS

SEQ ID NO: 241388 - protein, 11 aa, Japanese encephalitis virus
CPDEQRAWNSM

SEQ ID NO: 241389 - protein, 11 aa, Japanese encephalitis virus
PDERRAWNSTQ

SEQ ID NO: 241390 - protein, 11 aa, Japanese encephalitis virus
DERRAWNSTQI

SEQ ID NO: 241391 - protein, 11 aa, Japanese encephalitis virus
EQRAWNSMQIE

SEQ ID NO: 241392 - protein, 11 aa, Japanese encephalitis virus
RRAWNSTQIED

SEQ ID NO: 241393 - protein, 11 aa, Japanese encephalitis virus
TRVWLKIREET

SEQ ID NO: 241394 - protein, 11 aa, Japanese encephalitis virus
RVWLKIREETT

SEQ ID NO: 241395 - protein, 11 aa, Japanese encephalitis virus
VWLKIREETTD

SEQ ID NO: 241396 - protein, 11 aa, Japanese encephalitis virus
WLKIREETTDE

SEQ ID NO: 241397 - protein, 11 aa, Japanese encephalitis virus
LKIREETTDEC

SEQ ID NO: 241398 - protein, 11 aa, Japanese encephalitis virus
KIREETTDECD

SEQ ID NO: 241399 - protein, 11 aa, Japanese encephalitis virus
IREETTDECDG

SEQ ID NO: 241400 - protein, 11 aa, Japanese encephalitis virus
REESTDECDGP

SEQ ID NO: 241401 - protein, 11 aa, Japanese encephalitis virus
EESTDECDGPI

SEQ ID NO: 241402 - protein, 11 aa, Japanese encephalitis virus
ESTDECDGPII

SEQ ID NO: 241403 - protein, 11 aa, Japanese encephalitis virus
STDECDGPIIG

SEQ ID NO: 241404 - protein, 11 aa, Japanese encephalitis virus
TDECDGTIIGT

SEQ ID NO: 241405 - protein, 11 aa, Japanese encephalitis virus
DECDGTIIGTA

SEQ ID NO: 241406 - protein, 11 aa, Japanese encephalitis virus
ECDGTIIGTAI

SEQ ID NO: 241407 - protein, 11 aa, Japanese encephalitis virus
CDGTIIGTAIK

SEQ ID NO: 241408 - protein, 11 aa, Japanese encephalitis virus
DGTIIGTAIKG

SEQ ID NO: 241409 - protein, 11 aa, Japanese encephalitis virus
GPIIGTAVKGH

SEQ ID NO: 241410 - protein, 11 aa, Japanese encephalitis virus
AIIGTAVKGNV

SEQ ID NO: 241411 - protein, 11 aa, Japanese encephalitis virus
IIGTAVKGHVT

SEQ ID NO: 241412 - protein, 11 aa, Japanese encephalitis virus
IGTAVKGHVAL

SEQ ID NO: 241413 - protein, 11 aa, Japanese encephalitis virus
GTAVKGHVALH

SEQ ID NO: 241414 - protein, 11 aa, Japanese encephalitis virus
TAVKGHVALHS

SEQ ID NO: 241415 - protein, 11 aa, Japanese encephalitis virus
AIKGHVAVHSD

SEQ ID NO: 241416 - protein, 11 aa, Japanese encephalitis virus
IKGHVAVHSDL

SEQ ID NO: 241417 - protein, 11 aa, Japanese encephalitis virus
KGHVALHSDLS

SEQ ID NO: 241418 - protein, 11 aa, Japanese encephalitis virus
GHVTVHSDVSY

SEQ ID NO: 241419 - protein, 11 aa, Japanese encephalitis virus
HVTVHSDVSYW

SEQ ID NO: 241420 - protein, 11 aa, Japanese encephalitis virus
VTVHSDVSYWI

SEQ ID NO: 241421 - protein, 11 aa, Japanese encephalitis virus
TVHSDVSYWIE

SEQ ID NO: 241422 - protein, 11 aa, Japanese encephalitis virus
VHSDLSYWIGS

SEQ ID NO: 241423 - protein, 11 aa, Japanese encephalitis virus
HSDVSYWIESR

SEQ ID NO: 241424 - protein, 11 aa, Japanese encephalitis virus
NDTWKRERAVF

SEQ ID NO: 241425 - protein, 11 aa, Japanese encephalitis virus
DTWKLERLVFG

SEQ ID NO: 241426 - protein, 11 aa, Japanese encephalitis virus
SWKLERAVFGE

SEQ ID NO: 241427 - protein, 11 aa, Japanese encephalitis virus
WKLERLVFGEV

SEQ ID NO: 241428 - protein, 11 aa, Japanese encephalitis virus
KRERAVFEEVK

SEQ ID NO: 241429 - protein, 11 aa, Japanese encephalitis virus
RERAVFEEVKS

SEQ ID NO: 241430 - protein, 11 aa, Japanese encephalitis virus
ERLVFGEVKSC

SEQ ID NO: 241431 - protein, 11 aa, Japanese encephalitis virus
RLVFGEVKSCT

SEQ ID NO: 241432 - protein, 11 aa, Japanese encephalitis virus
LVFGEVKSCTW

SEQ ID NO: 241433 - protein, 11 aa, Japanese encephalitis virus
VFEEVKSCTWP

SEQ ID NO: 241434 - protein, 11 aa, Japanese encephalitis virus
FEEVKSCTWPE

SEQ ID NO: 241435 - protein, 11 aa, Japanese encephalitis virus
EEVKSCTWPET

SEQ ID NO: 241436 - protein, 11 aa, Japanese encephalitis virus
IKSCTWPETHT

SEQ ID NO: 241437 - protein, 11 aa, Japanese encephalitis virus
WPETHSLWGDG

SEQ ID NO: 241438 - protein, 11 aa, Japanese encephalitis virus
PETHSLWGDGV

SEQ ID NO: 241439 - protein, 11 aa, Japanese encephalitis virus
ETHSLWGDGVE

SEQ ID NO: 241440 - protein, 11 aa, Japanese encephalitis virus
THSLWGDGVEE

SEQ ID NO: 241441 - protein, 11 aa, Japanese encephalitis virus
HSLWGDGVEES

SEQ ID NO: 241442 - protein, 11 aa, Japanese encephalitis virus
SLWGDGVEESE

SEQ ID NO: 241443 - protein, 11 aa, Japanese encephalitis virus
LWGDGVEESDL

SEQ ID NO: 241444 - protein, 11 aa, Japanese encephalitis virus
WGDGVEESDLV

SEQ ID NO: 241445 - protein, 11 aa, Japanese encephalitis virus
GDDAEESELII

SEQ ID NO: 241446 - protein, 11 aa, Japanese encephalitis virus
DDAEESELIIP

SEQ ID NO: 241447 - protein, 11 aa, Japanese encephalitis virus
GVEESELIIPD

SEQ ID NO: 241448 - protein, 11 aa, Japanese encephalitis virus
VEESELIIPDT

SEQ ID NO: 241449 - protein, 11 aa, Japanese encephalitis virus
EESDLVIPHTI

SEQ ID NO: 241450 - protein, 11 aa, Japanese encephalitis virus
ESDLVIPHTIA

SEQ ID NO: 241451 - protein, 11 aa, Japanese encephalitis virus
SELIIPDTIAG

SEQ ID NO: 241452 - protein, 11 aa, Japanese encephalitis virus
DLVIPHTIAGP

SEQ ID NO: 241453 - protein, 11 aa, Japanese encephalitis virus
LIIPHTLAGPK

SEQ ID NO: 241454 - protein, 11 aa, Japanese encephalitis virus
IIPHTLAGPKS

SEQ ID NO: 241455 - protein, 11 aa, Japanese encephalitis virus
IPHTLAGPKSK

SEQ ID NO: 241456 - protein, 11 aa, Japanese encephalitis virus
PHTLAGPKSKH

SEQ ID NO: 241457 - protein, 11 aa, Japanese encephalitis virus
HTLAGPKSKHN

SEQ ID NO: 241458 - protein, 11 aa, Japanese encephalitis virus
TLAGPKSKHNR

SEQ ID NO: 241459 - protein, 11 aa, Japanese encephalitis virus
LAGPKSKHNRR

SEQ ID NO: 241460 - protein, 11 aa, Japanese encephalitis virus
AGPKSKHNQRE

SEQ ID NO: 241461 - protein, 11 aa, Japanese encephalitis virus
GPKSKHNQREG

SEQ ID NO: 241462 - protein, 11 aa, Japanese encephalitis virus
PKSKHNQREGY

SEQ ID NO: 241463 - protein, 11 aa, Japanese encephalitis virus
KSKHNRREGYR

SEQ ID NO: 241464 - protein, 11 aa, Japanese encephalitis virus
SKHNQREGYKT

SEQ ID NO: 241465 - protein, 11 aa, Japanese encephalitis virus
KHNQREGYKTQ

SEQ ID NO: 241466 - protein, 11 aa, Japanese encephalitis virus
HNRREGYMTQN

SEQ ID NO: 241467 - protein, 11 aa, Japanese encephalitis virus
NQREGYKTQNQ

SEQ ID NO: 241468 - protein, 11 aa, Japanese encephalitis virus
RREGYMTQNQG

SEQ ID NO: 241469 - protein, 11 aa, Japanese encephalitis virus
REGYMTQNQGP

SEQ ID NO: 241470 - protein, 11 aa, Japanese encephalitis virus
EGYMTQNQGPW

SEQ ID NO: 241471 - protein, 11 aa, Japanese encephalitis virus
GYMTQNQGPWD

SEQ ID NO: 241472 - protein, 11 aa, Japanese encephalitis virus
YMTQNQGPWDE

SEQ ID NO: 241473 - protein, 11 aa, Japanese encephalitis virus
TQNQGPWDESG

SEQ ID NO: 241474 - protein, 11 aa, Japanese encephalitis virus
QNQGPWDESGI

SEQ ID NO: 241475 - protein, 11 aa, Japanese encephalitis virus
NQGPWDEDGIV

SEQ ID NO: 241476 - protein, 11 aa, Japanese encephalitis virus
QGPWDEKGIVL

SEQ ID NO: 241477 - protein, 11 aa, Japanese encephalitis virus
GPWDENGLVPG

SEQ ID NO: 241478 - protein, 11 aa, Japanese encephalitis virus
PWDENGLVPGL

SEQ ID NO: 241479 - protein, 11 aa, Japanese encephalitis virus
WDENGLVPGLD

SEQ ID NO: 241480 - protein, 11 aa, Japanese encephalitis virus
DEKGIVLDFDY

SEQ ID NO: 241481 - protein, 11 aa, Japanese encephalitis virus
EDGIVLDFDYC

SEQ ID NO: 241482 - protein, 11 aa, Japanese encephalitis virus
KGIVLDFDYCP

SEQ ID NO: 241483 - protein, 11 aa, Japanese encephalitis virus
VPGLDYCPGTK

SEQ ID NO: 241484 - protein, 11 aa, Japanese encephalitis virus
LDFDYCPGTTV

SEQ ID NO: 241485 - protein, 11 aa, Japanese encephalitis virus
DFDYCPGTTVT

SEQ ID NO: 241486 - protein, 11 aa, Japanese encephalitis virus
LDYCPGTKVTI

SEQ ID NO: 241487 - protein, 11 aa, Japanese encephalitis virus
GTTVTITEDCG

SEQ ID NO: 241488 - protein, 11 aa, Japanese encephalitis virus
TTVTITEDCGK

SEQ ID NO: 241489 - protein, 11 aa, Japanese encephalitis virus
TVTITEDCGKR

SEQ ID NO: 241490 - protein, 11 aa, Japanese encephalitis virus
VTITEDCGKRA

SEQ ID NO: 241491 - protein, 11 aa, Japanese encephalitis virus
TITEDCGKRAP

SEQ ID NO: 241492 - protein, 11 aa, Japanese encephalitis virus
ITEDCGKRAPW

SEQ ID NO: 241493 - protein, 11 aa, Japanese encephalitis virus
TEDCSKRGPSV

SEQ ID NO: 241494 - protein, 11 aa, Japanese encephalitis virus
EDCSKRGPSVR

SEQ ID NO: 241495 - protein, 11 aa, Japanese encephalitis virus
DCSKRGPSVRT

SEQ ID NO: 241496 - protein, 11 aa, Japanese encephalitis virus
CSKRGPSVRTT

SEQ ID NO: 241497 - protein, 11 aa, Japanese encephalitis virus
SKRGPSVRTTT

SEQ ID NO: 241498 - protein, 11 aa, Japanese encephalitis virus
KRAPWVRTTTD

SEQ ID NO: 241499 - protein, 11 aa, Japanese encephalitis virus
RGPSLRTTTDS

SEQ ID NO: 241500 - protein, 11 aa, Japanese encephalitis virus
GPSLRTTTDSG

SEQ ID NO: 241501 - protein, 11 aa, Japanese encephalitis virus
PSLRTTTDSGK

SEQ ID NO: 241502 - protein, 11 aa, Japanese encephalitis virus
SLRTTTDSGKL

SEQ ID NO: 241503 - protein, 11 aa, Japanese encephalitis virus
VRTTTDIGKLI

SEQ ID NO: 241504 - protein, 11 aa, Japanese encephalitis virus
LITDWCCRSCT

SEQ ID NO: 241505 - protein, 11 aa, Japanese encephalitis virus
ITDWCCRNCSL

SEQ ID NO: 241506 - protein, 11 aa, Japanese encephalitis virus
TDWCCRSCTLP

SEQ ID NO: 241507 - protein, 11 aa, Japanese encephalitis virus
DWCCRSCTLPP

SEQ ID NO: 241508 - protein, 11 aa, Japanese encephalitis virus
WCCRSCTLPPL

SEQ ID NO: 241509 - protein, 11 aa, Japanese encephalitis virus
CCRSCTLPPLR

SEQ ID NO: 241510 - protein, 11 aa, Japanese encephalitis virus
CRSCTLPPLRF

SEQ ID NO: 241511 - protein, 11 aa, Japanese encephalitis virus
RNCSLPPLRFR

SEQ ID NO: 241512 - protein, 11 aa, Japanese encephalitis virus
SCTLPPLRFRT

SEQ ID NO: 241513 - protein, 11 aa, Japanese encephalitis virus
CSLPPLRFRTD

SEQ ID NO: 241514 - protein, 11 aa, Japanese encephalitis virus
TLPPLRFRTGS

SEQ ID NO: 241515 - protein, 11 aa, Japanese encephalitis virus
LPPLRFRTDNG

SEQ ID NO: 241516 - protein, 11 aa, Japanese encephalitis virus
PPLRFRTDNGC

SEQ ID NO: 241517 - protein, 11 aa, Japanese encephalitis virus
PLRFRTDNGCW

SEQ ID NO: 241518 - protein, 11 aa, Japanese encephalitis virus
LRFRTGSGCWY

SEQ ID NO: 241519 - protein, 11 aa, Japanese encephalitis virus
RFRTDNGCWYG

SEQ ID NO: 241520 - protein, 11 aa, Japanese encephalitis virus
FRTDNGCWYGM

SEQ ID NO: 241521 - protein, 11 aa, Japanese encephalitis virus
RTDNGCWYGME

SEQ ID NO: 241522 - protein, 11 aa, Japanese encephalitis virus
TGSGCWYGMEV

SEQ ID NO: 241523 - protein, 11 aa, Japanese encephalitis virus
DNGCWYGMEIR

SEQ ID NO: 241524 - protein, 11 aa, Japanese encephalitis virus
GCWYGMEIRPA

SEQ ID NO: 241525 - protein, 11 aa, Japanese encephalitis virus
HDEATLVRSQA

SEQ ID NO: 241526 - protein, 11 aa, Japanese encephalitis virus
GGMVDPFQLGL

SEQ ID NO: 241527 - protein, 11 aa, Japanese encephalitis virus
GMVDPFQLGLL

SEQ ID NO: 241528 - protein, 11 aa, Japanese encephalitis virus
MVDPFQMGLLV

SEQ ID NO: 241529 - protein, 11 aa, Japanese encephalitis virus
VDPFQLGLLVV

SEQ ID NO: 241530 - protein, 11 aa, Japanese encephalitis virus
DPFQMGLLVMF

SEQ ID NO: 241531 - protein, 11 aa, Japanese encephalitis virus
PFQMGLLVMFL

SEQ ID NO: 241532 - protein, 11 aa, Japanese encephalitis virus
FQMGLLVMFLA

SEQ ID NO: 241533 - protein, 11 aa, Japanese encephalitis virus
QMGLLVMFLAT

SEQ ID NO: 241534 - protein, 11 aa, Japanese encephalitis virus
MGLLVMFLATQ

SEQ ID NO: 241535 - protein, 11 aa, Japanese encephalitis virus
LVMFLATQEVF

SEQ ID NO: 241536 - protein, 11 aa, Japanese encephalitis virus
VMFLATQEVLG

SEQ ID NO: 241537 - protein, 11 aa, Japanese encephalitis virus
MFLATQEVLGK

SEQ ID NO: 241538 - protein, 11 aa, Japanese encephalitis virus
FLATQEVLGKR

SEQ ID NO: 241539 - protein, 11 aa, Japanese encephalitis virus
LATQEVFRKRW

SEQ ID NO: 241540 - protein, 11 aa, Japanese encephalitis virus
ATQEVLGKRWT

SEQ ID NO: 241541 - protein, 11 aa, Japanese encephalitis virus
TQEVLGKRWTA

SEQ ID NO: 241542 - protein, 11 aa, Japanese encephalitis virus
QEVFRKRWTAR

SEQ ID NO: 241543 - protein, 11 aa, Japanese encephalitis virus
EVFRKRWTARL

SEQ ID NO: 241544 - protein, 11 aa, Japanese encephalitis virus
VLGKRWTARLT

SEQ ID NO: 241545 - protein, 11 aa, Japanese encephalitis virus
LGKRWTARLTI

SEQ ID NO: 241546 - protein, 11 aa, Japanese encephalitis virus
GKRWTARLTIP

SEQ ID NO: 241547 - protein, 11 aa, Japanese encephalitis virus
ARLTVPAVLGA

SEQ ID NO: 241548 - protein, 11 aa, Japanese encephalitis virus
RLTVPAVLGAL

SEQ ID NO: 241549 - protein, 11 aa, Japanese encephalitis virus
LTVPAVLGALL

SEQ ID NO: 241550 - protein, 11 aa, Japanese encephalitis virus
TVPAVLGALLV

SEQ ID NO: 241551 - protein, 11 aa, Japanese encephalitis virus
VPAVLGALLVL

SEQ ID NO: 241552 - protein, 11 aa, Japanese encephalitis virus
AVLGALLVLMF

SEQ ID NO: 241553 - protein, 11 aa, Japanese encephalitis virus
VLGALLVLMFG

SEQ ID NO: 241554 - protein, 11 aa, Japanese encephalitis virus
LGALLVLMFGG

SEQ ID NO: 241555 - protein, 11 aa, Japanese encephalitis virus
GALLVLMFGGI

SEQ ID NO: 241556 - protein, 11 aa, Japanese encephalitis virus
ALLVLMFGGIT

SEQ ID NO: 241557 - protein, 11 aa, Japanese encephalitis virus
LVLMFGGITYT

SEQ ID NO: 241558 - protein, 11 aa, Japanese encephalitis virus
VLMFGGITYTD

SEQ ID NO: 241559 - protein, 11 aa, Japanese encephalitis virus
LMFGGITYTDL

SEQ ID NO: 241560 - protein, 11 aa, Japanese encephalitis virus
MFGGITYTDLA

SEQ ID NO: 241561 - protein, 11 aa, Japanese encephalitis virus
FGGITYTDLAR

SEQ ID NO: 241562 - protein, 11 aa, Japanese encephalitis virus
LARYVVLVAAV

SEQ ID NO: 241563 - protein, 11 aa, Japanese encephalitis virus
ARYVVLVAASF

SEQ ID NO: 241564 - protein, 11 aa, Japanese encephalitis virus
RYVVLVAASFA

SEQ ID NO: 241565 - protein, 11 aa, Japanese encephalitis virus
YVVLVAAVFAE

SEQ ID NO: 241566 - protein, 11 aa, Japanese encephalitis virus
VVLVAAVFAEA

SEQ ID NO: 241567 - protein, 11 aa, Japanese encephalitis virus
VLVAASFAEAN

SEQ ID NO: 241568 - protein, 11 aa, Japanese encephalitis virus
LVAAVFAEANS

SEQ ID NO: 241569 - protein, 11 aa, Japanese encephalitis virus
VAASFAEANSG

SEQ ID NO: 241570 - protein, 11 aa, Japanese encephalitis virus
AASFAEANSGG

SEQ ID NO: 241571 - protein, 11 aa, Japanese encephalitis virus
AVFAEANSGGD

SEQ ID NO: 241572 - protein, 11 aa, Japanese encephalitis virus
SFAEANSGGDV

SEQ ID NO: 241573 - protein, 11 aa, Japanese encephalitis virus
VFKIQPAFLVA

SEQ ID NO: 241574 - protein, 11 aa, Japanese encephalitis virus
FKIQPAFLAMK

SEQ ID NO: 241575 - protein, 11 aa, Japanese encephalitis virus
KIQPAFLAMKM

SEQ ID NO: 241576 - protein, 11 aa, Japanese encephalitis virus
IQPAFLAMKML

SEQ ID NO: 241577 - protein, 11 aa, Japanese encephalitis virus
QPAFLVANMLS

SEQ ID NO: 241578 - protein, 11 aa, Japanese encephalitis virus
PAFLAMNTLST

SEQ ID NO: 241579 - protein, 11 aa, Japanese encephalitis virus
NMLSAKWTNQE

SEQ ID NO: 241580 - protein, 11 aa, Japanese encephalitis virus
TLSTRWTNQEN

SEQ ID NO: 241581 - protein, 11 aa, Japanese encephalitis virus
LSAKWTNQENM

SEQ ID NO: 241582 - protein, 11 aa, Japanese encephalitis virus
STRWTNQENVA

SEQ ID NO: 241583 - protein, 11 aa, Japanese encephalitis virus
TRWTNQENVAL

SEQ ID NO: 241584 - protein, 11 aa, Japanese encephalitis virus
KWTNQENMVLV

SEQ ID NO: 241585 - protein, 11 aa, Japanese encephalitis virus
WTNQENVILVL

SEQ ID NO: 241586 - protein, 11 aa, Japanese encephalitis virus
TNQENMVLVLG

SEQ ID NO: 241587 - protein, 11 aa, Japanese encephalitis virus
NQENMVLVLGA

SEQ ID NO: 241588 - protein, 11 aa, Japanese encephalitis virus
QENMVLVLGAA

SEQ ID NO: 241589 - protein, 11 aa, Japanese encephalitis virus
ENVVLVLGAAL

SEQ ID NO: 241590 - protein, 11 aa, Japanese encephalitis virus
NVVLVLGAALF

SEQ ID NO: 241591 - protein, 11 aa, Japanese encephalitis virus
VVLVLGAALFQ

SEQ ID NO: 241592 - protein, 11 aa, Japanese encephalitis virus
VLVLGAALFQL

SEQ ID NO: 241593 - protein, 11 aa, Japanese encephalitis virus
LGAALFQLASV

SEQ ID NO: 241594 - protein, 11 aa, Japanese encephalitis virus
GAALFQLASVD

SEQ ID NO: 241595 - protein, 11 aa, Japanese encephalitis virus
AALFQLASVDL

SEQ ID NO: 241596 - protein, 11 aa, Japanese encephalitis virus
ALFQLASVDLQ

SEQ ID NO: 241597 - protein, 11 aa, Japanese encephalitis virus
LFQLASVDLQI

SEQ ID NO: 241598 - protein, 11 aa, Japanese encephalitis virus
FQLASMDLQIG

SEQ ID NO: 241599 - protein, 11 aa, Japanese encephalitis virus
QLASMDLQIGV

SEQ ID NO: 241600 - protein, 11 aa, Japanese encephalitis virus
LASMDLQIGVH

SEQ ID NO: 241601 - protein, 11 aa, Japanese encephalitis virus
ASMDLQIGVHG

SEQ ID NO: 241602 - protein, 11 aa, Japanese encephalitis virus
SADLQIGVHGM

SEQ ID NO: 241603 - protein, 11 aa, Japanese encephalitis virus
ADLQIGVHGML

SEQ ID NO: 241604 - protein, 11 aa, Japanese encephalitis virus
GVHGMLNAAAI

SEQ ID NO: 241605 - protein, 11 aa, Japanese encephalitis virus
VHGMLNAAAIA

SEQ ID NO: 241606 - protein, 11 aa, Japanese encephalitis virus
HGMLNAAAIAW

SEQ ID NO: 241607 - protein, 11 aa, Japanese encephalitis virus
GMLNAAAIAWM

SEQ ID NO: 241608 - protein, 11 aa, Japanese encephalitis virus
MLNAAAIAWMI

SEQ ID NO: 241609 - protein, 11 aa, Japanese encephalitis virus
LNAAAIAWMII

SEQ ID NO: 241610 - protein, 11 aa, Japanese encephalitis virus
NAAAMAWMIVR

SEQ ID NO: 241611 - protein, 11 aa, Japanese encephalitis virus
AAAIAWMIIKA

SEQ ID NO: 241612 - protein, 11 aa, Japanese encephalitis virus
AAMAWMIVRAI

SEQ ID NO: 241613 - protein, 11 aa, Japanese encephalitis virus
AIAWMIIKAIT

SEQ ID NO: 241614 - protein, 11 aa, Japanese encephalitis virus
IAWMIIKAITF

SEQ ID NO: 241615 - protein, 11 aa, Japanese encephalitis virus
MIIKAITFPTT

SEQ ID NO: 241616 - protein, 11 aa, Japanese encephalitis virus
IIKAITFPTTS

SEQ ID NO: 241617 - protein, 11 aa, Japanese encephalitis virus
VRAITFPTASS

SEQ ID NO: 241618 - protein, 11 aa, Japanese encephalitis virus
RAITFPTASSV

SEQ ID NO: 241619 - protein, 11 aa, Japanese encephalitis virus
AITFPTASSVT

SEQ ID NO: 241620 - protein, 11 aa, Japanese encephalitis virus
ITFPTASSVTM

SEQ ID NO: 241621 - protein, 11 aa, Japanese encephalitis virus
TFPTASSVTMP

SEQ ID NO: 241622 - protein, 11 aa, Japanese encephalitis virus
MPLLALLAPGM

SEQ ID NO: 241623 - protein, 11 aa, Japanese encephalitis virus
PVLTLLTPGMR

SEQ ID NO: 241624 - protein, 11 aa, Japanese encephalitis virus
VLALLTPGMKA

SEQ ID NO: 241625 - protein, 11 aa, Japanese encephalitis virus
LALLAPGMRAL

SEQ ID NO: 241626 - protein, 11 aa, Japanese encephalitis virus
LLTPGMRALCL

SEQ ID NO: 241627 - protein, 11 aa, Japanese encephalitis virus
LTPGMRALCLD

SEQ ID NO: 241628 - protein, 11 aa, Japanese encephalitis virus
TPGMKALYLDT

SEQ ID NO: 241629 - protein, 11 aa, Japanese encephalitis virus
PGMRAFDLDTY

SEQ ID NO: 241630 - protein, 11 aa, Japanese encephalitis virus
GMKALYLDTYR

SEQ ID NO: 241631 - protein, 11 aa, Japanese encephalitis virus
MRALCLDTYRI

SEQ ID NO: 241632 - protein, 11 aa, Japanese encephalitis virus
KALYLDTYRII

SEQ ID NO: 241633 - protein, 11 aa, Japanese encephalitis virus
AFDLDTYRIIL

SEQ ID NO: 241634 - protein, 11 aa, Japanese encephalitis virus
LCLDTYRIILL

SEQ ID NO: 241635 - protein, 11 aa, Japanese encephalitis virus
CLDTYRIILLV

SEQ ID NO: 241636 - protein, 11 aa, Japanese encephalitis virus
TYRIILLIIGV

SEQ ID NO: 241637 - protein, 11 aa, Japanese encephalitis virus
YRIILLIIGVC

SEQ ID NO: 241638 - protein, 11 aa, Japanese encephalitis virus
RIILLIIGVCS

SEQ ID NO: 241639 - protein, 11 aa, Japanese encephalitis virus
IILLIIGVCSL

SEQ ID NO: 241640 - protein, 11 aa, Japanese encephalitis virus
ILLVIGICSLQ

SEQ ID NO: 241641 - protein, 11 aa, Japanese encephalitis virus
LLVIGVCSLLQ

SEQ ID NO: 241642 - protein, 11 aa, Japanese encephalitis virus
LVIGVCSLLQE

SEQ ID NO: 241643 - protein, 11 aa, Japanese encephalitis virus
VIGVCSLLQER

SEQ ID NO: 241644 - protein, 11 aa, Japanese encephalitis virus
ERKKAMAKKKG

SEQ ID NO: 241645 - protein, 11 aa, Japanese encephalitis virus
RKKAMAKKKGA

SEQ ID NO: 241646 - protein, 11 aa, Japanese encephalitis virus
KKAMAKKKGAV

SEQ ID NO: 241647 - protein, 11 aa, Japanese encephalitis virus
RTMAKKKGAVL

SEQ ID NO: 241648 - protein, 11 aa, Japanese encephalitis virus
AMAKKKGAVLL

SEQ ID NO: 241649 - protein, 11 aa, Japanese encephalitis virus
SPTTIAAGLMA

SEQ ID NO: 241650 - protein, 11 aa, Japanese encephalitis virus
PTTIAAGLMAC

SEQ ID NO: 241651 - protein, 11 aa, Japanese encephalitis virus
TTITAGLMVCN

SEQ ID NO: 241652 - protein, 11 aa, Japanese encephalitis virus
TITAGLMVCNP

SEQ ID NO: 241653 - protein, 11 aa, Japanese encephalitis virus
ITAGLMVCNPN

SEQ ID NO: 241654 - protein, 11 aa, Japanese encephalitis virus
TAGLMVCNPNK

SEQ ID NO: 241655 - protein, 11 aa, Japanese encephalitis virus
GWPATEVLSAV

SEQ ID NO: 241656 - protein, 11 aa, Japanese encephalitis virus
WPATEVLSAVG

SEQ ID NO: 241657 - protein, 11 aa, Japanese encephalitis virus
PATEVLSAVGL

SEQ ID NO: 241658 - protein, 11 aa, Japanese encephalitis virus
ATEVLSAVGLM

SEQ ID NO: 241659 - protein, 11 aa, Japanese encephalitis virus
TEVLSAVGLMF

SEQ ID NO: 241660 - protein, 11 aa, Japanese encephalitis virus
EVLSAVGLMFA

SEQ ID NO: 241661 - protein, 11 aa, Japanese encephalitis virus
VLSAVGLMFAI

SEQ ID NO: 241662 - protein, 11 aa, Japanese encephalitis virus
SGKATDMWLEQ

SEQ ID NO: 241663 - protein, 11 aa, Japanese encephalitis virus
GKATDMWLEQA

SEQ ID NO: 241664 - protein, 11 aa, Japanese encephalitis virus
KATDMWLEQAA

SEQ ID NO: 241665 - protein, 11 aa, Japanese encephalitis virus
ATDMWLEQAAD

SEQ ID NO: 241666 - protein, 11 aa, Japanese encephalitis virus
TDMWLEQAADI

SEQ ID NO: 241667 - protein, 11 aa, Japanese encephalitis virus
DMWLEQAADIS

SEQ ID NO: 241668 - protein, 11 aa, Japanese encephalitis virus
MWLERAADVSW

SEQ ID NO: 241669 - protein, 11 aa, Japanese encephalitis virus
SWDMGAAITGS

SEQ ID NO: 241670 - protein, 11 aa, Japanese encephalitis virus
WDMGAAITGSS

SEQ ID NO: 241671 - protein, 11 aa, Japanese encephalitis virus
DMGAAITGSSR

SEQ ID NO: 241672 - protein, 11 aa, Japanese encephalitis virus
MGAAITGSSRR

SEQ ID NO: 241673 - protein, 11 aa, Japanese encephalitis virus
GAAITGSSRRL

SEQ ID NO: 241674 - protein, 11 aa, Japanese encephalitis virus
VKLDDDGDFHF

SEQ ID NO: 241675 - protein, 11 aa, Japanese encephalitis virus
KLDDDGDFHFI

SEQ ID NO: 241676 - protein, 11 aa, Japanese encephalitis virus
LDDDGDFHFID

SEQ ID NO: 241677 - protein, 11 aa, Japanese encephalitis virus
DDDGDFHFIDD

SEQ ID NO: 241678 - protein, 11 aa, Japanese encephalitis virus
DDGDFHFIDDP

SEQ ID NO: 241679 - protein, 11 aa, Japanese encephalitis virus
DGDFHLIDVPG

SEQ ID NO: 241680 - protein, 11 aa, Japanese encephalitis virus
GDFHFIDDPGV

SEQ ID NO: 241681 - protein, 11 aa, Japanese encephalitis virus
DFHFIDDPGVP

SEQ ID NO: 241682 - protein, 11 aa, Japanese encephalitis virus
FHLIDVPGVPW

SEQ ID NO: 241683 - protein, 11 aa, Japanese encephalitis virus
HLIDVPGVPWK

SEQ ID NO: 241684 - protein, 11 aa, Japanese encephalitis virus
LIDVPGVPWKV

SEQ ID NO: 241685 - protein, 11 aa, Japanese encephalitis virus
IDDPGVPWKIW

SEQ ID NO: 241686 - protein, 11 aa, Japanese encephalitis virus
DDPGVPWKIWL

SEQ ID NO: 241687 - protein, 11 aa, Japanese encephalitis virus
VPGVPWKVWVL

SEQ ID NO: 241688 - protein, 11 aa, Japanese encephalitis virus
PGVPWKIWLLR

SEQ ID NO: 241689 - protein, 11 aa, Japanese encephalitis virus
GVPWKIWLLRM

SEQ ID NO: 241690 - protein, 11 aa, Japanese encephalitis virus
VPWKVWVLRTS

SEQ ID NO: 241691 - protein, 11 aa, Japanese encephalitis virus
PWKVWVLRTSC

SEQ ID NO: 241692 - protein, 11 aa, Japanese encephalitis virus
WKVWVLRTSCI

SEQ ID NO: 241693 - protein, 11 aa, Japanese encephalitis virus
LRMSCICLAAL

SEQ ID NO: 241694 - protein, 11 aa, Japanese encephalitis virus
RTSCIGLAALT

SEQ ID NO: 241695 - protein, 11 aa, Japanese encephalitis virus
MSCICLAALTP

SEQ ID NO: 241696 - protein, 11 aa, Japanese encephalitis virus
SCSGLAALTPW

SEQ ID NO: 241697 - protein, 11 aa, Japanese encephalitis virus
CIGLVALTPWA

SEQ ID NO: 241698 - protein, 11 aa, Japanese encephalitis virus
IGLVALTPWAI

SEQ ID NO: 241699 - protein, 11 aa, Japanese encephalitis virus
GLVALTPWAIV

SEQ ID NO: 241700 - protein, 11 aa, Japanese encephalitis virus
FWDTPSPKPCA

SEQ ID NO: 241701 - protein, 11 aa, Japanese encephalitis virus
WDTPSPKPCAK

SEQ ID NO: 241702 - protein, 11 aa, Japanese encephalitis virus
DTPSPKPCAKG

SEQ ID NO: 241703 - protein, 11 aa, Japanese encephalitis virus
TPSPKPCAKGD

SEQ ID NO: 241704 - protein, 11 aa, Japanese encephalitis virus
PSPKPCAKGDT

SEQ ID NO: 241705 - protein, 11 aa, Japanese encephalitis virus
SPKPCAKGDTT

SEQ ID NO: 241706 - protein, 11 aa, Japanese encephalitis virus
PKPCAKGDTTT

SEQ ID NO: 241707 - protein, 11 aa, Japanese encephalitis virus
KPCAKGDTTTG

SEQ ID NO: 241708 - protein, 11 aa, Japanese encephalitis virus
PCAKGDTTTGV

SEQ ID NO: 241709 - protein, 11 aa, Japanese encephalitis virus
CAKGDTTTGVY

SEQ ID NO: 241710 - protein, 11 aa, Japanese encephalitis virus
AKGDTTTGVYR

SEQ ID NO: 241711 - protein, 11 aa, Japanese encephalitis virus
GVYRIMACGIL

SEQ ID NO: 241712 - protein, 11 aa, Japanese encephalitis virus
VYRIMACGILG

SEQ ID NO: 241713 - protein, 11 aa, Japanese encephalitis virus
YRIMACGILGT

SEQ ID NO: 241714 - protein, 11 aa, Japanese encephalitis virus
RIMACGILGTY

SEQ ID NO: 241715 - protein, 11 aa, Japanese encephalitis virus
IMACGILGTYQ

SEQ ID NO: 241716 - protein, 11 aa, Japanese encephalitis virus
MACGILGTYQS

SEQ ID NO: 241717 - protein, 11 aa, Japanese encephalitis virus
ARGIFGTHQAG

SEQ ID NO: 241718 - protein, 11 aa, Japanese encephalitis virus
CGILGTYQSGV

SEQ ID NO: 241719 - protein, 11 aa, Japanese encephalitis virus
GIFGTHQAGVG

SEQ ID NO: 241720 - protein, 11 aa, Japanese encephalitis virus
IFGTHQAGVGV

SEQ ID NO: 241721 - protein, 11 aa, Japanese encephalitis virus
FGTHQAGVGVM

SEQ ID NO: 241722 - protein, 11 aa, Japanese encephalitis virus
GTYQSGVGVIY

SEQ ID NO: 241723 - protein, 11 aa, Japanese encephalitis virus
TYQAGVGVMYQ

SEQ ID NO: 241724 - protein, 11 aa, Japanese encephalitis virus
YQAGVGVMYES

SEQ ID NO: 241725 - protein, 11 aa, Japanese encephalitis virus
QAGVGVMYQNV

SEQ ID NO: 241726 - protein, 11 aa, Japanese encephalitis virus
AGVGVMYESVF

SEQ ID NO: 241727 - protein, 11 aa, Japanese encephalitis virus
GVGVIYENVFH

SEQ ID NO: 241728 - protein, 11 aa, Japanese encephalitis virus
VGVMYESVFHT

SEQ ID NO: 241729 - protein, 11 aa, Japanese encephalitis virus
GVMYQNVFHTL

SEQ ID NO: 241730 - protein, 11 aa, Japanese encephalitis virus
VMYENVLHTLW

SEQ ID NO: 241731 - protein, 11 aa, Japanese encephalitis virus
MYESVFHTLWH

SEQ ID NO: 241732 - protein, 11 aa, Japanese encephalitis virus
YQNVFHTLWHT

SEQ ID NO: 241733 - protein, 11 aa, Japanese encephalitis virus
ENVLHTLWHTT

SEQ ID NO: 241734 - protein, 11 aa, Japanese encephalitis virus
NVFHTLWHPTR

SEQ ID NO: 241735 - protein, 11 aa, Japanese encephalitis virus
VFHTLWHPTRG

SEQ ID NO: 241736 - protein, 11 aa, Japanese encephalitis virus
FHTLWHPTRGA

SEQ ID NO: 241737 - protein, 11 aa, Japanese encephalitis virus
TLWHPTRGAAI

SEQ ID NO: 241738 - protein, 11 aa, Japanese encephalitis virus
LWHTTRGAAVM

SEQ ID NO: 241739 - protein, 11 aa, Japanese encephalitis virus
WHTTRGAAVMS

SEQ ID NO: 241740 - protein, 11 aa, Japanese encephalitis virus
HTTRGAAVMSG

SEQ ID NO: 241741 - protein, 11 aa, Japanese encephalitis virus
TRGAAVMSGEG

SEQ ID NO: 241742 - protein, 11 aa, Japanese encephalitis virus
RGAAVMSGEGK

SEQ ID NO: 241743 - protein, 11 aa, Japanese encephalitis virus
GAAVMSGEGKL

SEQ ID NO: 241744 - protein, 11 aa, Japanese encephalitis virus
AAVMSGEGKLT

SEQ ID NO: 241745 - protein, 11 aa, Japanese encephalitis virus
AVMSGEGKLTP

SEQ ID NO: 241746 - protein, 11 aa, Japanese encephalitis virus
VMSGEGKLTPY

SEQ ID NO: 241747 - protein, 11 aa, Japanese encephalitis virus
MSGGGKLTPYW

SEQ ID NO: 241748 - protein, 11 aa, Japanese encephalitis virus
SGKGKLTPYWG

SEQ ID NO: 241749 - protein, 11 aa, Japanese encephalitis virus
GKGKLTPYWGS

SEQ ID NO: 241750 - protein, 11 aa, Japanese encephalitis virus
KGKLTPYWGSV

SEQ ID NO: 241751 - protein, 11 aa, Japanese encephalitis virus
YWGSVREDRIA

SEQ ID NO: 241752 - protein, 11 aa, Japanese encephalitis virus
WGSVREDRIAY

SEQ ID NO: 241753 - protein, 11 aa, Japanese encephalitis virus
GSVREDRIAYG

SEQ ID NO: 241754 - protein, 11 aa, Japanese encephalitis virus
SVREDRIAYGG

SEQ ID NO: 241755 - protein, 11 aa, Japanese encephalitis virus
VREDRIAYGGP

SEQ ID NO: 241756 - protein, 11 aa, Japanese encephalitis virus
REDRIAYGGPW

SEQ ID NO: 241757 - protein, 11 aa, Japanese encephalitis virus
TNDVQVIVVEP

SEQ ID NO: 241758 - protein, 11 aa, Japanese encephalitis virus
NDVQVIVVEPG

SEQ ID NO: 241759 - protein, 11 aa, Japanese encephalitis virus
VQVIVVEPGKG

SEQ ID NO: 241760 - protein, 11 aa, Japanese encephalitis virus
QVIVVEPGKGA

SEQ ID NO: 241761 - protein, 11 aa, Japanese encephalitis virus
IQTKPGIFPTP

SEQ ID NO: 241762 - protein, 11 aa, Japanese encephalitis virus
QTKPGIFPPPF

SEQ ID NO: 241763 - protein, 11 aa, Japanese encephalitis virus
TKPGVFCTPFG

SEQ ID NO: 241764 - protein, 11 aa, Japanese encephalitis virus
PFGKVGTVSLD

SEQ ID NO: 241765 - protein, 11 aa, Japanese encephalitis virus
FGKVGAVSLDY

SEQ ID NO: 241766 - protein, 11 aa, Japanese encephalitis virus
GKVGAVSLDYP

SEQ ID NO: 241767 - protein, 11 aa, Japanese encephalitis virus
KVGTVSLDYPR

SEQ ID NO: 241768 - protein, 11 aa, Japanese encephalitis virus
VGTVSLDYPRG

SEQ ID NO: 241769 - protein, 11 aa, Japanese encephalitis virus
RGTSGSPILNS

SEQ ID NO: 241770 - protein, 11 aa, Japanese encephalitis virus
GTSGSPILDFN

SEQ ID NO: 241771 - protein, 11 aa, Japanese encephalitis virus
TSGSPILNSNG

SEQ ID NO: 241772 - protein, 11 aa, Japanese encephalitis virus
SGSPILNSNGD

SEQ ID NO: 241773 - protein, 11 aa, Japanese encephalitis virus
GSPILDFNGDI

SEQ ID NO: 241774 - protein, 11 aa, Japanese encephalitis virus
SPILDFNGDII

SEQ ID NO: 241775 - protein, 11 aa, Japanese encephalitis virus
PILNSNGDVVG

SEQ ID NO: 241776 - protein, 11 aa, Japanese encephalitis virus
ILDFNGDIIGL

SEQ ID NO: 241777 - protein, 11 aa, Japanese encephalitis virus
LDFNGDIIGLY

SEQ ID NO: 241778 - protein, 11 aa, Japanese encephalitis virus
NSNGDVVGCLG

SEQ ID NO: 241779 - protein, 11 aa, Japanese encephalitis virus
FNGDIIGLYGN

SEQ ID NO: 241780 - protein, 11 aa, Japanese encephalitis virus
GDIIGLYGNGG

SEQ ID NO: 241781 - protein, 11 aa, Japanese encephalitis virus
DIIGLYGNGGE

SEQ ID NO: 241782 - protein, 11 aa, Japanese encephalitis virus
IIGLYGNGGEL

SEQ ID NO: 241783 - protein, 11 aa, Japanese encephalitis virus
IGLYGNGGELG

SEQ ID NO: 241784 - protein, 11 aa, Japanese encephalitis virus
GCLGNGVELGD

SEQ ID NO: 241785 - protein, 11 aa, Japanese encephalitis virus
LYGNGVELGDR

SEQ ID NO: 241786 - protein, 11 aa, Japanese encephalitis virus
YGNGGELGDGS

SEQ ID NO: 241787 - protein, 11 aa, Japanese encephalitis virus
GNGGELGDGSY

SEQ ID NO: 241788 - protein, 11 aa, Japanese encephalitis virus
NGVELGDRSYV

SEQ ID NO: 241789 - protein, 11 aa, Japanese encephalitis virus
GGELGDGSYVS

SEQ ID NO: 241790 - protein, 11 aa, Japanese encephalitis virus
VELGDRSYVSA

SEQ ID NO: 241791 - protein, 11 aa, Japanese encephalitis virus
RSYVSAIVQGD

SEQ ID NO: 241792 - protein, 11 aa, Japanese encephalitis virus
IVQGDRQEEPI

SEQ ID NO: 241793 - protein, 11 aa, Japanese encephalitis virus
VQGDRQEEPIP

SEQ ID NO: 241794 - protein, 11 aa, Japanese encephalitis virus
QGERQEEPVPE

SEQ ID NO: 241795 - protein, 11 aa, Japanese encephalitis virus
GERQEEPVPEA

SEQ ID NO: 241796 - protein, 11 aa, Japanese encephalitis virus
ERQEEPVPEAY

SEQ ID NO: 241797 - protein, 11 aa, Japanese encephalitis virus
RQEEPIPEAYN

SEQ ID NO: 241798 - protein, 11 aa, Japanese encephalitis virus
QEEPIPEAYNP

SEQ ID NO: 241799 - protein, 11 aa, Japanese encephalitis virus
EEPVPEAYTPT

SEQ ID NO: 241800 - protein, 11 aa, Japanese encephalitis virus
EPVPEAYTPSM

SEQ ID NO: 241801 - protein, 11 aa, Japanese encephalitis virus
PVPEAYTPTML

SEQ ID NO: 241802 - protein, 11 aa, Japanese encephalitis virus
MLRKRQLTVLD

SEQ ID NO: 241803 - protein, 11 aa, Japanese encephalitis virus
LRKRQLTVLDL

SEQ ID NO: 241804 - protein, 11 aa, Japanese encephalitis virus
RKRQLTVLDLH

SEQ ID NO: 241805 - protein, 11 aa, Japanese encephalitis virus
KKQMTVLDLPP

SEQ ID NO: 241806 - protein, 11 aa, Japanese encephalitis virus
KQMTVLDLPPG

SEQ ID NO: 241807 - protein, 11 aa, Japanese encephalitis virus
QLTVLDLHPGL

SEQ ID NO: 241808 - protein, 11 aa, Japanese encephalitis virus
LTVLDLHPGLG

SEQ ID NO: 241809 - protein, 11 aa, Japanese encephalitis virus
TVLDLPPGSGK

SEQ ID NO: 241810 - protein, 11 aa, Japanese encephalitis virus
VLDLHPGLGKT

SEQ ID NO: 241811 - protein, 11 aa, Japanese encephalitis virus
LDLPPGSGKTR

SEQ ID NO: 241812 - protein, 11 aa, Japanese encephalitis virus
DLHPGLGKTRK

SEQ ID NO: 241813 - protein, 11 aa, Japanese encephalitis virus
LHPGLGKTRKI

SEQ ID NO: 241814 - protein, 11 aa, Japanese encephalitis virus
HPGLGKTRKIL

SEQ ID NO: 241815 - protein, 11 aa, Japanese encephalitis virus
PGLGKTRKILP

SEQ ID NO: 241816 - protein, 11 aa, Japanese encephalitis virus
GLGKTRKILPQ

SEQ ID NO: 241817 - protein, 11 aa, Japanese encephalitis virus
SGKTRKILPQT

SEQ ID NO: 241818 - protein, 11 aa, Japanese encephalitis virus
GKTRKILPQTI

SEQ ID NO: 241819 - protein, 11 aa, Japanese encephalitis virus
KTRKILPQTIK

SEQ ID NO: 241820 - protein, 11 aa, Japanese encephalitis virus
TRKILPQTIKD

SEQ ID NO: 241821 - protein, 11 aa, Japanese encephalitis virus
RKILPQIIRDA

SEQ ID NO: 241822 - protein, 11 aa, Japanese encephalitis virus
KILPQTIKDAI

SEQ ID NO: 241823 - protein, 11 aa, Japanese encephalitis virus
ILPQTIKDAIQ

SEQ ID NO: 241824 - protein, 11 aa, Japanese encephalitis virus
LPQTIKDAIQQ

SEQ ID NO: 241825 - protein, 11 aa, Japanese encephalitis virus
PQTIKDAIQQR

SEQ ID NO: 241826 - protein, 11 aa, Japanese encephalitis virus
QIIRDAIQQRL

SEQ ID NO: 241827 - protein, 11 aa, Japanese encephalitis virus
IIKDAIQQRLK

SEQ ID NO: 241828 - protein, 11 aa, Japanese encephalitis virus
IKDAIQQRLKT

SEQ ID NO: 241829 - protein, 11 aa, Japanese encephalitis virus
KDAIQQRLKTA

SEQ ID NO: 241830 - protein, 11 aa, Japanese encephalitis virus
DAIQQHLRTAV

SEQ ID NO: 241831 - protein, 11 aa, Japanese encephalitis virus
AIQQRLKTAVL

SEQ ID NO: 241832 - protein, 11 aa, Japanese encephalitis virus
IQQRLKTAVLA

SEQ ID NO: 241833 - protein, 11 aa, Japanese encephalitis virus
QQHLRTAVLAP

SEQ ID NO: 241834 - protein, 11 aa, Japanese encephalitis virus
QRLKTAVLAPT

SEQ ID NO: 241835 - protein, 11 aa, Japanese encephalitis virus
HLRTAVLAPTR

SEQ ID NO: 241836 - protein, 11 aa, Japanese encephalitis virus
VVAAEMAEVLR

SEQ ID NO: 241837 - protein, 11 aa, Japanese encephalitis virus
VAAEMAEVLRG

SEQ ID NO: 241838 - protein, 11 aa, Japanese encephalitis virus
AAEMAEVLRGL

SEQ ID NO: 241839 - protein, 11 aa, Japanese encephalitis virus
AEMAEVLRGLP

SEQ ID NO: 241840 - protein, 11 aa, Japanese encephalitis virus
EMAEVLRGLPV

SEQ ID NO: 241841 - protein, 11 aa, Japanese encephalitis virus
MAEVLRGLPVR

SEQ ID NO: 241842 - protein, 11 aa, Japanese encephalitis virus
AEVLRGLPVRY

SEQ ID NO: 241843 - protein, 11 aa, Japanese encephalitis virus
EVLRGLPVRYQ

SEQ ID NO: 241844 - protein, 11 aa, Japanese encephalitis virus
VLRGLPVRYQT

SEQ ID NO: 241845 - protein, 11 aa, Japanese encephalitis virus
SAVQREHQGNA

SEQ ID NO: 241846 - protein, 11 aa, Japanese encephalitis virus
AVQRSHQGNEI

SEQ ID NO: 241847 - protein, 11 aa, Japanese encephalitis virus
VQREHQGNAIV

SEQ ID NO: 241848 - protein, 11 aa, Japanese encephalitis virus
QREHQGNAIVD

SEQ ID NO: 241849 - protein, 11 aa, Japanese encephalitis virus
REHQGNAIVDV

SEQ ID NO: 241850 - protein, 11 aa, Japanese encephalitis virus
EHQGNAIVDVM

SEQ ID NO: 241851 - protein, 11 aa, Japanese encephalitis virus
SDAPIHDLQDE

SEQ ID NO: 241852 - protein, 11 aa, Japanese encephalitis virus
NAPIHDLQDET

SEQ ID NO: 241853 - protein, 11 aa, Japanese encephalitis virus
APIHDLQDEVP

SEQ ID NO: 241854 - protein, 11 aa, Japanese encephalitis virus
PIHDLQDEVPD

SEQ ID NO: 241855 - protein, 11 aa, Japanese encephalitis virus
IHDLQDETPDR

SEQ ID NO: 241856 - protein, 11 aa, Japanese encephalitis virus
HDLQDEIPDWA

SEQ ID NO: 241857 - protein, 11 aa, Japanese encephalitis virus
DLQDEIPDWAW

SEQ ID NO: 241858 - protein, 11 aa, Japanese encephalitis virus
LQDETPDRAWS

SEQ ID NO: 241859 - protein, 11 aa, Japanese encephalitis virus
QDETPDRAWSS

SEQ ID NO: 241860 - protein, 11 aa, Japanese encephalitis virus
DEIPDWAWSSG

SEQ ID NO: 241861 - protein, 11 aa, Japanese encephalitis virus
WITEYSGKTVW

SEQ ID NO: 241862 - protein, 11 aa, Japanese encephalitis virus
ITEYSGKTVWF

SEQ ID NO: 241863 - protein, 11 aa, Japanese encephalitis virus
TEYSGKTVWFV

SEQ ID NO: 241864 - protein, 11 aa, Japanese encephalitis virus
EYSGKTVWFVA

SEQ ID NO: 241865 - protein, 11 aa, Japanese encephalitis virus
ASVKMGNEIAV

SEQ ID NO: 241866 - protein, 11 aa, Japanese encephalitis virus
SVKMGNEIAVC

SEQ ID NO: 241867 - protein, 11 aa, Japanese encephalitis virus
VKMGNEIAVCL

SEQ ID NO: 241868 - protein, 11 aa, Japanese encephalitis virus
KMGNEIAVCLQ

SEQ ID NO: 241869 - protein, 11 aa, Japanese encephalitis virus
IAMCLQRAGKR

SEQ ID NO: 241870 - protein, 11 aa, Japanese encephalitis virus
AMCLQRAGKRV

SEQ ID NO: 241871 - protein, 11 aa, Japanese encephalitis virus
MCLQRAGKRVI

SEQ ID NO: 241872 - protein, 11 aa, Japanese encephalitis virus
QRAGKKVIQLS

SEQ ID NO: 241873 - protein, 11 aa, Japanese encephalitis virus
RAGKRVIQLNR

SEQ ID NO: 241874 - protein, 11 aa, Japanese encephalitis virus
AGKRVIQLNRK

SEQ ID NO: 241875 - protein, 11 aa, Japanese encephalitis virus
GKKVIQLSRKS

SEQ ID NO: 241876 - protein, 11 aa, Japanese encephalitis virus
KRVIQLNRKSY

SEQ ID NO: 241877 - protein, 11 aa, Japanese encephalitis virus
KVIQLSRKSYD

SEQ ID NO: 241878 - protein, 11 aa, Japanese encephalitis virus
VIDCRKSVKPI

SEQ ID NO: 241879 - protein, 11 aa, Japanese encephalitis virus
IDCRKSVKPII

SEQ ID NO: 241880 - protein, 11 aa, Japanese encephalitis virus
DCRKSVEPTIL

SEQ ID NO: 241881 - protein, 11 aa, Japanese encephalitis virus
CRKSVKPIILE

SEQ ID NO: 241882 - protein, 11 aa, Japanese encephalitis virus
RKSVKPTILEK

SEQ ID NO: 241883 - protein, 11 aa, Japanese encephalitis virus
KSVKPTILEKE

SEQ ID NO: 241884 - protein, 11 aa, Japanese encephalitis virus
SVEPTILEEGE

SEQ ID NO: 241885 - protein, 11 aa, Japanese encephalitis virus
VKPIILEEGEG

SEQ ID NO: 241886 - protein, 11 aa, Japanese encephalitis virus
KPTILEKEEGR

SEQ ID NO: 241887 - protein, 11 aa, Japanese encephalitis virus
PTILEKEEGRV

SEQ ID NO: 241888 - protein, 11 aa, Japanese encephalitis virus
TILEEGEGRVF

SEQ ID NO: 241889 - protein, 11 aa, Japanese encephalitis virus
ILEEGEGRVFL

SEQ ID NO: 241890 - protein, 11 aa, Japanese encephalitis virus
LEEGEGRVFLG

SEQ ID NO: 241891 - protein, 11 aa, Japanese encephalitis virus
EKEEGRVILGN

SEQ ID NO: 241892 - protein, 11 aa, Japanese encephalitis virus
EGEGRVFLGNP

SEQ ID NO: 241893 - protein, 11 aa, Japanese encephalitis virus
GEGRVFLGNPS

SEQ ID NO: 241894 - protein, 11 aa, Japanese encephalitis virus
VILGNPSPITN

SEQ ID NO: 241895 - protein, 11 aa, Japanese encephalitis virus
FLGNPSPITSA

SEQ ID NO: 241896 - protein, 11 aa, Japanese encephalitis virus
QRRGRVSRNPN

SEQ ID NO: 241897 - protein, 11 aa, Japanese encephalitis virus
RRGRVSRNPNQ

SEQ ID NO: 241898 - protein, 11 aa, Japanese encephalitis virus
RGRVGRNPSQV

SEQ ID NO: 241899 - protein, 11 aa, Japanese encephalitis virus
GRVGRNPSQVG

SEQ ID NO: 241900 - protein, 11 aa, Japanese encephalitis virus
RVGRNPSQVGD

SEQ ID NO: 241901 - protein, 11 aa, Japanese encephalitis virus
VSRNPNQVGDE

SEQ ID NO: 241902 - protein, 11 aa, Japanese encephalitis virus
SRNPNQVGDEY

SEQ ID NO: 241903 - protein, 11 aa, Japanese encephalitis virus
RNPSQVGDEYH

SEQ ID NO: 241904 - protein, 11 aa, Japanese encephalitis virus
NPNQVGDEYEY

SEQ ID NO: 241905 - protein, 11 aa, Japanese encephalitis virus
PNQVGDEYEYG

SEQ ID NO: 241906 - protein, 11 aa, Japanese encephalitis virus
SQVGDEYHYGG

SEQ ID NO: 241907 - protein, 11 aa, Japanese encephalitis virus
QVGDEYEYGGA

SEQ ID NO: 241908 - protein, 11 aa, Japanese encephalitis virus
VGDEYHYGGPT

SEQ ID NO: 241909 - protein, 11 aa, Japanese encephalitis virus
GDEYEYGGATS

SEQ ID NO: 241910 - protein, 11 aa, Japanese encephalitis virus
DEYHYGGPTSE

SEQ ID NO: 241911 - protein, 11 aa, Japanese encephalitis virus
EYEYGGATSED

SEQ ID NO: 241912 - protein, 11 aa, Japanese encephalitis virus
YHYGGATSEGD

SEQ ID NO: 241913 - protein, 11 aa, Japanese encephalitis virus
HYGGPTSEDDS

SEQ ID NO: 241914 - protein, 11 aa, Japanese encephalitis virus
YGGATSEDDGN

SEQ ID NO: 241915 - protein, 11 aa, Japanese encephalitis virus
GGATSEDDGNL

SEQ ID NO: 241916 - protein, 11 aa, Japanese encephalitis virus
GATSEGDSNLA

SEQ ID NO: 241917 - protein, 11 aa, Japanese encephalitis virus
ATSEGDSNLAH

SEQ ID NO: 241918 - protein, 11 aa, Japanese encephalitis virus
TSEDDGNLAHW

SEQ ID NO: 241919 - protein, 11 aa, Japanese encephalitis virus
SEDDGNLAHWT

SEQ ID NO: 241920 - protein, 11 aa, Japanese encephalitis virus
EGDSNLAHWTE

SEQ ID NO: 241921 - protein, 11 aa, Japanese encephalitis virus
DDGNLAHWTEA

SEQ ID NO: 241922 - protein, 11 aa, Japanese encephalitis virus
QLYGPEREKAL

SEQ ID NO: 241923 - protein, 11 aa, Japanese encephalitis virus
LYGPEREKALT

SEQ ID NO: 241924 - protein, 11 aa, Japanese encephalitis virus
YGPEREKALTM

SEQ ID NO: 241925 - protein, 11 aa, Japanese encephalitis virus
GPEREKALTMD

SEQ ID NO: 241926 - protein, 11 aa, Japanese encephalitis virus
PEREKALTMDG

SEQ ID NO: 241927 - protein, 11 aa, Japanese encephalitis virus
EREKALTMDGE

SEQ ID NO: 241928 - protein, 11 aa, Japanese encephalitis virus
REKAFTMDVEY

SEQ ID NO: 241929 - protein, 11 aa, Japanese encephalitis virus
EKAFTMDVEYR

SEQ ID NO: 241930 - protein, 11 aa, Japanese encephalitis virus
KALTMDGEYRL

SEQ ID NO: 241931 - protein, 11 aa, Japanese encephalitis virus
ALTMDGEYRLR

SEQ ID NO: 241932 - protein, 11 aa, Japanese encephalitis virus
LTMDGEYRLRG

SEQ ID NO: 241933 - protein, 11 aa, Japanese encephalitis virus
LPVWLAYRVAS

SEQ ID NO: 241934 - protein, 11 aa, Japanese encephalitis virus
PVWLAYKVAPN

SEQ ID NO: 241935 - protein, 11 aa, Japanese encephalitis virus
VWLAYKVAPNG

SEQ ID NO: 241936 - protein, 11 aa, Japanese encephalitis virus
WLAYRVASNGI

SEQ ID NO: 241937 - protein, 11 aa, Japanese encephalitis virus
LAYRVASNGIQ

SEQ ID NO: 241938 - protein, 11 aa, Japanese encephalitis virus
AYKVAPNGIQY

SEQ ID NO: 241939 - protein, 11 aa, Japanese encephalitis virus
YKVAPNGIQYT

SEQ ID NO: 241940 - protein, 11 aa, Japanese encephalitis virus
KVAPNGIQYTD

SEQ ID NO: 241941 - protein, 11 aa, Japanese encephalitis virus
APNGIQYTDRK

SEQ ID NO: 241942 - protein, 11 aa, Japanese encephalitis virus
PNGIQYTDRKW

SEQ ID NO: 241943 - protein, 11 aa, Japanese encephalitis virus
PRTNAILEDST

SEQ ID NO: 241944 - protein, 11 aa, Japanese encephalitis virus
RTNAILEDSTE

SEQ ID NO: 241945 - protein, 11 aa, Japanese encephalitis virus
TNAILEDSTEV

SEQ ID NO: 241946 - protein, 11 aa, Japanese encephalitis virus
NAILEDSTEVE

SEQ ID NO: 241947 - protein, 11 aa, Japanese encephalitis virus
AILEDSTEVEI

SEQ ID NO: 241948 - protein, 11 aa, Japanese encephalitis virus
ILEDSTEVEIV

SEQ ID NO: 241949 - protein, 11 aa, Japanese encephalitis virus
LEDSTEVEIVT

SEQ ID NO: 241950 - protein, 11 aa, Japanese encephalitis virus
EDSTEVEIVTR

SEQ ID NO: 241951 - protein, 11 aa, Japanese encephalitis virus
DSTEVEIVTRM

SEQ ID NO: 241952 - protein, 11 aa, Japanese encephalitis virus
NTEVEIVTRTG

SEQ ID NO: 241953 - protein, 11 aa, Japanese encephalitis virus
TEVEIVTRTGE

SEQ ID NO: 241954 - protein, 11 aa, Japanese encephalitis virus
ERKILKPRWLY

SEQ ID NO: 241955 - protein, 11 aa, Japanese encephalitis virus
RKVLKPRWLDA

SEQ ID NO: 241956 - protein, 11 aa, Japanese encephalitis virus
KVLKPRWLDAR

SEQ ID NO: 241957 - protein, 11 aa, Japanese encephalitis virus
VLKPRWLDARV

SEQ ID NO: 241958 - protein, 11 aa, Japanese encephalitis virus
KDFASGKRSAV

SEQ ID NO: 241959 - protein, 11 aa, Japanese encephalitis virus
DFASGKRSAVS

SEQ ID NO: 241960 - protein, 11 aa, Japanese encephalitis virus
FAAGKRSATSF

SEQ ID NO: 241961 - protein, 11 aa, Japanese encephalitis virus
AAGKRSATSFI

SEQ ID NO: 241962 - protein, 11 aa, Japanese encephalitis virus
AGKRSATSFIE

SEQ ID NO: 241963 - protein, 11 aa, Japanese encephalitis virus
GKRSAVSFIEE

SEQ ID NO: 241964 - protein, 11 aa, Japanese encephalitis virus
KRSATSFIEVL

SEQ ID NO: 241965 - protein, 11 aa, Japanese encephalitis virus
RSATSFIEVLG

SEQ ID NO: 241966 - protein, 11 aa, Japanese encephalitis virus
SAVSFIEEPGR

SEQ ID NO: 241967 - protein, 11 aa, Japanese encephalitis virus
AISFIEVRGRM

SEQ ID NO: 241968 - protein, 11 aa, Japanese encephalitis virus
ISFIEVRGRMP

SEQ ID NO: 241969 - protein, 11 aa, Japanese encephalitis virus
SFIEVRGRMPE

SEQ ID NO: 241970 - protein, 11 aa, Japanese encephalitis virus
FIEVRGRMPEH

SEQ ID NO: 241971 - protein, 11 aa, Japanese encephalitis virus
IEEPGRMPEHF

SEQ ID NO: 241972 - protein, 11 aa, Japanese encephalitis virus
EVRGRMPEHFM

SEQ ID NO: 241973 - protein, 11 aa, Japanese encephalitis virus
VLGRMPEHFAG

SEQ ID NO: 241974 - protein, 11 aa, Japanese encephalitis virus
LGRMPEHFAGK

SEQ ID NO: 241975 - protein, 11 aa, Japanese encephalitis virus
TMYLVATAEKS

SEQ ID NO: 241976 - protein, 11 aa, Japanese encephalitis virus
MYLVATAEKSG

SEQ ID NO: 241977 - protein, 11 aa, Japanese encephalitis virus
YLVATAEKSGK

SEQ ID NO: 241978 - protein, 11 aa, Japanese encephalitis virus
LVATAEKGGKT

SEQ ID NO: 241979 - protein, 11 aa, Japanese encephalitis virus
VATAEKSGKAH

SEQ ID NO: 241980 - protein, 11 aa, Japanese encephalitis virus
ATAEKSGKAHR

SEQ ID NO: 241981 - protein, 11 aa, Japanese encephalitis virus
TAEKGGKTHRM

SEQ ID NO: 241982 - protein, 11 aa, Japanese encephalitis virus
AEKSGKAHRMA

SEQ ID NO: 241983 - protein, 11 aa, Japanese encephalitis virus
EKGGKTHRMAL

SEQ ID NO: 241984 - protein, 11 aa, Japanese encephalitis virus
KGGKTHRMALE

SEQ ID NO: 241985 - protein, 11 aa, Japanese encephalitis virus
SGKAHRMALEE

SEQ ID NO: 241986 - protein, 11 aa, Japanese encephalitis virus
LPDALETVTLI

SEQ ID NO: 241987 - protein, 11 aa, Japanese encephalitis virus
PDALETVTLIV

SEQ ID NO: 241988 - protein, 11 aa, Japanese encephalitis virus
DALETITLTVA

SEQ ID NO: 241989 - protein, 11 aa, Japanese encephalitis virus
ALETITLTVAI

SEQ ID NO: 241990 - protein, 11 aa, Japanese encephalitis virus
AITVMTRGFFL

SEQ ID NO: 241991 - protein, 11 aa, Japanese encephalitis virus
IAVMTGGFFLL

SEQ ID NO: 241992 - protein, 11 aa, Japanese encephalitis virus
TAMTGGFFLLM

SEQ ID NO: 241993 - protein, 11 aa, Japanese encephalitis virus
VMTRGFFLLMM

SEQ ID NO: 241994 - protein, 11 aa, Japanese encephalitis virus
MTGGFFLLMKQ

SEQ ID NO: 241995 - protein, 11 aa, Japanese encephalitis virus
TGGFFLLMKQR

SEQ ID NO: 241996 - protein, 11 aa, Japanese encephalitis virus
RGFFLLMMQRK

SEQ ID NO: 241997 - protein, 11 aa, Japanese encephalitis virus
FLLMKQRKGIG

SEQ ID NO: 241998 - protein, 11 aa, Japanese encephalitis virus
LLMMQRKGIEK

SEQ ID NO: 241999 - protein, 11 aa, Japanese encephalitis virus
LMMQRKGIEKM

SEQ ID NO: 242000 - protein, 11 aa, Japanese encephalitis virus
MMQRKGIEKMG

SEQ ID NO: 242001 - protein, 11 aa, Japanese encephalitis virus
MQRKGIEKMGL

SEQ ID NO: 242002 - protein, 11 aa, Japanese encephalitis virus
QRKGIEKMGLG

SEQ ID NO: 242003 - protein, 11 aa, Japanese encephalitis virus
RKGIEKMGLGA

SEQ ID NO: 242004 - protein, 11 aa, Japanese encephalitis virus
KGIEKMGLGAL

SEQ ID NO: 242005 - protein, 11 aa, Japanese encephalitis virus
GIEKMGLGALV

SEQ ID NO: 242006 - protein, 11 aa, Japanese encephalitis virus
IEKMGLGALVL

SEQ ID NO: 242007 - protein, 11 aa, Japanese encephalitis virus
GKMGLGALVLV

SEQ ID NO: 242008 - protein, 11 aa, Japanese encephalitis virus
KMGLGALVLVL

SEQ ID NO: 242009 - protein, 11 aa, Japanese encephalitis virus
SGTKIAGTLLI

SEQ ID NO: 242010 - protein, 11 aa, Japanese encephalitis virus
VVLIPEPEKQK

SEQ ID NO: 242011 - protein, 11 aa, Japanese encephalitis virus
VLIPEPEKQKS

SEQ ID NO: 242012 - protein, 11 aa, Japanese encephalitis virus
LIPEPEKQRLQ

SEQ ID NO: 242013 - protein, 11 aa, Japanese encephalitis virus
IPEPEKQRLQT

SEQ ID NO: 242014 - protein, 11 aa, Japanese encephalitis virus
PEPEKQKSQTD

SEQ ID NO: 242015 - protein, 11 aa, Japanese encephalitis virus
EPEKQRLQTDN

SEQ ID NO: 242016 - protein, 11 aa, Japanese encephalitis virus
PEKQRLQTDNQ

SEQ ID NO: 242017 - protein, 11 aa, Japanese encephalitis virus
EKQRLQTDNQL

SEQ ID NO: 242018 - protein, 11 aa, Japanese encephalitis virus
KQRLQTDNQLA

SEQ ID NO: 242019 - protein, 11 aa, Japanese encephalitis virus
QRSQTGNQLAV

SEQ ID NO: 242020 - protein, 11 aa, Japanese encephalitis virus
RLQTDNQLAVF

SEQ ID NO: 242021 - protein, 11 aa, Japanese encephalitis virus
SQTGNQLAVFL

SEQ ID NO: 242022 - protein, 11 aa, Japanese encephalitis virus
LICVLTVVGVA

SEQ ID NO: 242023 - protein, 11 aa, Japanese encephalitis virus
ICVLTVVGVAA

SEQ ID NO: 242024 - protein, 11 aa, Japanese encephalitis virus
CVLTVVGMVAA

SEQ ID NO: 242025 - protein, 11 aa, Japanese encephalitis virus
VLTVVGMVAAN

SEQ ID NO: 242026 - protein, 11 aa, Japanese encephalitis virus
LTVVGVAAANE

SEQ ID NO: 242027 - protein, 11 aa, Japanese encephalitis virus
TVVGMVAANEY

SEQ ID NO: 242028 - protein, 11 aa, Japanese encephalitis virus
VVGVAAANEYG

SEQ ID NO: 242029 - protein, 11 aa, Japanese encephalitis virus
VGMVAANEYGM

SEQ ID NO: 242030 - protein, 11 aa, Japanese encephalitis virus
GVAAANEYGML

SEQ ID NO: 242031 - protein, 11 aa, Japanese encephalitis virus
VAAANEYGMLE

SEQ ID NO: 242032 - protein, 11 aa, Japanese encephalitis virus
VAANEYGMLER

SEQ ID NO: 242033 - protein, 11 aa, Japanese encephalitis virus
YGMLEKTKADI

SEQ ID NO: 242034 - protein, 11 aa, Japanese encephalitis virus
GMLEKTKADIK

SEQ ID NO: 242035 - protein, 11 aa, Japanese encephalitis virus
MLERTKADLKS

SEQ ID NO: 242036 - protein, 11 aa, Japanese encephalitis virus
LERTKADLKSM

SEQ ID NO: 242037 - protein, 11 aa, Japanese encephalitis virus
ERTKADLKSMF

SEQ ID NO: 242038 - protein, 11 aa, Japanese encephalitis virus
KTKADLKSMFV

SEQ ID NO: 242039 - protein, 11 aa, Japanese encephalitis virus
TKADLKSMFVG

SEQ ID NO: 242040 - protein, 11 aa, Japanese encephalitis virus
KADLKSMFAGK

SEQ ID NO: 242041 - protein, 11 aa, Japanese encephalitis virus
APVSGMTGLPG

SEQ ID NO: 242042 - protein, 11 aa, Japanese encephalitis virus
PVSGMTGLPGM

SEQ ID NO: 242043 - protein, 11 aa, Japanese encephalitis virus
GLTGLPSMTLD

SEQ ID NO: 242044 - protein, 11 aa, Japanese encephalitis virus
MTGLPGMALDL

SEQ ID NO: 242045 - protein, 11 aa, Japanese encephalitis virus
TGLPSVALDLR

SEQ ID NO: 242046 - protein, 11 aa, Japanese encephalitis virus
GLPSVALDLRP

SEQ ID NO: 242047 - protein, 11 aa, Japanese encephalitis virus
LPSMTLDLRPA

SEQ ID NO: 242048 - protein, 11 aa, Japanese encephalitis virus
PSMTLDLRPAT

SEQ ID NO: 242049 - protein, 11 aa, Japanese encephalitis virus
SVALDLRPATA

SEQ ID NO: 242050 - protein, 11 aa, Japanese encephalitis virus
MTLDLRPATAW

SEQ ID NO: 242051 - protein, 11 aa, Japanese encephalitis virus
KHIITSEYVTT

SEQ ID NO: 242052 - protein, 11 aa, Japanese encephalitis virus
HLITSEYVTPS

SEQ ID NO: 242053 - protein, 11 aa, Japanese encephalitis virus
LITSEYVTPSL

SEQ ID NO: 242054 - protein, 11 aa, Japanese encephalitis virus
EYVTPSLASIS

SEQ ID NO: 242055 - protein, 11 aa, Japanese encephalitis virus
YVTPSLASISS

SEQ ID NO: 242056 - protein, 11 aa, Japanese encephalitis virus
VTPSLASISSQ

SEQ ID NO: 242057 - protein, 11 aa, Japanese encephalitis virus
TPSLASISSQA

SEQ ID NO: 242058 - protein, 11 aa, Japanese encephalitis virus
PSLASISSQAG

SEQ ID NO: 242059 - protein, 11 aa, Japanese encephalitis virus
GLVLLGCWGQI

SEQ ID NO: 242060 - protein, 11 aa, Japanese encephalitis virus
LVLLGCWGQIT

SEQ ID NO: 242061 - protein, 11 aa, Japanese encephalitis virus
VLLGCWGQITL

SEQ ID NO: 242062 - protein, 11 aa, Japanese encephalitis virus
LLGCWGQITLT

SEQ ID NO: 242063 - protein, 11 aa, Japanese encephalitis virus
GCWGQITLTTS

SEQ ID NO: 242064 - protein, 11 aa, Japanese encephalitis virus
CWGQITLTTSL

SEQ ID NO: 242065 - protein, 11 aa, Japanese encephalitis virus
WGQITLTTSLT

SEQ ID NO: 242066 - protein, 11 aa, Japanese encephalitis virus
GQITLTTSLTA

SEQ ID NO: 242067 - protein, 11 aa, Japanese encephalitis virus
QVTLTTFLTAM

SEQ ID NO: 242068 - protein, 11 aa, Japanese encephalitis virus
VTLTTFLTAMV

SEQ ID NO: 242069 - protein, 11 aa, Japanese encephalitis virus
TLTTSLTAMVL

SEQ ID NO: 242070 - protein, 11 aa, Japanese encephalitis virus
LTAVVLATLHY

SEQ ID NO: 242071 - protein, 11 aa, Japanese encephalitis virus
TAVVLATLHYG

SEQ ID NO: 242072 - protein, 11 aa, Japanese encephalitis virus
VLTTLHYGYML

SEQ ID NO: 242073 - protein, 11 aa, Japanese encephalitis virus
LAILHYGYMLP

SEQ ID NO: 242074 - protein, 11 aa, Japanese encephalitis virus
TTLHYGYMLPG

SEQ ID NO: 242075 - protein, 11 aa, Japanese encephalitis virus
ILHYGYMLPGW

SEQ ID NO: 242076 - protein, 11 aa, Japanese encephalitis virus
VLLIGGSVAAF

SEQ ID NO: 242077 - protein, 11 aa, Japanese encephalitis virus
LLIGGSVAAFL

SEQ ID NO: 242078 - protein, 11 aa, Japanese encephalitis virus
LIGGSVAAFLV

SEQ ID NO: 242079 - protein, 11 aa, Japanese encephalitis virus
IGGSVAAFLVN

SEQ ID NO: 242080 - protein, 11 aa, Japanese encephalitis virus
GGSVAAFLVNP

SEQ ID NO: 242081 - protein, 11 aa, Japanese encephalitis virus
VSVAAFLVNPK

SEQ ID NO: 242082 - protein, 11 aa, Japanese encephalitis virus
SVAAFLVNPKI

SEQ ID NO: 242083 - protein, 11 aa, Japanese encephalitis virus
VAAFLVNPKIT

SEQ ID NO: 242084 - protein, 11 aa, Japanese encephalitis virus
AAFLVNPKITT

SEQ ID NO: 242085 - protein, 11 aa, Japanese encephalitis virus
AFLVNPKITTV

SEQ ID NO: 242086 - protein, 11 aa, Japanese encephalitis virus
FLVNPKITTVR

SEQ ID NO: 242087 - protein, 11 aa, Japanese encephalitis virus
LVNPKITTVRE

SEQ ID NO: 242088 - protein, 11 aa, Japanese encephalitis virus
VNPNVSTVRKA

SEQ ID NO: 242089 - protein, 11 aa, Japanese encephalitis virus
NPKITTVREAG

SEQ ID NO: 242090 - protein, 11 aa, Japanese encephalitis virus
PNVTTVKKPGV

SEQ ID NO: 242091 - protein, 11 aa, Japanese encephalitis virus
NVTTVKKPGVL

SEQ ID NO: 242092 - protein, 11 aa, Japanese encephalitis virus
VTTVKKPGVLV

SEQ ID NO: 242093 - protein, 11 aa, Japanese encephalitis virus
STVRKAGVLVT

SEQ ID NO: 242094 - protein, 11 aa, Japanese encephalitis virus
TVRKAGVLVTA

SEQ ID NO: 242095 - protein, 11 aa, Japanese encephalitis virus
VKKPGVLVTAA

SEQ ID NO: 242096 - protein, 11 aa, Japanese encephalitis virus
KKPGVLVTAAT

SEQ ID NO: 242097 - protein, 11 aa, Japanese encephalitis virus
KAGVLVTAATL

SEQ ID NO: 242098 - protein, 11 aa, Japanese encephalitis virus
PGVLVTAATLT

SEQ ID NO: 242099 - protein, 11 aa, Japanese encephalitis virus
GVLVTAATLSL

SEQ ID NO: 242100 - protein, 11 aa, Japanese encephalitis virus
VLVTAATLSLW

SEQ ID NO: 242101 - protein, 11 aa, Japanese encephalitis virus
LVTAATLSLWD

SEQ ID NO: 242102 - protein, 11 aa, Japanese encephalitis virus
VTAATLSLWDN

SEQ ID NO: 242103 - protein, 11 aa, Japanese encephalitis virus
TAATLSLWDNG

SEQ ID NO: 242104 - protein, 11 aa, Japanese encephalitis virus
AATLSLWDNGA

SEQ ID NO: 242105 - protein, 11 aa, Japanese encephalitis virus
ATLSLWDNGAS

SEQ ID NO: 242106 - protein, 11 aa, Japanese encephalitis virus
LTLWDNGASAA

SEQ ID NO: 242107 - protein, 11 aa, Japanese encephalitis virus
SLWDNGASAVW

SEQ ID NO: 242108 - protein, 11 aa, Japanese encephalitis virus
IAWTLIKNADN

SEQ ID NO: 242109 - protein, 11 aa, Japanese encephalitis virus
AWTLIKNANKP

SEQ ID NO: 242110 - protein, 11 aa, Japanese encephalitis virus
WTLIKNADNPS

SEQ ID NO: 242111 - protein, 11 aa, Japanese encephalitis virus
TLIKNADKPSF

SEQ ID NO: 242112 - protein, 11 aa, Japanese encephalitis virus
LIKNADKPSFK

SEQ ID NO: 242113 - protein, 11 aa, Japanese encephalitis virus
IKNADKPSLKK

SEQ ID NO: 242114 - protein, 11 aa, Japanese encephalitis virus
KNADNPSLKRG

SEQ ID NO: 242115 - protein, 11 aa, Japanese encephalitis virus
NANKPSLKRGR

SEQ ID NO: 242116 - protein, 11 aa, Japanese encephalitis virus
KPSLKKGRPGG

SEQ ID NO: 242117 - protein, 11 aa, Japanese encephalitis virus
PSLKKGRPGGR

SEQ ID NO: 242118 - protein, 11 aa, Japanese encephalitis virus
SLKKGRPGGRT

SEQ ID NO: 242119 - protein, 11 aa, Japanese encephalitis virus
LKKGRPGGRTL

SEQ ID NO: 242120 - protein, 11 aa, Japanese encephalitis virus
KKGRPGGRTLG

SEQ ID NO: 242121 - protein, 11 aa, Japanese encephalitis virus
RGRSGGRTLGE

SEQ ID NO: 242122 - protein, 11 aa, Japanese encephalitis virus
GGPGGRTLWEQ

SEQ ID NO: 242123 - protein, 11 aa, Japanese encephalitis virus
RPGGRTLGDQW

SEQ ID NO: 242124 - protein, 11 aa, Japanese encephalitis virus
PGGRTLGDQWK

SEQ ID NO: 242125 - protein, 11 aa, Japanese encephalitis virus
GGRTLGDQWKE

SEQ ID NO: 242126 - protein, 11 aa, Japanese encephalitis virus
GRTLGEQWKER

SEQ ID NO: 242127 - protein, 11 aa, Japanese encephalitis virus
RTLGDQWKEKL

SEQ ID NO: 242128 - protein, 11 aa, Japanese encephalitis virus
TLGEQWKRKLN

SEQ ID NO: 242129 - protein, 11 aa, Japanese encephalitis virus
LGEQWKRKLNA

SEQ ID NO: 242130 - protein, 11 aa, Japanese encephalitis virus
QWKEKLNAMGR

SEQ ID NO: 242131 - protein, 11 aa, Japanese encephalitis virus
KLNAMGRDEFF

SEQ ID NO: 242132 - protein, 11 aa, Japanese encephalitis virus
LNAMGRDEFFK

SEQ ID NO: 242133 - protein, 11 aa, Japanese encephalitis virus
NAMGRDEFFKY

SEQ ID NO: 242134 - protein, 11 aa, Japanese encephalitis virus
AMGRDEFFKYR

SEQ ID NO: 242135 - protein, 11 aa, Japanese encephalitis virus
MGRDEFFKYRR

SEQ ID NO: 242136 - protein, 11 aa, Japanese encephalitis virus
GRDEFFKYRRE

SEQ ID NO: 242137 - protein, 11 aa, Japanese encephalitis virus
REEFFKYRREG

SEQ ID NO: 242138 - protein, 11 aa, Japanese encephalitis virus
EEFFKYRREGI

SEQ ID NO: 242139 - protein, 11 aa, Japanese encephalitis virus
EFFKYRREGII

SEQ ID NO: 242140 - protein, 11 aa, Japanese encephalitis virus
FFQYRREAIIE

SEQ ID NO: 242141 - protein, 11 aa, Japanese encephalitis virus
FKYRREGIIEV

SEQ ID NO: 242142 - protein, 11 aa, Japanese encephalitis virus
QYRREAIIEVD

SEQ ID NO: 242143 - protein, 11 aa, Japanese encephalitis virus
GIIEVDRTEAR

SEQ ID NO: 242144 - protein, 11 aa, Japanese encephalitis virus
VDRTEARRARS

SEQ ID NO: 242145 - protein, 11 aa, Japanese encephalitis virus
DRTEARRARSE

SEQ ID NO: 242146 - protein, 11 aa, Japanese encephalitis virus
RTEARRARSEN

SEQ ID NO: 242147 - protein, 11 aa, Japanese encephalitis virus
TEARRARSENN

SEQ ID NO: 242148 - protein, 11 aa, Japanese encephalitis virus
EACRARRENNI

SEQ ID NO: 242149 - protein, 11 aa, Japanese encephalitis virus
ACRARRENNIV

SEQ ID NO: 242150 - protein, 11 aa, Japanese encephalitis virus
CRARRENNIVG

SEQ ID NO: 242151 - protein, 11 aa, Japanese encephalitis virus
RARSENNIVGG

SEQ ID NO: 242152 - protein, 11 aa, Japanese encephalitis virus
ARRENNKVGGH

SEQ ID NO: 242153 - protein, 11 aa, Japanese encephalitis virus
RSENNIVGGHP

SEQ ID NO: 242154 - protein, 11 aa, Japanese encephalitis virus
RENNKVGGHPV

SEQ ID NO: 242155 - protein, 11 aa, Japanese encephalitis virus
ENNKVGGHPVS

SEQ ID NO: 242156 - protein, 11 aa, Japanese encephalitis virus
NNKVGGHPVSR

SEQ ID NO: 242157 - protein, 11 aa, Japanese encephalitis virus
NKVGGHPVSRG

SEQ ID NO: 242158 - protein, 11 aa, Japanese encephalitis virus
KVGGHPVSRGS

SEQ ID NO: 242159 - protein, 11 aa, Japanese encephalitis virus
KGFVSPIGKVV

SEQ ID NO: 242160 - protein, 11 aa, Japanese encephalitis virus
GFVPPIGKVID

SEQ ID NO: 242161 - protein, 11 aa, Japanese encephalitis virus
FVSPIGKVVDL

SEQ ID NO: 242162 - protein, 11 aa, Japanese encephalitis virus
VSPIGKVVDLG

SEQ ID NO: 242163 - protein, 11 aa, Japanese encephalitis virus
SPIGKVVDLGC

SEQ ID NO: 242164 - protein, 11 aa, Japanese encephalitis virus
IGKVIDLGCGC

SEQ ID NO: 242165 - protein, 11 aa, Japanese encephalitis virus
GKVVDLGCGRG

SEQ ID NO: 242166 - protein, 11 aa, Japanese encephalitis virus
KVVDLGCGRGG

SEQ ID NO: 242167 - protein, 11 aa, Japanese encephalitis virus
VIDLGCGCGGW

SEQ ID NO: 242168 - protein, 11 aa, Japanese encephalitis virus
IDLGCGCGGWS

SEQ ID NO: 242169 - protein, 11 aa, Japanese encephalitis virus
DLGCGCGGWSY

SEQ ID NO: 242170 - protein, 11 aa, Japanese encephalitis virus
LGCGCGGWSYY

SEQ ID NO: 242171 - protein, 11 aa, Japanese encephalitis virus
GCGCGGWSYYA

SEQ ID NO: 242172 - protein, 11 aa, Japanese encephalitis virus
CGCGGWSYYAA

SEQ ID NO: 242173 - protein, 11 aa, Japanese encephalitis virus
GRGGWSYCAAT

SEQ ID NO: 242174 - protein, 11 aa, Japanese encephalitis virus
RGGWSYCAATL

SEQ ID NO: 242175 - protein, 11 aa, Japanese encephalitis virus
GGWSYCAATLK

SEQ ID NO: 242176 - protein, 11 aa, Japanese encephalitis virus
GWSYCAATLKK

SEQ ID NO: 242177 - protein, 11 aa, Japanese encephalitis virus
WSYYAATLKRV

SEQ ID NO: 242178 - protein, 11 aa, Japanese encephalitis virus
SYCAATLKKVQ

SEQ ID NO: 242179 - protein, 11 aa, Japanese encephalitis virus
YYAATLKRVQE

SEQ ID NO: 242180 - protein, 11 aa, Japanese encephalitis virus
CAATLKKVQEV

SEQ ID NO: 242181 - protein, 11 aa, Japanese encephalitis virus
AATLKKVQEFR

SEQ ID NO: 242182 - protein, 11 aa, Japanese encephalitis virus
ATLKRVQEVRG

SEQ ID NO: 242183 - protein, 11 aa, Japanese encephalitis virus
TLKKVQEFRGY

SEQ ID NO: 242184 - protein, 11 aa, Japanese encephalitis virus
LKRVQEVRGYT

SEQ ID NO: 242185 - protein, 11 aa, Japanese encephalitis virus
KRVQEVRGYTK

SEQ ID NO: 242186 - protein, 11 aa, Japanese encephalitis virus
RVQEVRGYTKG

SEQ ID NO: 242187 - protein, 11 aa, Japanese encephalitis virus
VQEFRGYTKGG

SEQ ID NO: 242188 - protein, 11 aa, Japanese encephalitis virus
QEFRGYTKGGA

SEQ ID NO: 242189 - protein, 11 aa, Japanese encephalitis virus
EFRGYTKGGAG

SEQ ID NO: 242190 - protein, 11 aa, Japanese encephalitis virus
FRGYTKGGAGH

SEQ ID NO: 242191 - protein, 11 aa, Japanese encephalitis virus
EEPMPMQSYGW

SEQ ID NO: 242192 - protein, 11 aa, Japanese encephalitis virus
EPMPMQSYGWN

SEQ ID NO: 242193 - protein, 11 aa, Japanese encephalitis virus
PMPMQSYGWNL

SEQ ID NO: 242194 - protein, 11 aa, Japanese encephalitis virus
MPMQSYGWNLV

SEQ ID NO: 242195 - protein, 11 aa, Japanese encephalitis virus
PMQSYGWNLVS

SEQ ID NO: 242196 - protein, 11 aa, Japanese encephalitis virus
MQSYGWNLVSM

SEQ ID NO: 242197 - protein, 11 aa, Japanese encephalitis virus
QSYGWNLVSMK

SEQ ID NO: 242198 - protein, 11 aa, Japanese encephalitis virus
SYGWNLVSMKS

SEQ ID NO: 242199 - protein, 11 aa, Japanese encephalitis virus
YGWNLVSMKSG

SEQ ID NO: 242200 - protein, 11 aa, Japanese encephalitis virus
GWNLVSMKSGV

SEQ ID NO: 242201 - protein, 11 aa, Japanese encephalitis virus
WNLVSMKSGVD

SEQ ID NO: 242202 - protein, 11 aa, Japanese encephalitis virus
NLVSLKSGVHV

SEQ ID NO: 242203 - protein, 11 aa, Japanese encephalitis virus
LVSMKSGVDVF

SEQ ID NO: 242204 - protein, 11 aa, Japanese encephalitis virus
VSLKSGVHVFY

SEQ ID NO: 242205 - protein, 11 aa, Japanese encephalitis virus
SMKSGVDVFYK

SEQ ID NO: 242206 - protein, 11 aa, Japanese encephalitis virus
LKSGVDVFYRP

SEQ ID NO: 242207 - protein, 11 aa, Japanese encephalitis virus
KSGVHVFYKPS

SEQ ID NO: 242208 - protein, 11 aa, Japanese encephalitis virus
SGVHVFYKPSE

SEQ ID NO: 242209 - protein, 11 aa, Japanese encephalitis virus
GVHVFYKPSEP

SEQ ID NO: 242210 - protein, 11 aa, Japanese encephalitis virus
VHVFYKPSEPS

SEQ ID NO: 242211 - protein, 11 aa, Japanese encephalitis virus
DVFYRPSEPSD

SEQ ID NO: 242212 - protein, 11 aa, Japanese encephalitis virus
CPYMPKVIEKI

SEQ ID NO: 242213 - protein, 11 aa, Japanese encephalitis virus
PYMPKVIEKNE

SEQ ID NO: 242214 - protein, 11 aa, Japanese encephalitis virus
YMPKVIEKNEV

SEQ ID NO: 242215 - protein, 11 aa, Japanese encephalitis virus
MPKVIEKIEVL

SEQ ID NO: 242216 - protein, 11 aa, Japanese encephalitis virus
PKVIEKIEVLQ

SEQ ID NO: 242217 - protein, 11 aa, Japanese encephalitis virus
KVIEKIEVLQR

SEQ ID NO: 242218 - protein, 11 aa, Japanese encephalitis virus
VIEKNEVLQRR

SEQ ID NO: 242219 - protein, 11 aa, Japanese encephalitis virus
IEKNEVLQRRF

SEQ ID NO: 242220 - protein, 11 aa, Japanese encephalitis virus
EKIEVLQRRFG

SEQ ID NO: 242221 - protein, 11 aa, Japanese encephalitis virus
KNEVLQRRFGG

SEQ ID NO: 242222 - protein, 11 aa, Japanese encephalitis virus
IEVLQRRFGGG

SEQ ID NO: 242223 - protein, 11 aa, Japanese encephalitis virus
SQVLLGRMNRT

SEQ ID NO: 242224 - protein, 11 aa, Japanese encephalitis virus
QVLLGRMDRAV

SEQ ID NO: 242225 - protein, 11 aa, Japanese encephalitis virus
VLLGRMNRTVW

SEQ ID NO: 242226 - protein, 11 aa, Japanese encephalitis virus
LLGRMDRAVWR

SEQ ID NO: 242227 - protein, 11 aa, Japanese encephalitis virus
LGRMDRAVWRG

SEQ ID NO: 242228 - protein, 11 aa, Japanese encephalitis virus
GRMNRTVWRGP

SEQ ID NO: 242229 - protein, 11 aa, Japanese encephalitis virus
RMNRTVWRGPK

SEQ ID NO: 242230 - protein, 11 aa, Japanese encephalitis virus
MDRTVWRGPRY

SEQ ID NO: 242231 - protein, 11 aa, Japanese encephalitis virus
NRTVWRGPKYE

SEQ ID NO: 242232 - protein, 11 aa, Japanese encephalitis virus
RTVWRGPKYKE

SEQ ID NO: 242233 - protein, 11 aa, Japanese encephalitis virus
TVWRGPRYEED

SEQ ID NO: 242234 - protein, 11 aa, Japanese encephalitis virus
VWRGPRYEEDV

SEQ ID NO: 242235 - protein, 11 aa, Japanese encephalitis virus
WRGPKYKEDVN

SEQ ID NO: 242236 - protein, 11 aa, Japanese encephalitis virus
RGPKYKEDVNL

SEQ ID NO: 242237 - protein, 11 aa, Japanese encephalitis virus
GPRYEEDVNLG

SEQ ID NO: 242238 - protein, 11 aa, Japanese encephalitis virus
PKYKEDVNLGS

SEQ ID NO: 242239 - protein, 11 aa, Japanese encephalitis virus
RYEEDVNLGSG

SEQ ID NO: 242240 - protein, 11 aa, Japanese encephalitis virus
RAVGKGEVHSD

SEQ ID NO: 242241 - protein, 11 aa, Japanese encephalitis virus
AVGKGEVHSDQ

SEQ ID NO: 242242 - protein, 11 aa, Japanese encephalitis virus
KIRKRIQKLKE

SEQ ID NO: 242243 - protein, 11 aa, Japanese encephalitis virus
KRIQKQKEEFA

SEQ ID NO: 242244 - protein, 11 aa, Japanese encephalitis virus
RIQKLREGFAT

SEQ ID NO: 242245 - protein, 11 aa, Japanese encephalitis virus
IQKLREGFATT

SEQ ID NO: 242246 - protein, 11 aa, Japanese encephalitis virus
QKLREGFATTW

SEQ ID NO: 242247 - protein, 11 aa, Japanese encephalitis virus
KQKEEFATTWH

SEQ ID NO: 242248 - protein, 11 aa, Japanese encephalitis virus
KEEFATTWHRD

SEQ ID NO: 242249 - protein, 11 aa, Japanese encephalitis virus
EEFATTWHKDH

SEQ ID NO: 242250 - protein, 11 aa, Japanese encephalitis virus
EFGTTWHKDPE

SEQ ID NO: 242251 - protein, 11 aa, Japanese encephalitis virus
FATTWHKDHEH

SEQ ID NO: 242252 - protein, 11 aa, Japanese encephalitis virus
ATTWHRDPEHP

SEQ ID NO: 242253 - protein, 11 aa, Japanese encephalitis virus
TTWHKDHEHPY

SEQ ID NO: 242254 - protein, 11 aa, Japanese encephalitis virus
TWHKDHEHPYR

SEQ ID NO: 242255 - protein, 11 aa, Japanese encephalitis virus
WHKDPEHPYRN

SEQ ID NO: 242256 - protein, 11 aa, Japanese encephalitis virus
HRDPEHPYRTW

SEQ ID NO: 242257 - protein, 11 aa, Japanese encephalitis virus
RDPEHPYRTWT

SEQ ID NO: 242258 - protein, 11 aa, Japanese encephalitis virus
DPEHPYRNWTY

SEQ ID NO: 242259 - protein, 11 aa, Japanese encephalitis virus
PEHPYRNWTYH

SEQ ID NO: 242260 - protein, 11 aa, Japanese encephalitis virus
TWTYHGSYEVR

SEQ ID NO: 242261 - protein, 11 aa, Japanese encephalitis virus
TYHGSYEVKAN

SEQ ID NO: 242262 - protein, 11 aa, Japanese encephalitis virus
YHGSYEVRATG

SEQ ID NO: 242263 - protein, 11 aa, Japanese encephalitis virus
HGSYEVKANGS

SEQ ID NO: 242264 - protein, 11 aa, Japanese encephalitis virus
GSYEVKANGSA

SEQ ID NO: 242265 - protein, 11 aa, Japanese encephalitis virus
SYEVKANGSAS

SEQ ID NO: 242266 - protein, 11 aa, Japanese encephalitis virus
YEVRATGSASS

SEQ ID NO: 242267 - protein, 11 aa, Japanese encephalitis virus
EVRATGSASSL

SEQ ID NO: 242268 - protein, 11 aa, Japanese encephalitis virus
VRATGSASSLV

SEQ ID NO: 242269 - protein, 11 aa, Japanese encephalitis virus
KANGSASSLVN

SEQ ID NO: 242270 - protein, 11 aa, Japanese encephalitis virus
VVKLMSKPWDT

SEQ ID NO: 242271 - protein, 11 aa, Japanese encephalitis virus
VKLMSKPWDTI

SEQ ID NO: 242272 - protein, 11 aa, Japanese encephalitis virus
KLMSKPWDTIA

SEQ ID NO: 242273 - protein, 11 aa, Japanese encephalitis virus
LMSKPWDTIAN

SEQ ID NO: 242274 - protein, 11 aa, Japanese encephalitis virus
MSKPWDTIANV

SEQ ID NO: 242275 - protein, 11 aa, Japanese encephalitis virus
SKPWDTIANVT

SEQ ID NO: 242276 - protein, 11 aa, Japanese encephalitis virus
KPWDAISYVTT

SEQ ID NO: 242277 - protein, 11 aa, Japanese encephalitis virus
PWDAISYVTTM

SEQ ID NO: 242278 - protein, 11 aa, Japanese encephalitis virus
WDAISYVTTMP

SEQ ID NO: 242279 - protein, 11 aa, Japanese encephalitis virus
DAISYVTTMPM

SEQ ID NO: 242280 - protein, 11 aa, Japanese encephalitis virus
AISYVTTMPMT

SEQ ID NO: 242281 - protein, 11 aa, Japanese encephalitis virus
QRVFKEKVGTK

SEQ ID NO: 242282 - protein, 11 aa, Japanese encephalitis virus
RVFKEKVGTKA

SEQ ID NO: 242283 - protein, 11 aa, Japanese encephalitis virus
VFKEKVGTMAP

SEQ ID NO: 242284 - protein, 11 aa, Japanese encephalitis virus
FKEKVGTMAPE

SEQ ID NO: 242285 - protein, 11 aa, Japanese encephalitis virus
KEKVGTMAPEP

SEQ ID NO: 242286 - protein, 11 aa, Japanese encephalitis virus
EKVGTMAPEPP

SEQ ID NO: 242287 - protein, 11 aa, Japanese encephalitis virus
GVREVLNETTN

SEQ ID NO: 242288 - protein, 11 aa, Japanese encephalitis virus
VREVLNETTNW

SEQ ID NO: 242289 - protein, 11 aa, Japanese encephalitis virus
TNWLWAHLSRK

SEQ ID NO: 242290 - protein, 11 aa, Japanese encephalitis virus
NWLWAHLSRKK

SEQ ID NO: 242291 - protein, 11 aa, Japanese encephalitis virus
WLWAHLSRKKR

SEQ ID NO: 242292 - protein, 11 aa, Japanese encephalitis virus
LWAHLSRKKRP

SEQ ID NO: 242293 - protein, 11 aa, Japanese encephalitis virus
WAHLSRKKRPR

SEQ ID NO: 242294 - protein, 11 aa, Japanese encephalitis virus
AHLSRKKRPRL

SEQ ID NO: 242295 - protein, 11 aa, Japanese encephalitis virus
HLSRKKRPRLC

SEQ ID NO: 242296 - protein, 11 aa, Japanese encephalitis virus
PRLCTKEEFIN

SEQ ID NO: 242297 - protein, 11 aa, Japanese encephalitis virus
RLCTKEEFINK

SEQ ID NO: 242298 - protein, 11 aa, Japanese encephalitis virus
LCTKEEFINKV

SEQ ID NO: 242299 - protein, 11 aa, Japanese encephalitis virus
CTKEEFINKVN

SEQ ID NO: 242300 - protein, 11 aa, Japanese encephalitis virus
TKEEFINKVNS

SEQ ID NO: 242301 - protein, 11 aa, Japanese encephalitis virus
KEEFIKKVNSS

SEQ ID NO: 242302 - protein, 11 aa, Japanese encephalitis virus
EEFIKKVNSDA

SEQ ID NO: 242303 - protein, 11 aa, Japanese encephalitis virus
KVNSDAALGAV

SEQ ID NO: 242304 - protein, 11 aa, Japanese encephalitis virus
VNSSAALGAVF

SEQ ID NO: 242305 - protein, 11 aa, Japanese encephalitis virus
NSNASLGAVFA

SEQ ID NO: 242306 - protein, 11 aa, Japanese encephalitis virus
SNASLGAVFAE

SEQ ID NO: 242307 - protein, 11 aa, Japanese encephalitis virus
SAALGAVFAEQ

SEQ ID NO: 242308 - protein, 11 aa, Japanese encephalitis virus
ASLGAVFAEQN

SEQ ID NO: 242309 - protein, 11 aa, Japanese encephalitis virus
SLGAVFAEQNQ

SEQ ID NO: 242310 - protein, 11 aa, Japanese encephalitis virus
NQWSTAREAVN

SEQ ID NO: 242311 - protein, 11 aa, Japanese encephalitis virus
QWSTAREAVSD

SEQ ID NO: 242312 - protein, 11 aa, Japanese encephalitis virus
WSTAREAVSDP

SEQ ID NO: 242313 - protein, 11 aa, Japanese encephalitis virus
LWEMVDEEREN

SEQ ID NO: 242314 - protein, 11 aa, Japanese encephalitis virus
WEIVDEERENH

SEQ ID NO: 242315 - protein, 11 aa, Japanese encephalitis virus
EIVDEERENHL

SEQ ID NO: 242316 - protein, 11 aa, Japanese encephalitis virus
IVDEERENHLR

SEQ ID NO: 242317 - protein, 11 aa, Japanese encephalitis virus
VDVERENHLRG

SEQ ID NO: 242318 - protein, 11 aa, Japanese encephalitis virus
DVERENHLRGE

SEQ ID NO: 242319 - protein, 11 aa, Japanese encephalitis virus
NHLRGECHTRI

SEQ ID NO: 242320 - protein, 11 aa, Japanese encephalitis virus
HLRGECHTRIY

SEQ ID NO: 242321 - protein, 11 aa, Japanese encephalitis virus
LRGECHTCVYH

SEQ ID NO: 242322 - protein, 11 aa, Japanese encephalitis virus
RGECHTCVYHM

SEQ ID NO: 242323 - protein, 11 aa, Japanese encephalitis virus
GECHTCVYHMM

SEQ ID NO: 242324 - protein, 11 aa, Japanese encephalitis virus
ECHTRIYNMMG

SEQ ID NO: 242325 - protein, 11 aa, Japanese encephalitis virus
CHTCVYHMMGK

SEQ ID NO: 242326 - protein, 11 aa, Japanese encephalitis virus
HTCVYHMMGKR

SEQ ID NO: 242327 - protein, 11 aa, Japanese encephalitis virus
TCVYHMMGKRE

SEQ ID NO: 242328 - protein, 11 aa, Japanese encephalitis virus
CVYHMMGKREK

SEQ ID NO: 242329 - protein, 11 aa, Japanese encephalitis virus
VYHMMGKREKK

SEQ ID NO: 242330 - protein, 11 aa, Japanese encephalitis virus
LEFEALGSLNE

SEQ ID NO: 242331 - protein, 11 aa, Japanese encephalitis virus
EFEALGSLNED

SEQ ID NO: 242332 - protein, 11 aa, Japanese encephalitis virus
FEALGFLNENH

SEQ ID NO: 242333 - protein, 11 aa, Japanese encephalitis virus
EALGFLNENHW

SEQ ID NO: 242334 - protein, 11 aa, Japanese encephalitis virus
ALGSLNEDHWL

SEQ ID NO: 242335 - protein, 11 aa, Japanese encephalitis virus
LGFLNENHWLS

SEQ ID NO: 242336 - protein, 11 aa, Japanese encephalitis virus
GFLNENHWLSR

SEQ ID NO: 242337 - protein, 11 aa, Japanese encephalitis virus
FLNEDHWLSRR

SEQ ID NO: 242338 - protein, 11 aa, Japanese encephalitis virus
LNENHWLSREN

SEQ ID NO: 242339 - protein, 11 aa, Japanese encephalitis virus
NENHWLSRENS

SEQ ID NO: 242340 - protein, 11 aa, Japanese encephalitis virus
EDHWLSRRNSG

SEQ ID NO: 242341 - protein, 11 aa, Japanese encephalitis virus
DHWLSRRNSGG

SEQ ID NO: 242342 - protein, 11 aa, Japanese encephalitis virus
HWLSRENSRGG

SEQ ID NO: 242343 - protein, 11 aa, Japanese encephalitis virus
WLSRRNSGGGV

SEQ ID NO: 242344 - protein, 11 aa, Japanese encephalitis virus
LSRENSRGGVE

SEQ ID NO: 242345 - protein, 11 aa, Japanese encephalitis virus
SRRNSGGGVEG

SEQ ID NO: 242346 - protein, 11 aa, Japanese encephalitis virus
RENSRGGVEGS

SEQ ID NO: 242347 - protein, 11 aa, Japanese encephalitis virus
NSGGGVEGLGV

SEQ ID NO: 242348 - protein, 11 aa, Japanese encephalitis virus
SRGGVEGSSVQ

SEQ ID NO: 242349 - protein, 11 aa, Japanese encephalitis virus
GGGVEGSSVQK

SEQ ID NO: 242350 - protein, 11 aa, Japanese encephalitis virus
GGVEGLGVQKL

SEQ ID NO: 242351 - protein, 11 aa, Japanese encephalitis virus
GEEGSGVQKLG

SEQ ID NO: 242352 - protein, 11 aa, Japanese encephalitis virus
VEGLGVQKLGY

SEQ ID NO: 242353 - protein, 11 aa, Japanese encephalitis virus
EGLGVQKLGYI

SEQ ID NO: 242354 - protein, 11 aa, Japanese encephalitis virus
GVQKLGYISGD

SEQ ID NO: 242355 - protein, 11 aa, Japanese encephalitis virus
VQKLGYISGDI

SEQ ID NO: 242356 - protein, 11 aa, Japanese encephalitis virus
QKLGYIIRDIA

SEQ ID NO: 242357 - protein, 11 aa, Japanese encephalitis virus
GDITSRAIGKM

SEQ ID NO: 242358 - protein, 11 aa, Japanese encephalitis virus
DIARKEGGKMY

SEQ ID NO: 242359 - protein, 11 aa, Japanese encephalitis virus
IAVKQGGKMYA

SEQ ID NO: 242360 - protein, 11 aa, Japanese encephalitis virus
TSRAIGKMYAD

SEQ ID NO: 242361 - protein, 11 aa, Japanese encephalitis virus
RKEGGKMYADD

SEQ ID NO: 242362 - protein, 11 aa, Japanese encephalitis virus
KQGGKMYADDP

SEQ ID NO: 242363 - protein, 11 aa, Japanese encephalitis virus
AIGKMYADDTA

SEQ ID NO: 242364 - protein, 11 aa, Japanese encephalitis virus
IGKMYADDTAG

SEQ ID NO: 242365 - protein, 11 aa, Japanese encephalitis virus
DTAGWDTRITK

SEQ ID NO: 242366 - protein, 11 aa, Japanese encephalitis virus
PAGWDTRITRT

SEQ ID NO: 242367 - protein, 11 aa, Japanese encephalitis virus
AGWDTRITKTD

SEQ ID NO: 242368 - protein, 11 aa, Japanese encephalitis virus
GWDTRITKTDL

SEQ ID NO: 242369 - protein, 11 aa, Japanese encephalitis virus
WDTRITKTDLE

SEQ ID NO: 242370 - protein, 11 aa, Japanese encephalitis virus
DTRITKTDLEN

SEQ ID NO: 242371 - protein, 11 aa, Japanese encephalitis virus
TRITKTDLENE

SEQ ID NO: 242372 - protein, 11 aa, Japanese encephalitis virus
RITKTDLENEA

SEQ ID NO: 242373 - protein, 11 aa, Japanese encephalitis virus
ITKTDLENEAK

SEQ ID NO: 242374 - protein, 11 aa, Japanese encephalitis virus
TKTDLENEAKV

SEQ ID NO: 242375 - protein, 11 aa, Japanese encephalitis virus
KTDLENEAKVL

SEQ ID NO: 242376 - protein, 11 aa, Japanese encephalitis virus
RAIIELTYKHK

SEQ ID NO: 242377 - protein, 11 aa, Japanese encephalitis virus
AIIELTYRHQV

SEQ ID NO: 242378 - protein, 11 aa, Japanese encephalitis virus
IIELTYKHKVV

SEQ ID NO: 242379 - protein, 11 aa, Japanese encephalitis virus
IELTYKHKVVK

SEQ ID NO: 242380 - protein, 11 aa, Japanese encephalitis virus
ELTYRHQVFKV

SEQ ID NO: 242381 - protein, 11 aa, Japanese encephalitis virus
LTYKHKVVKVM

SEQ ID NO: 242382 - protein, 11 aa, Japanese encephalitis virus
TYKHKVVKVMR

SEQ ID NO: 242383 - protein, 11 aa, Japanese encephalitis virus
YKHKVVKVMRP

SEQ ID NO: 242384 - protein, 11 aa, Japanese encephalitis virus
RHQVFKVMRPA

SEQ ID NO: 242385 - protein, 11 aa, Japanese encephalitis virus
HKVVKVMRPAS

SEQ ID NO: 242386 - protein, 11 aa, Japanese encephalitis virus
KVMRPSTDGKT

SEQ ID NO: 242387 - protein, 11 aa, Japanese encephalitis virus
VMRPSTDGKTV

SEQ ID NO: 242388 - protein, 11 aa, Japanese encephalitis virus
MRPAAKGKTGM

SEQ ID NO: 242389 - protein, 11 aa, Japanese encephalitis virus
KGKTGMAVISR

SEQ ID NO: 242390 - protein, 11 aa, Japanese encephalitis virus
GKTGMAVISRE

SEQ ID NO: 242391 - protein, 11 aa, Japanese encephalitis virus
KTVMVVYSRED

SEQ ID NO: 242392 - protein, 11 aa, Japanese encephalitis virus
TVMVVYSREDQ

SEQ ID NO: 242393 - protein, 11 aa, Japanese encephalitis virus
VMVVYSREDQR

SEQ ID NO: 242394 - protein, 11 aa, Japanese encephalitis virus
MAVISRENQRG

SEQ ID NO: 242395 - protein, 11 aa, Japanese encephalitis virus
VVYSREDQRGS

SEQ ID NO: 242396 - protein, 11 aa, Japanese encephalitis virus
VYSREDQRGSG

SEQ ID NO: 242397 - protein, 11 aa, Japanese encephalitis virus
ISRENQRGSGQ

SEQ ID NO: 242398 - protein, 11 aa, Japanese encephalitis virus
TNIAVQFVRLM

SEQ ID NO: 242399 - protein, 11 aa, Japanese encephalitis virus
NIAVQLVRLVE

SEQ ID NO: 242400 - protein, 11 aa, Japanese encephalitis virus
IAVQLVRLVEA

SEQ ID NO: 242401 - protein, 11 aa, Japanese encephalitis virus
AVQFVRLMKVE

SEQ ID NO: 242402 - protein, 11 aa, Japanese encephalitis virus
VQLVRLVEAEG

SEQ ID NO: 242403 - protein, 11 aa, Japanese encephalitis virus
QFVRLMKVEGV

SEQ ID NO: 242404 - protein, 11 aa, Japanese encephalitis virus
FVRLMKVEGVI

SEQ ID NO: 242405 - protein, 11 aa, Japanese encephalitis virus
VRLVEAEGVIG

SEQ ID NO: 242406 - protein, 11 aa, Japanese encephalitis virus
RLVEAEGVIGP

SEQ ID NO: 242407 - protein, 11 aa, Japanese encephalitis virus
LVEAEGVIGPQ

SEQ ID NO: 242408 - protein, 11 aa, Japanese encephalitis virus
VEAEGVIGPQH

SEQ ID NO: 242409 - protein, 11 aa, Japanese encephalitis virus
EAEGVIGPQHV

SEQ ID NO: 242410 - protein, 11 aa, Japanese encephalitis virus
AEGVIGPQHVE

SEQ ID NO: 242411 - protein, 11 aa, Japanese encephalitis virus
EGVIGPQHVEQ

SEQ ID NO: 242412 - protein, 11 aa, Japanese encephalitis virus
GVIGPQHLEHL

SEQ ID NO: 242413 - protein, 11 aa, Japanese encephalitis virus
VIGPQHVEQLP

SEQ ID NO: 242414 - protein, 11 aa, Japanese encephalitis virus
IGPQHLEQLPK

SEQ ID NO: 242415 - protein, 11 aa, Japanese encephalitis virus
GPQHLEQLPRE

SEQ ID NO: 242416 - protein, 11 aa, Japanese encephalitis virus
EHLPRKNKIAV

SEQ ID NO: 242417 - protein, 11 aa, Japanese encephalitis virus
HLPRKNKIAVR

SEQ ID NO: 242418 - protein, 11 aa, Japanese encephalitis virus
LPRENKIAVRT

SEQ ID NO: 242419 - protein, 11 aa, Japanese encephalitis virus
PKKNKIAVRTW

SEQ ID NO: 242420 - protein, 11 aa, Japanese encephalitis virus
KKNKIAVRTWL

SEQ ID NO: 242421 - protein, 11 aa, Japanese encephalitis virus
ENKIAVRTWLF

SEQ ID NO: 242422 - protein, 11 aa, Japanese encephalitis virus
WLFENGGERVT

SEQ ID NO: 242423 - protein, 11 aa, Japanese encephalitis virus
LFENGGERVTR

SEQ ID NO: 242424 - protein, 11 aa, Japanese encephalitis virus
FENGGERVTRM

SEQ ID NO: 242425 - protein, 11 aa, Japanese encephalitis virus
ENGGERVTRMA

SEQ ID NO: 242426 - protein, 11 aa, Japanese encephalitis virus
NGGERVTRMAI

SEQ ID NO: 242427 - protein, 11 aa, Japanese encephalitis virus
GGERVTRMAIS

SEQ ID NO: 242428 - protein, 11 aa, Japanese encephalitis virus
GERVTRMAISG

SEQ ID NO: 242429 - protein, 11 aa, Japanese encephalitis virus
TRMAISGDDCA

SEQ ID NO: 242430 - protein, 11 aa, Japanese encephalitis virus
PLDDRFATSLH

SEQ ID NO: 242431 - protein, 11 aa, Japanese encephalitis virus
LDDRFATSLHF

SEQ ID NO: 242432 - protein, 11 aa, Japanese encephalitis virus
DDRFATSLHFL

SEQ ID NO: 242433 - protein, 11 aa, Japanese encephalitis virus
DRFATALYFLN

SEQ ID NO: 242434 - protein, 11 aa, Japanese encephalitis virus
RFATALYFLNA

SEQ ID NO: 242435 - protein, 11 aa, Japanese encephalitis virus
FATALYFLNAM

SEQ ID NO: 242436 - protein, 11 aa, Japanese encephalitis virus
ATALYFLNAMS

SEQ ID NO: 242437 - protein, 11 aa, Japanese encephalitis virus
TSLHFLNAMSK

SEQ ID NO: 242438 - protein, 11 aa, Japanese encephalitis virus
ALYFLNAMSKV

SEQ ID NO: 242439 - protein, 11 aa, Japanese encephalitis virus
LHFLNAMSKVT

SEQ ID NO: 242440 - protein, 11 aa, Japanese encephalitis virus
HFLNAMSKVTK

SEQ ID NO: 242441 - protein, 11 aa, Japanese encephalitis virus
FLNAMSKVRRD

SEQ ID NO: 242442 - protein, 11 aa, Japanese encephalitis virus
LNAMSKVTKDI

SEQ ID NO: 242443 - protein, 11 aa, Japanese encephalitis virus
NAMSKVRRDIQ

SEQ ID NO: 242444 - protein, 11 aa, Japanese encephalitis virus
AMSKVRRDIQE

SEQ ID NO: 242445 - protein, 11 aa, Japanese encephalitis virus
MSKVTKDIQQW

SEQ ID NO: 242446 - protein, 11 aa, Japanese encephalitis virus
SKVRRDIQEWK

SEQ ID NO: 242447 - protein, 11 aa, Japanese encephalitis virus
KVRRDIQEWKP

SEQ ID NO: 242448 - protein, 11 aa, Japanese encephalitis virus
VTKDIQQWKPS

SEQ ID NO: 242449 - protein, 11 aa, Japanese encephalitis virus
RRDIQEWKPSH

SEQ ID NO: 242450 - protein, 11 aa, Japanese encephalitis virus
KDIQQWKPSHG

SEQ ID NO: 242451 - protein, 11 aa, Japanese encephalitis virus
DIQQWKPSHGW

SEQ ID NO: 242452 - protein, 11 aa, Japanese encephalitis virus
IQEWKPSHGWL

SEQ ID NO: 242453 - protein, 11 aa, Japanese encephalitis virus
QEWKPSHGWLD

SEQ ID NO: 242454 - protein, 11 aa, Japanese encephalitis virus
QWKPSHGWHDW

SEQ ID NO: 242455 - protein, 11 aa, Japanese encephalitis virus
WKPSHGWLDWQ

SEQ ID NO: 242456 - protein, 11 aa, Japanese encephalitis virus
KPSHGWHDWLH

SEQ ID NO: 242457 - protein, 11 aa, Japanese encephalitis virus
PSHGWLDWQQV

SEQ ID NO: 242458 - protein, 11 aa, Japanese encephalitis virus
SHGWLDWQQVP

SEQ ID NO: 242459 - protein, 11 aa, Japanese encephalitis virus
HGWLDWQQVPF

SEQ ID NO: 242460 - protein, 11 aa, Japanese encephalitis virus
GWHDWLHVPFC

SEQ ID NO: 242461 - protein, 11 aa, Japanese encephalitis virus
WHDWLHVPFCS

SEQ ID NO: 242462 - protein, 11 aa, Japanese encephalitis virus
LDWQQVPFCSN

SEQ ID NO: 242463 - protein, 11 aa, Japanese encephalitis virus
IVMKDGRSIVD

SEQ ID NO: 242464 - protein, 11 aa, Japanese encephalitis virus
VMKDGRSIVDP

SEQ ID NO: 242465 - protein, 11 aa, Japanese encephalitis virus
MKDGRSIVDPC

SEQ ID NO: 242466 - protein, 11 aa, Japanese encephalitis virus
KDGRSLLVPCR

SEQ ID NO: 242467 - protein, 11 aa, Japanese encephalitis virus
DGRSLLVPCRG

SEQ ID NO: 242468 - protein, 11 aa, Japanese encephalitis virus
GRSLLVPCRGQ

SEQ ID NO: 242469 - protein, 11 aa, Japanese encephalitis virus
RSLLVPCRGQD

SEQ ID NO: 242470 - protein, 11 aa, Japanese encephalitis virus
SIVDPCRGQDE

SEQ ID NO: 242471 - protein, 11 aa, Japanese encephalitis virus
IVDPCRGQDEL

SEQ ID NO: 242472 - protein, 11 aa, Japanese encephalitis virus
LVPCRGQDELI

SEQ ID NO: 242473 - protein, 11 aa, Japanese encephalitis virus
DPCRGQDELIG

SEQ ID NO: 242474 - protein, 11 aa, Japanese encephalitis virus
DRARISPGAGW

SEQ ID NO: 242475 - protein, 11 aa, Japanese encephalitis virus
RISPGAGWNVM

SEQ ID NO: 242476 - protein, 11 aa, Japanese encephalitis virus
ISPGAGWNVRD

SEQ ID NO: 242477 - protein, 11 aa, Japanese encephalitis virus
SPGAGWNVRDT

SEQ ID NO: 242478 - protein, 11 aa, Japanese encephalitis virus
PGAGWNVMDTA

SEQ ID NO: 242479 - protein, 11 aa, Japanese encephalitis virus
GAGWNVMDTAC

SEQ ID NO: 242480 - protein, 11 aa, Japanese encephalitis virus
AGWNVRDTACL

SEQ ID NO: 242481 - protein, 11 aa, Japanese encephalitis virus
GWNVMDTACLA

SEQ ID NO: 242482 - protein, 11 aa, Japanese encephalitis virus
WNVMDTACLAK

SEQ ID NO: 242483 - protein, 11 aa, Japanese encephalitis virus
NVMDTACLAKA

SEQ ID NO: 242484 - protein, 11 aa, Japanese encephalitis virus
VRDTACLAKAY

SEQ ID NO: 242485 - protein, 11 aa, Japanese encephalitis virus
RDTACLAKAYA

SEQ ID NO: 242486 - protein, 11 aa, Japanese encephalitis virus
ACLPKAYAQMW

SEQ ID NO: 242487 - protein, 11 aa, Japanese encephalitis virus
CLPKAYAQMWV

SEQ ID NO: 242488 - protein, 11 aa, Japanese encephalitis virus
LPKAYAQMWVL

SEQ ID NO: 242489 - protein, 11 aa, Japanese encephalitis virus
PKAYAQMWVLL

SEQ ID NO: 242490 - protein, 11 aa, Japanese encephalitis virus
KAYAQMWVLLY

SEQ ID NO: 242491 - protein, 11 aa, Japanese encephalitis virus
AYAQMWVLLYF

SEQ ID NO: 242492 - protein, 11 aa, Japanese encephalitis virus
YAQMWVLLYFH

SEQ ID NO: 242493 - protein, 11 aa, Japanese encephalitis virus
AQMWVLLYFHR

SEQ ID NO: 242494 - protein, 11 aa, Japanese encephalitis virus
QMWVLLYFHRR

SEQ ID NO: 242495 - protein, 11 aa, Japanese encephalitis virus
MWLLLYFHRRY

SEQ ID NO: 242496 - protein, 11 aa, Japanese encephalitis virus
RLLLYFHRRDL

SEQ ID NO: 242497 - protein, 11 aa, Japanese encephalitis virus
LLLYFHRRDLC

SEQ ID NO: 242498 - protein, 11 aa, Japanese encephalitis virus
LLYFHRRDLCL

SEQ ID NO: 242499 - protein, 11 aa, Japanese encephalitis virus
LYFHRRDQRLM

SEQ ID NO: 242500 - protein, 11 aa, Japanese encephalitis virus
YFHRRDQRLMA

SEQ ID NO: 242501 - protein, 11 aa, Japanese encephalitis virus
FHRRDQRLMAN

SEQ ID NO: 242502 - protein, 11 aa, Japanese encephalitis virus
HRRDLCLMANA

SEQ ID NO: 242503 - protein, 11 aa, Japanese encephalitis virus
RRDLCLMANAI

SEQ ID NO: 242504 - protein, 11 aa, Japanese encephalitis virus
RDQRLMANAIC

SEQ ID NO: 242505 - protein, 11 aa, Japanese encephalitis virus
DLCLMANAICS

SEQ ID NO: 242506 - protein, 11 aa, Japanese encephalitis virus
LCLMANAICSA

SEQ ID NO: 242507 - protein, 11 aa, Japanese encephalitis virus
RLMANAICSTV

SEQ ID NO: 242508 - protein, 11 aa, Japanese encephalitis virus
MANAICSAVPL

SEQ ID NO: 242509 - protein, 11 aa, Japanese encephalitis virus
ANAICSAVPVN

SEQ ID NO: 242510 - protein, 11 aa, Japanese encephalitis virus
NAICSTVPVDW

SEQ ID NO: 242511 - protein, 11 aa, Japanese encephalitis virus
AICSTVPVDWV

SEQ ID NO: 242512 - protein, 11 aa, Japanese encephalitis virus
ICSTVPVDWVP

SEQ ID NO: 242513 - protein, 11 aa, Japanese encephalitis virus
CSAVPLDWVPT

SEQ ID NO: 242514 - protein, 11 aa, Japanese encephalitis virus
SAVPVNWVPTG

SEQ ID NO: 242515 - protein, 11 aa, Japanese encephalitis virus
TVPVDWVPTGR

SEQ ID NO: 242516 - protein, 11 aa, Japanese encephalitis virus
VPVNWVPTGRT

SEQ ID NO: 242517 - protein, 11 aa, Japanese encephalitis virus
PLDWVPTGRTS

SEQ ID NO: 242518 - protein, 11 aa, Japanese encephalitis virus
LDWVPTGRTSW

SEQ ID NO: 242519 - protein, 11 aa, Japanese encephalitis virus
SWSIHSKGEWI

SEQ ID NO: 242520 - protein, 11 aa, Japanese encephalitis virus
WSIHSKGEWIP

SEQ ID NO: 242521 - protein, 11 aa, Japanese encephalitis virus
SIHSKGEWIPT

SEQ ID NO: 242522 - protein, 11 aa, Japanese encephalitis virus
IHSKGEWIPTE

SEQ ID NO: 242523 - protein, 11 aa, Japanese encephalitis virus
HSKGEWIPTED

SEQ ID NO: 242524 - protein, 11 aa, Japanese encephalitis virus
SKGEWIPTEDM

SEQ ID NO: 242525 - protein, 11 aa, Japanese encephalitis virus
KGEWIPTEDML

SEQ ID NO: 242526 - protein, 11 aa, Japanese encephalitis virus
GEWIPTEDMLQ

SEQ ID NO: 242527 - protein, 11 aa, Japanese encephalitis virus
EWIPTEDMLQV

SEQ ID NO: 242528 - protein, 11 aa, Japanese encephalitis virus
WIPTEDMLQVW

SEQ ID NO: 242529 - protein, 11 aa, Japanese encephalitis virus
IPTEDMLQVWN

SEQ ID NO: 242530 - protein, 11 aa, Japanese encephalitis virus
PTEDMLQVWNR

SEQ ID NO: 242531 - protein, 11 aa, Japanese encephalitis virus
RVWIEENEWMV

SEQ ID NO: 242532 - protein, 11 aa, Japanese encephalitis virus
VWIEENEWMTD

SEQ ID NO: 242533 - protein, 11 aa, Japanese encephalitis virus
WIEENEWMTDK

SEQ ID NO: 242534 - protein, 11 aa, Japanese encephalitis virus
IEENEWMTDKT

SEQ ID NO: 242535 - protein, 11 aa, Japanese encephalitis virus
EENEWMTDKTP

SEQ ID NO: 242536 - protein, 11 aa, Japanese encephalitis virus
DKTPIASWTDV

SEQ ID NO: 242537 - protein, 11 aa, Japanese encephalitis virus
KTPIASWTDVP

SEQ ID NO: 242538 - protein, 11 aa, Japanese encephalitis virus
TPIASWTDVPY

SEQ ID NO: 242539 - protein, 11 aa, Japanese encephalitis virus
PIASWTDVPYV

SEQ ID NO: 242540 - protein, 11 aa, Japanese encephalitis virus
IASWTDVPYVG

SEQ ID NO: 242541 - protein, 11 aa, Japanese encephalitis virus
IWCGSLIGTRA

SEQ ID NO: 242542 - protein, 11 aa, Japanese encephalitis virus
WCGSLIGTRSK

SEQ ID NO: 242543 - protein, 11 aa, Japanese encephalitis virus
CGSLIGTRSKA

SEQ ID NO: 242544 - protein, 11 aa, Japanese encephalitis virus
GSLIGTRSKAT

SEQ ID NO: 242545 - protein, 11 aa, Japanese encephalitis virus
SLIGTRSKATW

SEQ ID NO: 242546 - protein, 11 aa, Japanese encephalitis virus
LIGTRSKATWA

SEQ ID NO: 242547 - protein, 11 aa, Japanese encephalitis virus
IGTRSKATWAE

SEQ ID NO: 242548 - protein, 11 aa, Japanese encephalitis virus
GTRSKATWAEN

SEQ ID NO: 242549 - protein, 11 aa, Japanese encephalitis virus
TRSKATWAENI

SEQ ID NO: 242550 - protein, 11 aa, Japanese encephalitis virus
RSKATWAENIY

SEQ ID NO: 242551 - protein, 11 aa, Japanese encephalitis virus
SKATWAENIYA

SEQ ID NO: 242552 - protein, 11 aa, Japanese encephalitis virus
RATWAENVYAA

SEQ ID NO: 242553 - protein, 11 aa, Japanese encephalitis virus
VYAAINQVRAI

SEQ ID NO: 242554 - protein, 11 aa, Japanese encephalitis virus
YAAINQVRAIL

SEQ ID NO: 242555 - protein, 11 aa, Japanese encephalitis virus
AAINQVRAILG

SEQ ID NO: 242556 - protein, 11 aa, Japanese encephalitis virus
AINQVRAILGK

SEQ ID NO: 242557 - protein, 11 aa, Japanese encephalitis virus
INQVRAILGKE

SEQ ID NO: 242558 - protein, 11 aa, Japanese encephalitis virus
NQVRAIIGKED

SEQ ID NO: 242559 - protein, 11 aa, Japanese encephalitis virus
QVRAILGKENY

SEQ ID NO: 242560 - protein, 11 aa, Japanese encephalitis virus
VRAILGKENYV

SEQ ID NO: 242561 - protein, 11 aa, Japanese encephalitis virus
RAIIGKEDYVD

SEQ ID NO: 242562 - protein, 11 aa, Japanese encephalitis virus
AIIGKEDYVDY

SEQ ID NO: 242563 - protein, 11 aa, Japanese encephalitis virus
IIGKEDYVDYM

SEQ ID NO: 242564 - protein, 11 aa, Japanese encephalitis virus
IGKENYVDYML

SEQ ID NO: 242565 - protein, 11 aa, Japanese encephalitis virus
GKENYVDYMLS

SEQ ID NO: 242566 - protein, 11 aa, Japanese encephalitis virus
KEDYVDYMTSL

SEQ ID NO: 242567 - protein, 11 aa, Japanese encephalitis virus
ETYVDYMTSLR

SEQ ID NO: 242568 - protein, 11 aa, Japanese encephalitis virus
NYVDYMDFPQR

SEQ ID NO: 242569 - protein, 11 aa, Japanese encephalitis virus
YVDYMLSLRRY

SEQ ID NO: 242570 - protein, 11 aa, Japanese encephalitis virus
VDYMLSLRRYE

SEQ ID NO: 242571 - protein, 11 aa, Japanese encephalitis virus
DYMDFPQRIED

SEQ ID NO: 242572 - protein, 11 aa, Japanese encephalitis virus
YMDFPQRIEDV

SEQ ID NO: 242573 - protein, 11 aa, Japanese encephalitis virus
MTSLRRYEDVS

SEQ ID NO: 242574 - protein, 11 aa, Japanese encephalitis virus
SLRRYEDVSIQ

SEQ ID NO: 242575 - protein, 11 aa, Japanese encephalitis virus
LRRYEDVLTQE

SEQ ID NO: 242576 - protein, 11 aa, Japanese encephalitis virus
RRYEDVSIQED

SEQ ID NO: 242577 - protein, 11 aa, Japanese encephalitis virus
RYEDVLTQEDR

SEQ ID NO: 242578 - protein, 11 aa, Japanese encephalitis virus
IEDVLIQEDRV

SEQ ID NO: 242579 - protein, 11 aa, Japanese encephalitis virus
EDVSIQEDRVI

SEQ ID NO: 242580 - protein, 11 aa, Japanese encephalitis virus
MTKKPGGPGKS

SEQ ID NO: 242581 - protein, 11 aa, Japanese encephalitis virus
TKKPGGPGKSR

SEQ ID NO: 242582 - protein, 11 aa, Japanese encephalitis virus
KKPGGPGKSRA

SEQ ID NO: 242583 - protein, 11 aa, Japanese encephalitis virus
KPGGPGKSRAI

SEQ ID NO: 242584 - protein, 11 aa, Japanese encephalitis virus
PGGPGKSRAIN

SEQ ID NO: 242585 - protein, 11 aa, Japanese encephalitis virus
GGPGKSRAINM

SEQ ID NO: 242586 - protein, 11 aa, Japanese encephalitis virus
GPGINRAIYML

SEQ ID NO: 242587 - protein, 11 aa, Japanese encephalitis virus
PGINRAIYMLK

SEQ ID NO: 242588 - protein, 11 aa, Japanese encephalitis virus
GINRAIYMLKR

SEQ ID NO: 242589 - protein, 11 aa, Japanese encephalitis virus
INRAIYMLKRG

SEQ ID NO: 242590 - protein, 11 aa, Japanese encephalitis virus
FPLVGVKRVVI

SEQ ID NO: 242591 - protein, 11 aa, Japanese encephalitis virus
PLVGVKRVVIS

SEQ ID NO: 242592 - protein, 11 aa, Japanese encephalitis virus
LVGVKKVVMSL

SEQ ID NO: 242593 - protein, 11 aa, Japanese encephalitis virus
VGVKKVVMSLL

SEQ ID NO: 242594 - protein, 11 aa, Japanese encephalitis virus
GVKRVVISLLD

SEQ ID NO: 242595 - protein, 11 aa, Japanese encephalitis virus
GIGPLRFVLAL

SEQ ID NO: 242596 - protein, 11 aa, Japanese encephalitis virus
IGPLRFVLALV

SEQ ID NO: 242597 - protein, 11 aa, Japanese encephalitis virus
GPVRFVLAFIT

SEQ ID NO: 242598 - protein, 11 aa, Japanese encephalitis virus
PVRFVLAFITF

SEQ ID NO: 242599 - protein, 11 aa, Japanese encephalitis virus
LRFVLALVSFF

SEQ ID NO: 242600 - protein, 11 aa, Japanese encephalitis virus
RFVLALVSFFK

SEQ ID NO: 242601 - protein, 11 aa, Japanese encephalitis virus
FVLAFITFFKF

SEQ ID NO: 242602 - protein, 11 aa, Japanese encephalitis virus
VLALVSFFKFT

SEQ ID NO: 242603 - protein, 11 aa, Japanese encephalitis virus
LALVSFFKFTA

SEQ ID NO: 242604 - protein, 11 aa, Japanese encephalitis virus
ALVSFFKFTAL

SEQ ID NO: 242605 - protein, 11 aa, Japanese encephalitis virus
FITFFKFTALA

SEQ ID NO: 242606 - protein, 11 aa, Japanese encephalitis virus
SPTKALLGRWR

SEQ ID NO: 242607 - protein, 11 aa, Japanese encephalitis virus
TKALLGRWRAL

SEQ ID NO: 242608 - protein, 11 aa, Japanese encephalitis virus
KALLGRWRALE

SEQ ID NO: 242609 - protein, 11 aa, Japanese encephalitis virus
ALSGRWKAVER

SEQ ID NO: 242610 - protein, 11 aa, Japanese encephalitis virus
LSGRWKAVERS

SEQ ID NO: 242611 - protein, 11 aa, Japanese encephalitis virus
SGRWKAVERSV

SEQ ID NO: 242612 - protein, 11 aa, Japanese encephalitis virus
GRWKAVERSVA

SEQ ID NO: 242613 - protein, 11 aa, Japanese encephalitis virus
RWRALEKSVAM

SEQ ID NO: 242614 - protein, 11 aa, Japanese encephalitis virus
WKAVERSVAMK

SEQ ID NO: 242615 - protein, 11 aa, Japanese encephalitis virus
RALEKSVAMKH

SEQ ID NO: 242616 - protein, 11 aa, Japanese encephalitis virus
FKRELGTLIDV

SEQ ID NO: 242617 - protein, 11 aa, Japanese encephalitis virus
KRELGILIDAV

SEQ ID NO: 242618 - protein, 11 aa, Japanese encephalitis virus
GELGTLIDGVN

SEQ ID NO: 242619 - protein, 11 aa, Japanese encephalitis virus
ELGTLIDTVNK

SEQ ID NO: 242620 - protein, 11 aa, Japanese encephalitis virus
LGTLIDVVNKR

SEQ ID NO: 242621 - protein, 11 aa, Japanese encephalitis virus
GTLIDTVNKRG

SEQ ID NO: 242622 - protein, 11 aa, Japanese encephalitis virus
LIDVVNKRGKK

SEQ ID NO: 242623 - protein, 11 aa, Japanese encephalitis virus
GRKQNKRGGNG

SEQ ID NO: 242624 - protein, 11 aa, Japanese encephalitis virus
AGAIKLSNFQG

SEQ ID NO: 242625 - protein, 11 aa, Japanese encephalitis virus
GALKLSNFQGK

SEQ ID NO: 242626 - protein, 11 aa, Japanese encephalitis virus
ALKLSNFQGKL

SEQ ID NO: 242627 - protein, 11 aa, Japanese encephalitis virus
LKLSNFQGKLL

SEQ ID NO: 242628 - protein, 11 aa, Japanese encephalitis virus
TGNDPEDVDCW

SEQ ID NO: 242629 - protein, 11 aa, Japanese encephalitis virus
DCWCDNQEVYI

SEQ ID NO: 242630 - protein, 11 aa, Japanese encephalitis virus
CWCDNQEVYIQ

SEQ ID NO: 242631 - protein, 11 aa, Japanese encephalitis virus
WCDHQEVYVQY

SEQ ID NO: 242632 - protein, 11 aa, Japanese encephalitis virus
CDNQEVYIQYG

SEQ ID NO: 242633 - protein, 11 aa, Japanese encephalitis virus
DHQEVYVQYGR

SEQ ID NO: 242634 - protein, 11 aa, Japanese encephalitis virus
NQEVYIQYGRC

SEQ ID NO: 242635 - protein, 11 aa, Japanese encephalitis virus
YIQYGRCTRTR

SEQ ID NO: 242636 - protein, 11 aa, Japanese encephalitis virus
IQYGRCTRTRH

SEQ ID NO: 242637 - protein, 11 aa, Japanese encephalitis virus
RCTRTSHSQTS

SEQ ID NO: 242638 - protein, 11 aa, Japanese encephalitis virus
CTRTRHSKRSK

SEQ ID NO: 242639 - protein, 11 aa, Japanese encephalitis virus
TRTSHSQTSRR

SEQ ID NO: 242640 - protein, 11 aa, Japanese encephalitis virus
RTSHSQTSRRS

SEQ ID NO: 242641 - protein, 11 aa, Japanese encephalitis virus
TSHSQTSRRSV

SEQ ID NO: 242642 - protein, 11 aa, Japanese encephalitis virus
RHSKRSKRSVS

SEQ ID NO: 242643 - protein, 11 aa, Japanese encephalitis virus
HSKRSKRSVSV

SEQ ID NO: 242644 - protein, 11 aa, Japanese encephalitis virus
SQTSRRSVSVH

SEQ ID NO: 242645 - protein, 11 aa, Japanese encephalitis virus
KRSRRSVSVQP

SEQ ID NO: 242646 - protein, 11 aa, Japanese encephalitis virus
RSKRSVSVQTH

SEQ ID NO: 242647 - protein, 11 aa, Japanese encephalitis virus
SRRSVSVHTHG

SEQ ID NO: 242648 - protein, 11 aa, Japanese encephalitis virus
KRSVSVQTHGE

SEQ ID NO: 242649 - protein, 11 aa, Japanese encephalitis virus
SVQTHGESSLE

SEQ ID NO: 242650 - protein, 11 aa, Japanese encephalitis virus
VQPNGERSLVN

SEQ ID NO: 242651 - protein, 11 aa, Japanese encephalitis virus
QTHGESSLENK

SEQ ID NO: 242652 - protein, 11 aa, Japanese encephalitis virus
HGESSLENKKE

SEQ ID NO: 242653 - protein, 11 aa, Japanese encephalitis virus
GESSLVNKKKA

SEQ ID NO: 242654 - protein, 11 aa, Japanese encephalitis virus
ESSLVNKKKAW

SEQ ID NO: 242655 - protein, 11 aa, Japanese encephalitis virus
SSLVNKKKAWL

SEQ ID NO: 242656 - protein, 11 aa, Japanese encephalitis virus
SLVNKKEAWLN

SEQ ID NO: 242657 - protein, 11 aa, Japanese encephalitis virus
LVNKKKAWLDS

SEQ ID NO: 242658 - protein, 11 aa, Japanese encephalitis virus
ENKKEAWLDST

SEQ ID NO: 242659 - protein, 11 aa, Japanese encephalitis virus
NKKEAWLNSTK

SEQ ID NO: 242660 - protein, 11 aa, Japanese encephalitis virus
KKEAWLDSTRA

SEQ ID NO: 242661 - protein, 11 aa, Japanese encephalitis virus
KEAWLNSTKAT

SEQ ID NO: 242662 - protein, 11 aa, Japanese encephalitis virus
EAWLNSTKATR

SEQ ID NO: 242663 - protein, 11 aa, Japanese encephalitis virus
LNSTKATRYLV

SEQ ID NO: 242664 - protein, 11 aa, Japanese encephalitis virus
NSTKATRYLVK

SEQ ID NO: 242665 - protein, 11 aa, Japanese encephalitis virus
STKATRYLVKT

SEQ ID NO: 242666 - protein, 11 aa, Japanese encephalitis virus
TKATRYLVKTE

SEQ ID NO: 242667 - protein, 11 aa, Japanese encephalitis virus
KATRYLVKTEN

SEQ ID NO: 242668 - protein, 11 aa, Japanese encephalitis virus
RYLVKTENWIV

SEQ ID NO: 242669 - protein, 11 aa, Japanese encephalitis virus
YLVKTENWIVR

SEQ ID NO: 242670 - protein, 11 aa, Japanese encephalitis virus
LVKTENWIVRN

SEQ ID NO: 242671 - protein, 11 aa, Japanese encephalitis virus
VKTENWIVRNP

SEQ ID NO: 242672 - protein, 11 aa, Japanese encephalitis virus
IRNPGYAFLAG

SEQ ID NO: 242673 - protein, 11 aa, Japanese encephalitis virus
GQRVVFTILPL

SEQ ID NO: 242674 - protein, 11 aa, Japanese encephalitis virus
QRVVFTILPLL

SEQ ID NO: 242675 - protein, 11 aa, Japanese encephalitis virus
LGMGNRDFIER

SEQ ID NO: 242676 - protein, 11 aa, Japanese encephalitis virus
GMGNRDFVEGA

SEQ ID NO: 242677 - protein, 11 aa, Japanese encephalitis virus
MGNRDFIERAS

SEQ ID NO: 242678 - protein, 11 aa, Japanese encephalitis virus
GNRDFIQGASG

SEQ ID NO: 242679 - protein, 11 aa, Japanese encephalitis virus
NRDFIQGASGA

SEQ ID NO: 242680 - protein, 11 aa, Japanese encephalitis virus
RDFIERASGAT

SEQ ID NO: 242681 - protein, 11 aa, Japanese encephalitis virus
DFIQGASGATW

SEQ ID NO: 242682 - protein, 11 aa, Japanese encephalitis virus
FIERASGATWV

SEQ ID NO: 242683 - protein, 11 aa, Japanese encephalitis virus
IQGASGATWVD

SEQ ID NO: 242684 - protein, 11 aa, Japanese encephalitis virus
ERASGATWVDL

SEQ ID NO: 242685 - protein, 11 aa, Japanese encephalitis virus
IMANDRPTLDV

SEQ ID NO: 242686 - protein, 11 aa, Japanese encephalitis virus
MANDKPTLDRR

SEQ ID NO: 242687 - protein, 11 aa, Japanese encephalitis virus
ANDKPTLDRRM

SEQ ID NO: 242688 - protein, 11 aa, Japanese encephalitis virus
NDKPTLDRRMI

SEQ ID NO: 242689 - protein, 11 aa, Japanese encephalitis virus
DKPTLDRRMIN

SEQ ID NO: 242690 - protein, 11 aa, Japanese encephalitis virus
RPTLDVRMINI

SEQ ID NO: 242691 - protein, 11 aa, Japanese encephalitis virus
LDRRMINIEAS

SEQ ID NO: 242692 - protein, 11 aa, Japanese encephalitis virus
DRRMINIEASQ

SEQ ID NO: 242693 - protein, 11 aa, Japanese encephalitis virus
RRMINIEASQL

SEQ ID NO: 242694 - protein, 11 aa, Japanese encephalitis virus
PTTGEAHNKKR

SEQ ID NO: 242695 - protein, 11 aa, Japanese encephalitis virus
TTGEAHNEKGA

SEQ ID NO: 242696 - protein, 11 aa, Japanese encephalitis virus
TGEAHNKKRAD

SEQ ID NO: 242697 - protein, 11 aa, Japanese encephalitis virus
GEAHNEKGADS

SEQ ID NO: 242698 - protein, 11 aa, Japanese encephalitis virus
EAHNEKGADSS

SEQ ID NO: 242699 - protein, 11 aa, Japanese encephalitis virus
AHNKKRADSSY

SEQ ID NO: 242700 - protein, 11 aa, Japanese encephalitis virus
HNEKQADSSYV

SEQ ID NO: 242701 - protein, 11 aa, Japanese encephalitis virus
NEKGADSSYVC

SEQ ID NO: 242702 - protein, 11 aa, Japanese encephalitis virus
EKQADSSYVCK

SEQ ID NO: 242703 - protein, 11 aa, Japanese encephalitis virus
TDRGWRNGCGL

SEQ ID NO: 242704 - protein, 11 aa, Japanese encephalitis virus
DRGWRNGCGLF

SEQ ID NO: 242705 - protein, 11 aa, Japanese encephalitis virus
RGWGKGCGLFG

SEQ ID NO: 242706 - protein, 11 aa, Japanese encephalitis virus
GWGNGCGLSGK

SEQ ID NO: 242707 - protein, 11 aa, Japanese encephalitis virus
WGNGCGLSGKG

SEQ ID NO: 242708 - protein, 11 aa, Japanese encephalitis virus
RNGCGLFGKGS

SEQ ID NO: 242709 - protein, 11 aa, Japanese encephalitis virus
NGCGLSGKGSI

SEQ ID NO: 242710 - protein, 11 aa, Japanese encephalitis virus
CAKFSCTNKAI

SEQ ID NO: 242711 - protein, 11 aa, Japanese encephalitis virus
AKFSCTSKATG

SEQ ID NO: 242712 - protein, 11 aa, Japanese encephalitis virus
KFSCTSKATGK

SEQ ID NO: 242713 - protein, 11 aa, Japanese encephalitis virus
IQPENSKYEVG

SEQ ID NO: 242714 - protein, 11 aa, Japanese encephalitis virus
QSENIKYEVGI

SEQ ID NO: 242715 - protein, 11 aa, Japanese encephalitis virus
SENIKYEVGIF

SEQ ID NO: 242716 - protein, 11 aa, Japanese encephalitis virus
KYEVGIFVHGA

SEQ ID NO: 242717 - protein, 11 aa, Japanese encephalitis virus
YEVGIFVHGAT

SEQ ID NO: 242718 - protein, 11 aa, Japanese encephalitis virus
EVGIFVHGATT

SEQ ID NO: 242719 - protein, 11 aa, Japanese encephalitis virus
NHGNYTAQIGA

SEQ ID NO: 242720 - protein, 11 aa, Japanese encephalitis virus
HGNYSAQVGVS

SEQ ID NO: 242721 - protein, 11 aa, Japanese encephalitis virus
GNYSAQVGVSQ

SEQ ID NO: 242722 - protein, 11 aa, Japanese encephalitis virus
NYSAQVGVSQA

SEQ ID NO: 242723 - protein, 11 aa, Japanese encephalitis virus
YTAQIGASQAA

SEQ ID NO: 242724 - protein, 11 aa, Japanese encephalitis virus
TAQIGASQAAK

SEQ ID NO: 242725 - protein, 11 aa, Japanese encephalitis virus
AQVGASQAARF

SEQ ID NO: 242726 - protein, 11 aa, Japanese encephalitis virus
QIGASQAAKFT

SEQ ID NO: 242727 - protein, 11 aa, Japanese encephalitis virus
GVSQAAKFTVT

SEQ ID NO: 242728 - protein, 11 aa, Japanese encephalitis virus
VSQAAKFTVTP

SEQ ID NO: 242729 - protein, 11 aa, Japanese encephalitis virus
KFTITPNAPSI

SEQ ID NO: 242730 - protein, 11 aa, Japanese encephalitis virus
FTVTPNAPSVA

SEQ ID NO: 242731 - protein, 11 aa, Japanese encephalitis virus
TVTPNAPSVTL

SEQ ID NO: 242732 - protein, 11 aa, Japanese encephalitis virus
TPNAPSVTLEL

SEQ ID NO: 242733 - protein, 11 aa, Japanese encephalitis virus
PNAPSVTLELG

SEQ ID NO: 242734 - protein, 11 aa, Japanese encephalitis virus
NAPSVTLKLGD

SEQ ID NO: 242735 - protein, 11 aa, Japanese encephalitis virus
TLELGDYGEVT

SEQ ID NO: 242736 - protein, 11 aa, Japanese encephalitis virus
FYVMTVGSKSL

SEQ ID NO: 242737 - protein, 11 aa, Japanese encephalitis virus
YVMTVGPKSFL

SEQ ID NO: 242738 - protein, 11 aa, Japanese encephalitis virus
VMTVGPKSFLV

SEQ ID NO: 242739 - protein, 11 aa, Japanese encephalitis virus
MTVGPKSFLVH

SEQ ID NO: 242740 - protein, 11 aa, Japanese encephalitis virus
TVGPKSFLVHR

SEQ ID NO: 242741 - protein, 11 aa, Japanese encephalitis virus
VGSKSLLVHRE

SEQ ID NO: 242742 - protein, 11 aa, Japanese encephalitis virus
GPKSFLVHREW

SEQ ID NO: 242743 - protein, 11 aa, Japanese encephalitis virus
PKSFLVHREWF

SEQ ID NO: 242744 - protein, 11 aa, Japanese encephalitis virus
WFHDLALPWSS

SEQ ID NO: 242745 - protein, 11 aa, Japanese encephalitis virus
FHDLALPWSSP

SEQ ID NO: 242746 - protein, 11 aa, Japanese encephalitis virus
HDLALPWSSPS

SEQ ID NO: 242747 - protein, 11 aa, Japanese encephalitis virus
DLALPWTSSSN

SEQ ID NO: 242748 - protein, 11 aa, Japanese encephalitis virus
LALPWTSSSNT

SEQ ID NO: 242749 - protein, 11 aa, Japanese encephalitis virus
ALPWTSSSNTA

SEQ ID NO: 242750 - protein, 11 aa, Japanese encephalitis virus
LPWSSPSSTAW

SEQ ID NO: 242751 - protein, 11 aa, Japanese encephalitis virus
PWSSPSSTAWR

SEQ ID NO: 242752 - protein, 11 aa, Japanese encephalitis virus
WSSPSSTAWRN

SEQ ID NO: 242753 - protein, 11 aa, Japanese encephalitis virus
TSSSNTAWRNR

SEQ ID NO: 242754 - protein, 11 aa, Japanese encephalitis virus
SVVALGSQERA

SEQ ID NO: 242755 - protein, 11 aa, Japanese encephalitis virus
VVALGSQEGSL

SEQ ID NO: 242756 - protein, 11 aa, Japanese encephalitis virus
VALGSREGGLH

SEQ ID NO: 242757 - protein, 11 aa, Japanese encephalitis virus
ALGSQEGSLHQ

SEQ ID NO: 242758 - protein, 11 aa, Japanese encephalitis virus
LGSREGGLHQA

SEQ ID NO: 242759 - protein, 11 aa, Japanese encephalitis virus
GSQEGSLHQAL

SEQ ID NO: 242760 - protein, 11 aa, Japanese encephalitis virus
SQEGSLHQALA

SEQ ID NO: 242761 - protein, 11 aa, Japanese encephalitis virus
REGGLHQALAG

SEQ ID NO: 242762 - protein, 11 aa, Japanese encephalitis virus
ERALHQALAGA

SEQ ID NO: 242763 - protein, 11 aa, Japanese encephalitis virus
GSLHQALAGAI

SEQ ID NO: 242764 - protein, 11 aa, Japanese encephalitis virus
SLHQALAGAIV

SEQ ID NO: 242765 - protein, 11 aa, Japanese encephalitis virus
AIVVEYPSSVK

SEQ ID NO: 242766 - protein, 11 aa, Japanese encephalitis virus
IVVEYSNSVKL

SEQ ID NO: 242767 - protein, 11 aa, Japanese encephalitis virus
VVEYSNSVKLT

SEQ ID NO: 242768 - protein, 11 aa, Japanese encephalitis virus
VEYSNSVKLTS

SEQ ID NO: 242769 - protein, 11 aa, Japanese encephalitis virus
EYSNSVKLTSG

SEQ ID NO: 242770 - protein, 11 aa, Japanese encephalitis virus
YPSSVKLTSGH

SEQ ID NO: 242771 - protein, 11 aa, Japanese encephalitis virus
PSSVKLTSGHL

SEQ ID NO: 242772 - protein, 11 aa, Japanese encephalitis virus
NSVKLTSGHLK

SEQ ID NO: 242773 - protein, 11 aa, Japanese encephalitis virus
LKGTTYGVCTE

SEQ ID NO: 242774 - protein, 11 aa, Japanese encephalitis virus
KGTTYGMCTEN

SEQ ID NO: 242775 - protein, 11 aa, Japanese encephalitis virus
GTTYGVCTEKF

SEQ ID NO: 242776 - protein, 11 aa, Japanese encephalitis virus
TTYGVCTEKFS

SEQ ID NO: 242777 - protein, 11 aa, Japanese encephalitis virus
TYGMCTENSSF

SEQ ID NO: 242778 - protein, 11 aa, Japanese encephalitis virus
YGMCTENSSFR

SEQ ID NO: 242779 - protein, 11 aa, Japanese encephalitis virus
GMCTENSSFRK

SEQ ID NO: 242780 - protein, 11 aa, Japanese encephalitis virus
MCTENSSFRKN

SEQ ID NO: 242781 - protein, 11 aa, Japanese encephalitis virus
CTENSSFRKNP

SEQ ID NO: 242782 - protein, 11 aa, Japanese encephalitis virus
TKKFSFAKNPA

SEQ ID NO: 242783 - protein, 11 aa, Japanese encephalitis virus
KKFSFAKNPAD

SEQ ID NO: 242784 - protein, 11 aa, Japanese encephalitis virus
TVVIELLYSGS

SEQ ID NO: 242785 - protein, 11 aa, Japanese encephalitis virus
VVIELLYSGSD

SEQ ID NO: 242786 - protein, 11 aa, Japanese encephalitis virus
VIELLYSGSDG

SEQ ID NO: 242787 - protein, 11 aa, Japanese encephalitis virus
IELSYSGRDGP

SEQ ID NO: 242788 - protein, 11 aa, Japanese encephalitis virus
ELSYSGRDGPC

SEQ ID NO: 242789 - protein, 11 aa, Japanese encephalitis virus
LSYSGRDGPCK

SEQ ID NO: 242790 - protein, 11 aa, Japanese encephalitis virus
LYSGSDGPCKI

SEQ ID NO: 242791 - protein, 11 aa, Japanese encephalitis virus
PCKIPIVSVAN

SEQ ID NO: 242792 - protein, 11 aa, Japanese encephalitis virus
PIVSVVSLNDM

SEQ ID NO: 242793 - protein, 11 aa, Japanese encephalitis virus
IVSVANLNDMT

SEQ ID NO: 242794 - protein, 11 aa, Japanese encephalitis virus
VSVANLNDMTP

SEQ ID NO: 242795 - protein, 11 aa, Japanese encephalitis virus
SVASLNDMTPA

SEQ ID NO: 242796 - protein, 11 aa, Japanese encephalitis virus
VASLNDMTPAG

SEQ ID NO: 242797 - protein, 11 aa, Japanese encephalitis virus
ASLNDMTPAGR

SEQ ID NO: 242798 - protein, 11 aa, Japanese encephalitis virus
SLNDMTPAGRL

SEQ ID NO: 242799 - protein, 11 aa, Japanese encephalitis virus
PFVATSSSNSQ

SEQ ID NO: 242800 - protein, 11 aa, Japanese encephalitis virus
FVATSSANSKA

SEQ ID NO: 242801 - protein, 11 aa, Japanese encephalitis virus
VATSSSNSQVL

SEQ ID NO: 242802 - protein, 11 aa, Japanese encephalitis virus
SSANSKALVEM

SEQ ID NO: 242803 - protein, 11 aa, Japanese encephalitis virus
SSNSQVLVEME

SEQ ID NO: 242804 - protein, 11 aa, Japanese encephalitis virus
ANSKALVEMEP

SEQ ID NO: 242805 - protein, 11 aa, Japanese encephalitis virus
NSKALVEMEPP

SEQ ID NO: 242806 - protein, 11 aa, Japanese encephalitis virus
SKALVEMEPPF

SEQ ID NO: 242807 - protein, 11 aa, Japanese encephalitis virus
KVLLEIEPPFG

SEQ ID NO: 242808 - protein, 11 aa, Japanese encephalitis virus
FGDSYIVVGMG

SEQ ID NO: 242809 - protein, 11 aa, Japanese encephalitis virus
HHWHKPGSTLG

SEQ ID NO: 242810 - protein, 11 aa, Japanese encephalitis virus
HWHKPGSTLGK

SEQ ID NO: 242811 - protein, 11 aa, Japanese encephalitis virus
WYKAGSTLGKA

SEQ ID NO: 242812 - protein, 11 aa, Japanese encephalitis virus
HKPGSTLGKAF

SEQ ID NO: 242813 - protein, 11 aa, Japanese encephalitis virus
KPGSTLGKAFS

SEQ ID NO: 242814 - protein, 11 aa, Japanese encephalitis virus
TAWDFGSIGRV

SEQ ID NO: 242815 - protein, 11 aa, Japanese encephalitis virus
AWDFGSIGRVF

SEQ ID NO: 242816 - protein, 11 aa, Japanese encephalitis virus
WDFGSIGRVFN

SEQ ID NO: 242817 - protein, 11 aa, Japanese encephalitis virus
DFGSIGGIFNS

SEQ ID NO: 242818 - protein, 11 aa, Japanese encephalitis virus
FGSIGGIFNSI

SEQ ID NO: 242819 - protein, 11 aa, Japanese encephalitis virus
GSIGRVFNSIG

SEQ ID NO: 242820 - protein, 11 aa, Japanese encephalitis virus
SIGGAFNSIGK

SEQ ID NO: 242821 - protein, 11 aa, Japanese encephalitis virus
IGGIFNSIGKA

SEQ ID NO: 242822 - protein, 11 aa, Japanese encephalitis virus
GGIFNSIGKAV

SEQ ID NO: 242823 - protein, 11 aa, Japanese encephalitis virus
GAFNSIGKAVH

SEQ ID NO: 242824 - protein, 11 aa, Japanese encephalitis virus
AFNSIGKAVHQ

SEQ ID NO: 242825 - protein, 11 aa, Japanese encephalitis virus
GVNARNRSIAL

SEQ ID NO: 242826 - protein, 11 aa, Japanese encephalitis virus
VNARNRSIALA

SEQ ID NO: 242827 - protein, 11 aa, Japanese encephalitis virus
VHADTGCAIDV

SEQ ID NO: 242828 - protein, 11 aa, Japanese encephalitis virus
HADTGCAIDVT

SEQ ID NO: 242829 - protein, 11 aa, Japanese encephalitis virus
ADTGSAIDITR

SEQ ID NO: 242830 - protein, 11 aa, Japanese encephalitis virus
TRNQMRCGSGI

SEQ ID NO: 242831 - protein, 11 aa, Japanese encephalitis virus
ALAKIVHKAHM

SEQ ID NO: 242832 - protein, 11 aa, Japanese encephalitis virus
LAKIVHKAYKE

SEQ ID NO: 242833 - protein, 11 aa, Japanese encephalitis virus
AKIVHKAYKEG

SEQ ID NO: 242834 - protein, 11 aa, Japanese encephalitis virus
KIVHKAYKEGV

SEQ ID NO: 242835 - protein, 11 aa, Japanese encephalitis virus
IVHKAHMEGVC

SEQ ID NO: 242836 - protein, 11 aa, Japanese encephalitis virus
VHKAHMEGICG

SEQ ID NO: 242837 - protein, 11 aa, Japanese encephalitis virus
HKAHMEGVCGV

SEQ ID NO: 242838 - protein, 11 aa, Japanese encephalitis virus
KAHMEGVCGVR

SEQ ID NO: 242839 - protein, 11 aa, Japanese encephalitis virus
AYKEGVCGIRS

SEQ ID NO: 242840 - protein, 11 aa, Japanese encephalitis virus
HMEGICGVRSV

SEQ ID NO: 242841 - protein, 11 aa, Japanese encephalitis virus
MEGVCGVRSVT

SEQ ID NO: 242842 - protein, 11 aa, Japanese encephalitis virus
RSAPKRLFMTQ

SEQ ID NO: 242843 - protein, 11 aa, Japanese encephalitis virus
SAPKRLSMTRE

SEQ ID NO: 242844 - protein, 11 aa, Japanese encephalitis virus
TPKRLSMTQEK

SEQ ID NO: 242845 - protein, 11 aa, Japanese encephalitis virus
WGKSMLFAPEL

SEQ ID NO: 242846 - protein, 11 aa, Japanese encephalitis virus
GKSLLFAPELA

SEQ ID NO: 242847 - protein, 11 aa, Japanese encephalitis virus
KSLLFAPELAN

SEQ ID NO: 242848 - protein, 11 aa, Japanese encephalitis virus
SILFAPEMANS

SEQ ID NO: 242849 - protein, 11 aa, Japanese encephalitis virus
MLFAPELANST

SEQ ID NO: 242850 - protein, 11 aa, Japanese encephalitis virus
GPETKECPDEQ

SEQ ID NO: 242851 - protein, 11 aa, Japanese encephalitis virus
PETKECPVVHR

SEQ ID NO: 242852 - protein, 11 aa, Japanese encephalitis virus
ETKECPVVHRA

SEQ ID NO: 242853 - protein, 11 aa, Japanese encephalitis virus
TKECPVVHRAW

SEQ ID NO: 242854 - protein, 11 aa, Japanese encephalitis virus
KECPDEQRAWN

SEQ ID NO: 242855 - protein, 11 aa, Japanese encephalitis virus
ECPDEQRAWNS

SEQ ID NO: 242856 - protein, 11 aa, Japanese encephalitis virus
CPDERRAWNST

SEQ ID NO: 242857 - protein, 11 aa, Japanese encephalitis virus
PDEQRAWNSMQ

SEQ ID NO: 242858 - protein, 11 aa, Japanese encephalitis virus
DEQRAWNSMQI

SEQ ID NO: 242859 - protein, 11 aa, Japanese encephalitis virus
VHRAWNSMQIE

SEQ ID NO: 242860 - protein, 11 aa, Japanese encephalitis virus
QRAWNSMQIED

SEQ ID NO: 242861 - protein, 11 aa, Japanese encephalitis virus
REENTDECDGT

SEQ ID NO: 242862 - protein, 11 aa, Japanese encephalitis virus
EETTDECDGAI

SEQ ID NO: 242863 - protein, 11 aa, Japanese encephalitis virus
ETTDECDGAII

SEQ ID NO: 242864 - protein, 11 aa, Japanese encephalitis virus
NTDECDGTIIG

SEQ ID NO: 242865 - protein, 11 aa, Japanese encephalitis virus
GTIIGTAIKGH

SEQ ID NO: 242866 - protein, 11 aa, Japanese encephalitis virus
TIIGTAIKGHV

SEQ ID NO: 242867 - protein, 11 aa, Japanese encephalitis virus
IIGTAIKGHVA

SEQ ID NO: 242868 - protein, 11 aa, Japanese encephalitis virus
IGTAVKGHVTV

SEQ ID NO: 242869 - protein, 11 aa, Japanese encephalitis virus
GTAVKGHVTVH

SEQ ID NO: 242870 - protein, 11 aa, Japanese encephalitis virus
TAVKGHVTVHS

SEQ ID NO: 242871 - protein, 11 aa, Japanese encephalitis virus
AVKGHVTVHSD

SEQ ID NO: 242872 - protein, 11 aa, Japanese encephalitis virus
VKGHVTVHSDV

SEQ ID NO: 242873 - protein, 11 aa, Japanese encephalitis virus
KGHVTVHSDVS

SEQ ID NO: 242874 - protein, 11 aa, Japanese encephalitis virus
GHVALHSDLSY

SEQ ID NO: 242875 - protein, 11 aa, Japanese encephalitis virus
HVALHSDLSYW

SEQ ID NO: 242876 - protein, 11 aa, Japanese encephalitis virus
AVHSDLSYWIG

SEQ ID NO: 242877 - protein, 11 aa, Japanese encephalitis virus
LHSDLSYWIES

SEQ ID NO: 242878 - protein, 11 aa, Japanese encephalitis virus
HSDLSYWIGSR

SEQ ID NO: 242879 - protein, 11 aa, Japanese encephalitis virus
NDSWKLERAVF

SEQ ID NO: 242880 - protein, 11 aa, Japanese encephalitis virus
DTWKRERAVFE

SEQ ID NO: 242881 - protein, 11 aa, Japanese encephalitis virus
TRKLERAVFGE

SEQ ID NO: 242882 - protein, 11 aa, Japanese encephalitis virus
WKRERAVFEEV

SEQ ID NO: 242883 - protein, 11 aa, Japanese encephalitis virus
KLERLVFGEVK

SEQ ID NO: 242884 - protein, 11 aa, Japanese encephalitis virus
LERLVFGEVKS

SEQ ID NO: 242885 - protein, 11 aa, Japanese encephalitis virus
ERAVFEEVKSC

SEQ ID NO: 242886 - protein, 11 aa, Japanese encephalitis virus
RAVFEEVKSCT

SEQ ID NO: 242887 - protein, 11 aa, Japanese encephalitis virus
AVFEEVKSCTW

SEQ ID NO: 242888 - protein, 11 aa, Japanese encephalitis virus
PETHTLWGDDA

SEQ ID NO: 242889 - protein, 11 aa, Japanese encephalitis virus
ETHTLWGDDAE

SEQ ID NO: 242890 - protein, 11 aa, Japanese encephalitis virus
THTLWGDDAEE

SEQ ID NO: 242891 - protein, 11 aa, Japanese encephalitis virus
HTLWGDDAEES

SEQ ID NO: 242892 - protein, 11 aa, Japanese encephalitis virus
TLWGDGVEESD

SEQ ID NO: 242893 - protein, 11 aa, Japanese encephalitis virus
LWGDDAEESEL

SEQ ID NO: 242894 - protein, 11 aa, Japanese encephalitis virus
WGDDAEESELI

SEQ ID NO: 242895 - protein, 11 aa, Japanese encephalitis virus
GDGVEESDLVI

SEQ ID NO: 242896 - protein, 11 aa, Japanese encephalitis virus
DGVEESDLVIP

SEQ ID NO: 242897 - protein, 11 aa, Japanese encephalitis virus
DAEESELIIPH

SEQ ID NO: 242898 - protein, 11 aa, Japanese encephalitis virus
VEESDLVIPHT

SEQ ID NO: 242899 - protein, 11 aa, Japanese encephalitis virus
EESELIIPDTI

SEQ ID NO: 242900 - protein, 11 aa, Japanese encephalitis virus
ESELIIPDTIA

SEQ ID NO: 242901 - protein, 11 aa, Japanese encephalitis virus
SDLVIPHTIAG

SEQ ID NO: 242902 - protein, 11 aa, Japanese encephalitis virus
ELIIPDTIAGP

SEQ ID NO: 242903 - protein, 11 aa, Japanese encephalitis virus
LVIPHTIAGPR

SEQ ID NO: 242904 - protein, 11 aa, Japanese encephalitis virus
IIPDTIAGPKS

SEQ ID NO: 242905 - protein, 11 aa, Japanese encephalitis virus
IPDTIAGPKSK

SEQ ID NO: 242906 - protein, 11 aa, Japanese encephalitis virus
PDTIAGPKSKH

SEQ ID NO: 242907 - protein, 11 aa, Japanese encephalitis virus
DTIAGPKSKHN

SEQ ID NO: 242908 - protein, 11 aa, Japanese encephalitis virus
TIAGPKSKHNQ

SEQ ID NO: 242909 - protein, 11 aa, Japanese encephalitis virus
IAGPKSKHNQR

SEQ ID NO: 242910 - protein, 11 aa, Japanese encephalitis virus
KSKHNQREGYK

SEQ ID NO: 242911 - protein, 11 aa, Japanese encephalitis virus
SKHNRREGYMT

SEQ ID NO: 242912 - protein, 11 aa, Japanese encephalitis virus
KHNRREGYMTQ

SEQ ID NO: 242913 - protein, 11 aa, Japanese encephalitis virus
HNQREGYKTQN

SEQ ID NO: 242914 - protein, 11 aa, Japanese encephalitis virus
NRREGYMTQNQ

SEQ ID NO: 242915 - protein, 11 aa, Japanese encephalitis virus
QREGYKTQNQG

SEQ ID NO: 242916 - protein, 11 aa, Japanese encephalitis virus
TQNQGPWDEKG

SEQ ID NO: 242917 - protein, 11 aa, Japanese encephalitis virus
QNQGPWDEDGI

SEQ ID NO: 242918 - protein, 11 aa, Japanese encephalitis virus
NQGPWDENGLV

SEQ ID NO: 242919 - protein, 11 aa, Japanese encephalitis virus
QGPWDENGLVP

SEQ ID NO: 242920 - protein, 11 aa, Japanese encephalitis virus
GPWDEKGIVLD

SEQ ID NO: 242921 - protein, 11 aa, Japanese encephalitis virus
PWDEKGIVLDF

SEQ ID NO: 242922 - protein, 11 aa, Japanese encephalitis virus
WDESGIVLDFD

SEQ ID NO: 242923 - protein, 11 aa, Japanese encephalitis virus
DESGIVLDFDY

SEQ ID NO: 242924 - protein, 11 aa, Japanese encephalitis virus
ESGIVLDFDYC

SEQ ID NO: 242925 - protein, 11 aa, Japanese encephalitis virus
SGIVLDFDYCP

SEQ ID NO: 242926 - protein, 11 aa, Japanese encephalitis virus
TEDCGKRAPWV

SEQ ID NO: 242927 - protein, 11 aa, Japanese encephalitis virus
EDCGKRGPSLR

SEQ ID NO: 242928 - protein, 11 aa, Japanese encephalitis virus
DCGKRGPSLRT

SEQ ID NO: 242929 - protein, 11 aa, Japanese encephalitis virus
CGKRAPWVRTT

SEQ ID NO: 242930 - protein, 11 aa, Japanese encephalitis virus
GKRAPWVRTTT

SEQ ID NO: 242931 - protein, 11 aa, Japanese encephalitis virus
KRGPSLRTTTD

SEQ ID NO: 242932 - protein, 11 aa, Japanese encephalitis virus
RAPWVRTTTDI

SEQ ID NO: 242933 - protein, 11 aa, Japanese encephalitis virus
APWVRTTTDIG

SEQ ID NO: 242934 - protein, 11 aa, Japanese encephalitis virus
PWVRTTTDIGK

SEQ ID NO: 242935 - protein, 11 aa, Japanese encephalitis virus
WVRTTTDIGKL

SEQ ID NO: 242936 - protein, 11 aa, Japanese encephalitis virus
LRTTTDSGKLI

SEQ ID NO: 242937 - protein, 11 aa, Japanese encephalitis virus
CCRNCSLPPLR

SEQ ID NO: 242938 - protein, 11 aa, Japanese encephalitis virus
CRNCSLPPLRF

SEQ ID NO: 242939 - protein, 11 aa, Japanese encephalitis virus
RSCTLPPLRFR

SEQ ID NO: 242940 - protein, 11 aa, Japanese encephalitis virus
NCSLPPLRFRT

SEQ ID NO: 242941 - protein, 11 aa, Japanese encephalitis virus
CTLPPLRFRTG

SEQ ID NO: 242942 - protein, 11 aa, Japanese encephalitis virus
SLPPLRFRTDN

SEQ ID NO: 242943 - protein, 11 aa, Japanese encephalitis virus
LPPLRFRTGSG

SEQ ID NO: 242944 - protein, 11 aa, Japanese encephalitis virus
PPLRFRTGSGC

SEQ ID NO: 242945 - protein, 11 aa, Japanese encephalitis virus
PLRFRTGSGCW

SEQ ID NO: 242946 - protein, 11 aa, Japanese encephalitis virus
LRFRTDNGCWY

SEQ ID NO: 242947 - protein, 11 aa, Japanese encephalitis virus
RFRTGSGCWYG

SEQ ID NO: 242948 - protein, 11 aa, Japanese encephalitis virus
GCWYGMEVRPV

SEQ ID NO: 242949 - protein, 11 aa, Japanese encephalitis virus
HDETTLVRWQV

SEQ ID NO: 242950 - protein, 11 aa, Japanese encephalitis virus
GEMVDPFQMGL

SEQ ID NO: 242951 - protein, 11 aa, Japanese encephalitis virus
EMVDPFQMGLL

SEQ ID NO: 242952 - protein, 11 aa, Japanese encephalitis virus
VDPFQMGLLVM

SEQ ID NO: 242953 - protein, 11 aa, Japanese encephalitis virus
VMFLATQEVFR

SEQ ID NO: 242954 - protein, 11 aa, Japanese encephalitis virus
MFLATQEVFRK

SEQ ID NO: 242955 - protein, 11 aa, Japanese encephalitis virus
FRKRWTARLTI

SEQ ID NO: 242956 - protein, 11 aa, Japanese encephalitis virus
LVAASFAEANS

SEQ ID NO: 242957 - protein, 11 aa, Japanese encephalitis virus
VAAVFAEANSG

SEQ ID NO: 242958 - protein, 11 aa, Japanese encephalitis virus
AAVFAEANSGG

SEQ ID NO: 242959 - protein, 11 aa, Japanese encephalitis virus
ASFAEANSGGD

SEQ ID NO: 242960 - protein, 11 aa, Japanese encephalitis virus
VFAEANSGGDV

SEQ ID NO: 242961 - protein, 11 aa, Japanese encephalitis virus
FKIQPAFLVAN

SEQ ID NO: 242962 - protein, 11 aa, Japanese encephalitis virus
KIQPAFLVANM

SEQ ID NO: 242963 - protein, 11 aa, Japanese encephalitis virus
IQPAFLVANML

SEQ ID NO: 242964 - protein, 11 aa, Japanese encephalitis virus
QPAFLAMNTLS

SEQ ID NO: 242965 - protein, 11 aa, Japanese encephalitis virus
PAFLVANMLST

SEQ ID NO: 242966 - protein, 11 aa, Japanese encephalitis virus
KMLSTRWTNQE

SEQ ID NO: 242967 - protein, 11 aa, Japanese encephalitis virus
MLSAKWTNQEN

SEQ ID NO: 242968 - protein, 11 aa, Japanese encephalitis virus
SAKWTNQENMV

SEQ ID NO: 242969 - protein, 11 aa, Japanese encephalitis virus
TRWTNQENVIL

SEQ ID NO: 242970 - protein, 11 aa, Japanese encephalitis virus
RWTNQENVILV

SEQ ID NO: 242971 - protein, 11 aa, Japanese encephalitis virus
WTNQENMVLVL

SEQ ID NO: 242972 - protein, 11 aa, Japanese encephalitis virus
TNQENVILVLG

SEQ ID NO: 242973 - protein, 11 aa, Japanese encephalitis virus
NQENVILVLGA

SEQ ID NO: 242974 - protein, 11 aa, Japanese encephalitis virus
QENVILVLGAA

SEQ ID NO: 242975 - protein, 11 aa, Japanese encephalitis virus
ENMVLVLGAAF

SEQ ID NO: 242976 - protein, 11 aa, Japanese encephalitis virus
NMVLVLGAAFF

SEQ ID NO: 242977 - protein, 11 aa, Japanese encephalitis virus
VILVLGAAFFQ

SEQ ID NO: 242978 - protein, 11 aa, Japanese encephalitis virus
ILVLGAAFFQL

SEQ ID NO: 242979 - protein, 11 aa, Japanese encephalitis virus
LGAAFFQLASM

SEQ ID NO: 242980 - protein, 11 aa, Japanese encephalitis virus
GAAFFQLASMD

SEQ ID NO: 242981 - protein, 11 aa, Japanese encephalitis virus
AAFFQLASMDL

SEQ ID NO: 242982 - protein, 11 aa, Japanese encephalitis virus
AFFQLASMDLQ

SEQ ID NO: 242983 - protein, 11 aa, Japanese encephalitis virus
FFQLASMDLQI

SEQ ID NO: 242984 - protein, 11 aa, Japanese encephalitis virus
SMDLQIGVHGI

SEQ ID NO: 242985 - protein, 11 aa, Japanese encephalitis virus
MDLQIGVHGIL

SEQ ID NO: 242986 - protein, 11 aa, Japanese encephalitis virus
IKAITFPTTST

SEQ ID NO: 242987 - protein, 11 aa, Japanese encephalitis virus
KAITFPTTSTI

SEQ ID NO: 242988 - protein, 11 aa, Japanese encephalitis virus
AITFPTTSTVT

SEQ ID NO: 242989 - protein, 11 aa, Japanese encephalitis virus
ITFPTTSTITM

SEQ ID NO: 242990 - protein, 11 aa, Japanese encephalitis virus
TFPTTSTITMP

SEQ ID NO: 242991 - protein, 11 aa, Japanese encephalitis virus
MPVLTLLTPGM

SEQ ID NO: 242992 - protein, 11 aa, Japanese encephalitis virus
PVLALLTPGMK

SEQ ID NO: 242993 - protein, 11 aa, Japanese encephalitis virus
LLALLAPGMRA

SEQ ID NO: 242994 - protein, 11 aa, Japanese encephalitis virus
LALLTPGMKAL

SEQ ID NO: 242995 - protein, 11 aa, Japanese encephalitis virus
LLTPGMKALYL

SEQ ID NO: 242996 - protein, 11 aa, Japanese encephalitis virus
LAPGMRALYLD

SEQ ID NO: 242997 - protein, 11 aa, Japanese encephalitis virus
TPGMRAFDLDT

SEQ ID NO: 242998 - protein, 11 aa, Japanese encephalitis virus
PGMKALYLDTY

SEQ ID NO: 242999 - protein, 11 aa, Japanese encephalitis virus
GMRAFDLDTYR

SEQ ID NO: 243000 - protein, 11 aa, Japanese encephalitis virus
MRAFDLDTYRI

SEQ ID NO: 243001 - protein, 11 aa, Japanese encephalitis virus
RALCLDTYRII

SEQ ID NO: 243002 - protein, 11 aa, Japanese encephalitis virus
DLDTYRIILLV

SEQ ID NO: 243003 - protein, 11 aa, Japanese encephalitis virus
ILLIIGVCSLL

SEQ ID NO: 243004 - protein, 11 aa, Japanese encephalitis virus
LLIIGVCSLLQ

SEQ ID NO: 243005 - protein, 11 aa, Japanese encephalitis virus
LVIGICSLQQE

SEQ ID NO: 243006 - protein, 11 aa, Japanese encephalitis virus
VIGICSLQQER

SEQ ID NO: 243007 - protein, 11 aa, Japanese encephalitis virus
EREKTMAKKKG

SEQ ID NO: 243008 - protein, 11 aa, Japanese encephalitis virus
RRRTMAKKKGA

SEQ ID NO: 243009 - protein, 11 aa, Japanese encephalitis virus
EKTMAKKKGAV

SEQ ID NO: 243010 - protein, 11 aa, Japanese encephalitis virus
TDMWLERAADV

SEQ ID NO: 243011 - protein, 11 aa, Japanese encephalitis virus
DMWLERAADVS

SEQ ID NO: 243012 - protein, 11 aa, Japanese encephalitis virus
MWLEQAADISW

SEQ ID NO: 243013 - protein, 11 aa, Japanese encephalitis virus
SWEMGAAITGS

SEQ ID NO: 243014 - protein, 11 aa, Japanese encephalitis virus
WEMGAAITGSS

SEQ ID NO: 243015 - protein, 11 aa, Japanese encephalitis virus
EMGAAITGSSR

SEQ ID NO: 243016 - protein, 11 aa, Japanese encephalitis virus
DEDGDFHLIDV

SEQ ID NO: 243017 - protein, 11 aa, Japanese encephalitis virus
EDGDFHLIDVP

SEQ ID NO: 243018 - protein, 11 aa, Japanese encephalitis virus
LIDDPGVPWKI

SEQ ID NO: 243019 - protein, 11 aa, Japanese encephalitis virus
DVPGVPWKVWV

SEQ ID NO: 243020 - protein, 11 aa, Japanese encephalitis virus
DPGVPWKIWLL

SEQ ID NO: 243021 - protein, 11 aa, Japanese encephalitis virus
GVPWKVWVLRT

SEQ ID NO: 243022 - protein, 11 aa, Japanese encephalitis virus
VPWKIWLLRMS

SEQ ID NO: 243023 - protein, 11 aa, Japanese encephalitis virus
PWKIWLLRMSC

SEQ ID NO: 243024 - protein, 11 aa, Japanese encephalitis virus
WKVWVLRMSCS

SEQ ID NO: 243025 - protein, 11 aa, Japanese encephalitis virus
LRMSCIGLVAL

SEQ ID NO: 243026 - protein, 11 aa, Japanese encephalitis virus
RMSCSGLAALT

SEQ ID NO: 243027 - protein, 11 aa, Japanese encephalitis virus
TSCIGLAALTP

SEQ ID NO: 243028 - protein, 11 aa, Japanese encephalitis virus
SCICLAALTPW

SEQ ID NO: 243029 - protein, 11 aa, Japanese encephalitis virus
CICLAALTPWA

SEQ ID NO: 243030 - protein, 11 aa, Japanese encephalitis virus
ICLAALTPWAI

SEQ ID NO: 243031 - protein, 11 aa, Japanese encephalitis virus
THQAGVGVMYE

SEQ ID NO: 243032 - protein, 11 aa, Japanese encephalitis virus
HQAGVGVMYEN

SEQ ID NO: 243033 - protein, 11 aa, Japanese encephalitis virus
QSGVGVIYENV

SEQ ID NO: 243034 - protein, 11 aa, Japanese encephalitis virus
AGVGVMYENVL

SEQ ID NO: 243035 - protein, 11 aa, Japanese encephalitis virus
GVGVMYENVLH

SEQ ID NO: 243036 - protein, 11 aa, Japanese encephalitis virus
VGVMYENVLHT

SEQ ID NO: 243037 - protein, 11 aa, Japanese encephalitis virus
GVMYESVFHTL

SEQ ID NO: 243038 - protein, 11 aa, Japanese encephalitis virus
VMYESVFHTLW

SEQ ID NO: 243039 - protein, 11 aa, Japanese encephalitis virus
MYQNVFHTLWH

SEQ ID NO: 243040 - protein, 11 aa, Japanese encephalitis virus
YENVLHTLWHT

SEQ ID NO: 243041 - protein, 11 aa, Japanese encephalitis virus
ESVFHTLWHTT

SEQ ID NO: 243042 - protein, 11 aa, Japanese encephalitis virus
NVLHTLWHTTR

SEQ ID NO: 243043 - protein, 11 aa, Japanese encephalitis virus
LWHPTRGAAIM

SEQ ID NO: 243044 - protein, 11 aa, Japanese encephalitis virus
WHPTRGAAIMS

SEQ ID NO: 243045 - protein, 11 aa, Japanese encephalitis virus
HPTRGAAIMSG

SEQ ID NO: 243046 - protein, 11 aa, Japanese encephalitis virus
TRGAAIMSGKG

SEQ ID NO: 243047 - protein, 11 aa, Japanese encephalitis virus
RGAAIMSGKGK

SEQ ID NO: 243048 - protein, 11 aa, Japanese encephalitis virus
GAAIMSGGGKL

SEQ ID NO: 243049 - protein, 11 aa, Japanese encephalitis virus
AAIMSGKGKLT

SEQ ID NO: 243050 - protein, 11 aa, Japanese encephalitis virus
AIMSGGGKLTP

SEQ ID NO: 243051 - protein, 11 aa, Japanese encephalitis virus
IMSGKGKLTPY

SEQ ID NO: 243052 - protein, 11 aa, Japanese encephalitis virus
MSGKGKLTPYW

SEQ ID NO: 243053 - protein, 11 aa, Japanese encephalitis virus
VQVIVVEPGKV

SEQ ID NO: 243054 - protein, 11 aa, Japanese encephalitis virus
QVIVVEQGKPA

SEQ ID NO: 243055 - protein, 11 aa, Japanese encephalitis virus
FQTKPGVFRTP

SEQ ID NO: 243056 - protein, 11 aa, Japanese encephalitis virus
QTKPGVFRTPL

SEQ ID NO: 243057 - protein, 11 aa, Japanese encephalitis virus
TKPGVFRTPLG

SEQ ID NO: 243058 - protein, 11 aa, Japanese encephalitis virus
PFGKVGAVSLD

SEQ ID NO: 243059 - protein, 11 aa, Japanese encephalitis virus
LGEVGAVSLDY

SEQ ID NO: 243060 - protein, 11 aa, Japanese encephalitis virus
GKVGTVSLDYP

SEQ ID NO: 243061 - protein, 11 aa, Japanese encephalitis virus
KVGAVSLDYPR

SEQ ID NO: 243062 - protein, 11 aa, Japanese encephalitis virus
LYGNGGELGDG

SEQ ID NO: 243063 - protein, 11 aa, Japanese encephalitis virus
YGNGVELGDRS

SEQ ID NO: 243064 - protein, 11 aa, Japanese encephalitis virus
QGDRQEEPIPE

SEQ ID NO: 243065 - protein, 11 aa, Japanese encephalitis virus
GDRQEEPIPEA

SEQ ID NO: 243066 - protein, 11 aa, Japanese encephalitis virus
DRQEEPIPEAY

SEQ ID NO: 243067 - protein, 11 aa, Japanese encephalitis virus
EEPVPEAYTPS

SEQ ID NO: 243068 - protein, 11 aa, Japanese encephalitis virus
EPVPEAYTPTM

SEQ ID NO: 243069 - protein, 11 aa, Japanese encephalitis virus
PVPEAYTPSML

SEQ ID NO: 243070 - protein, 11 aa, Japanese encephalitis virus
MLKKKQMTVLD

SEQ ID NO: 243071 - protein, 11 aa, Japanese encephalitis virus
LKKKQMTVLDL

SEQ ID NO: 243072 - protein, 11 aa, Japanese encephalitis virus
KKKQMTVLDLP

SEQ ID NO: 243073 - protein, 11 aa, Japanese encephalitis virus
QMTVLDLPPGS

SEQ ID NO: 243074 - protein, 11 aa, Japanese encephalitis virus
MTVLDLPPGSG

SEQ ID NO: 243075 - protein, 11 aa, Japanese encephalitis virus
LDLHPGLGKTR

SEQ ID NO: 243076 - protein, 11 aa, Japanese encephalitis virus
DLPPGSGKTRK

SEQ ID NO: 243077 - protein, 11 aa, Japanese encephalitis virus
LPPGSGKTRKI

SEQ ID NO: 243078 - protein, 11 aa, Japanese encephalitis virus
PPGSGKTRKIL

SEQ ID NO: 243079 - protein, 11 aa, Japanese encephalitis virus
LGKTRKILPQI

SEQ ID NO: 243080 - protein, 11 aa, Japanese encephalitis virus
KTRKILPQIIR

SEQ ID NO: 243081 - protein, 11 aa, Japanese encephalitis virus
TRKILPQIIRD

SEQ ID NO: 243082 - protein, 11 aa, Japanese encephalitis virus
RKILPQTIKDA

SEQ ID NO: 243083 - protein, 11 aa, Japanese encephalitis virus
PQIIRDAIQQR

SEQ ID NO: 243084 - protein, 11 aa, Japanese encephalitis virus
QTIKDAIQQRL

SEQ ID NO: 243085 - protein, 11 aa, Japanese encephalitis virus
TIKDAIQQRLR

SEQ ID NO: 243086 - protein, 11 aa, Japanese encephalitis virus
IRDAIQQRLRT

SEQ ID NO: 243087 - protein, 11 aa, Japanese encephalitis virus
RDAIQQRLRTA

SEQ ID NO: 243088 - protein, 11 aa, Japanese encephalitis virus
DAPIHDLQDEI

SEQ ID NO: 243089 - protein, 11 aa, Japanese encephalitis virus
IHDLQDEVPDR

SEQ ID NO: 243090 - protein, 11 aa, Japanese encephalitis virus
HDLQDETPDRA

SEQ ID NO: 243091 - protein, 11 aa, Japanese encephalitis virus
DLQDEVPDRAW

SEQ ID NO: 243092 - protein, 11 aa, Japanese encephalitis virus
LQDEIPDWAWS

SEQ ID NO: 243093 - protein, 11 aa, Japanese encephalitis virus
QDEIPDWAWSS

SEQ ID NO: 243094 - protein, 11 aa, Japanese encephalitis virus
DEVPDRAWSSG

SEQ ID NO: 243095 - protein, 11 aa, Japanese encephalitis virus
WSTEYAGKTVW

SEQ ID NO: 243096 - protein, 11 aa, Japanese encephalitis virus
STEYAGKTVWF

SEQ ID NO: 243097 - protein, 11 aa, Japanese encephalitis virus
RKSVKPIILEE

SEQ ID NO: 243098 - protein, 11 aa, Japanese encephalitis virus
KSVKPIILEEG

SEQ ID NO: 243099 - protein, 11 aa, Japanese encephalitis virus
SVKPIILEEGE

SEQ ID NO: 243100 - protein, 11 aa, Japanese encephalitis virus
VKPTILEKEEG

SEQ ID NO: 243101 - protein, 11 aa, Japanese encephalitis virus
EPTILEEGEGR

SEQ ID NO: 243102 - protein, 11 aa, Japanese encephalitis virus
TILEKEEGRVI

SEQ ID NO: 243103 - protein, 11 aa, Japanese encephalitis virus
EYHYGGATSEG

SEQ ID NO: 243104 - protein, 11 aa, Japanese encephalitis virus
YHYGGPTSEDD

SEQ ID NO: 243105 - protein, 11 aa, Japanese encephalitis virus
HYGGATSEGDS

SEQ ID NO: 243106 - protein, 11 aa, Japanese encephalitis virus
YGGPTSEDDSN

SEQ ID NO: 243107 - protein, 11 aa, Japanese encephalitis virus
GGATSEGDSNL

SEQ ID NO: 243108 - protein, 11 aa, Japanese encephalitis virus
GPTSEDDSNLA

SEQ ID NO: 243109 - protein, 11 aa, Japanese encephalitis virus
ATSEDDGNLAH

SEQ ID NO: 243110 - protein, 11 aa, Japanese encephalitis virus
PEREKAFTMDV

SEQ ID NO: 243111 - protein, 11 aa, Japanese encephalitis virus
EREKAFTMDVE

SEQ ID NO: 243112 - protein, 11 aa, Japanese encephalitis virus
REKALTMDGEY

SEQ ID NO: 243113 - protein, 11 aa, Japanese encephalitis virus
EKALTMDGEYR

SEQ ID NO: 243114 - protein, 11 aa, Japanese encephalitis virus
KAFTMDVEYRL

SEQ ID NO: 243115 - protein, 11 aa, Japanese encephalitis virus
AFTMDVEYRLR

SEQ ID NO: 243116 - protein, 11 aa, Japanese encephalitis virus
FTMDVEYRLRG

SEQ ID NO: 243117 - protein, 11 aa, Japanese encephalitis virus
DNTEVEIVTRT

SEQ ID NO: 243118 - protein, 11 aa, Japanese encephalitis virus
STEVEIVTRMG

SEQ ID NO: 243119 - protein, 11 aa, Japanese encephalitis virus
KDFAAGKRSAT

SEQ ID NO: 243120 - protein, 11 aa, Japanese encephalitis virus
DFAAGKRSATS

SEQ ID NO: 243121 - protein, 11 aa, Japanese encephalitis virus
FASGKRSAVSF

SEQ ID NO: 243122 - protein, 11 aa, Japanese encephalitis virus
ASGKRSAVSFI

SEQ ID NO: 243123 - protein, 11 aa, Japanese encephalitis virus
SGKRSAVSFIE

SEQ ID NO: 243124 - protein, 11 aa, Japanese encephalitis virus
GKRSATSFIEV

SEQ ID NO: 243125 - protein, 11 aa, Japanese encephalitis virus
KRSAVSFIEEP

SEQ ID NO: 243126 - protein, 11 aa, Japanese encephalitis virus
RSAISFIEVRG

SEQ ID NO: 243127 - protein, 11 aa, Japanese encephalitis virus
SAISFIEVRGR

SEQ ID NO: 243128 - protein, 11 aa, Japanese encephalitis virus
ATSFIEVLGRM

SEQ ID NO: 243129 - protein, 11 aa, Japanese encephalitis virus
TSFIEVLGRMP

SEQ ID NO: 243130 - protein, 11 aa, Japanese encephalitis virus
EEPGRMPEHFM

SEQ ID NO: 243131 - protein, 11 aa, Japanese encephalitis virus
EPGRMPEHFMG

SEQ ID NO: 243132 - protein, 11 aa, Japanese encephalitis virus
RGRMPEHFMGK

SEQ ID NO: 243133 - protein, 11 aa, Japanese encephalitis virus
LVATAEKSGKA

SEQ ID NO: 243134 - protein, 11 aa, Japanese encephalitis virus
VATAEKGGKTH

SEQ ID NO: 243135 - protein, 11 aa, Japanese encephalitis virus
ATAEKGGKTHR

SEQ ID NO: 243136 - protein, 11 aa, Japanese encephalitis virus
TAEKSGKAHRM

SEQ ID NO: 243137 - protein, 11 aa, Japanese encephalitis virus
AEKGGKTHRMA

SEQ ID NO: 243138 - protein, 11 aa, Japanese encephalitis virus
EKSGKAHRMAL

SEQ ID NO: 243139 - protein, 11 aa, Japanese encephalitis virus
KSGKAHRMALE

SEQ ID NO: 243140 - protein, 11 aa, Japanese encephalitis virus
PDALETITLTV

SEQ ID NO: 243141 - protein, 11 aa, Japanese encephalitis virus
DALETVTLIVA

SEQ ID NO: 243142 - protein, 11 aa, Japanese encephalitis virus
ALETVTLIVAI

SEQ ID NO: 243143 - protein, 11 aa, Japanese encephalitis virus
AITAMTGGFFL

SEQ ID NO: 243144 - protein, 11 aa, Japanese encephalitis virus
ITVMTRGFFLL

SEQ ID NO: 243145 - protein, 11 aa, Japanese encephalitis virus
AVMTGGFFLLM

SEQ ID NO: 243146 - protein, 11 aa, Japanese encephalitis virus
AMTGGFFLLMM

SEQ ID NO: 243147 - protein, 11 aa, Japanese encephalitis virus
LLMKQRKGIGK

SEQ ID NO: 243148 - protein, 11 aa, Japanese encephalitis virus
LMKQRKGIGKM

SEQ ID NO: 243149 - protein, 11 aa, Japanese encephalitis virus
MKQRKGIGKMG

SEQ ID NO: 243150 - protein, 11 aa, Japanese encephalitis virus
KQRKGIGKMGL

SEQ ID NO: 243151 - protein, 11 aa, Japanese encephalitis virus
EKMGLGALVLT

SEQ ID NO: 243152 - protein, 11 aa, Japanese encephalitis virus
VLIPEPEKQRL

SEQ ID NO: 243153 - protein, 11 aa, Japanese encephalitis virus
LIPEPEKQKSQ

SEQ ID NO: 243154 - protein, 11 aa, Japanese encephalitis virus
IPEPEKQKSQT

SEQ ID NO: 243155 - protein, 11 aa, Japanese encephalitis virus
PEPEKQRLQTD

SEQ ID NO: 243156 - protein, 11 aa, Japanese encephalitis virus
EPEKQRSQTGN

SEQ ID NO: 243157 - protein, 11 aa, Japanese encephalitis virus
PEKQKSQTDNQ

SEQ ID NO: 243158 - protein, 11 aa, Japanese encephalitis virus
EKQRSQTGNQL

SEQ ID NO: 243159 - protein, 11 aa, Japanese encephalitis virus
KQRSQTGNQLA

SEQ ID NO: 243160 - protein, 11 aa, Japanese encephalitis virus
QKSQTDNQLAV

SEQ ID NO: 243161 - protein, 11 aa, Japanese encephalitis virus
RSQTGNQLAVF

SEQ ID NO: 243162 - protein, 11 aa, Japanese encephalitis virus
KTKADIKSMFA

SEQ ID NO: 243163 - protein, 11 aa, Japanese encephalitis virus
TKADIKSMFAG

SEQ ID NO: 243164 - protein, 11 aa, Japanese encephalitis virus
KADLKSMFVGK

SEQ ID NO: 243165 - protein, 11 aa, Japanese encephalitis virus
TQALGLTGLPS

SEQ ID NO: 243166 - protein, 11 aa, Japanese encephalitis virus
QALGLTGLPSM

SEQ ID NO: 243167 - protein, 11 aa, Japanese encephalitis virus
GLTGLPSVALD

SEQ ID NO: 243168 - protein, 11 aa, Japanese encephalitis virus
LTGLPSVALDL

SEQ ID NO: 243169 - protein, 11 aa, Japanese encephalitis virus
TGLPGMALDLR

SEQ ID NO: 243170 - protein, 11 aa, Japanese encephalitis virus
GLPSMTLDLRP

SEQ ID NO: 243171 - protein, 11 aa, Japanese encephalitis virus
LPGMALDLRPA

SEQ ID NO: 243172 - protein, 11 aa, Japanese encephalitis virus
PGMALDLRPAT

SEQ ID NO: 243173 - protein, 11 aa, Japanese encephalitis virus
GMALDLRPATA

SEQ ID NO: 243174 - protein, 11 aa, Japanese encephalitis virus
GCWGQITLTTV

SEQ ID NO: 243175 - protein, 11 aa, Japanese encephalitis virus
CWGQITLTTVL

SEQ ID NO: 243176 - protein, 11 aa, Japanese encephalitis virus
WGQITLTTVLT

SEQ ID NO: 243177 - protein, 11 aa, Japanese encephalitis virus
GQITLTTVLTA

SEQ ID NO: 243178 - protein, 11 aa, Japanese encephalitis virus
QITLTTSLTAM

SEQ ID NO: 243179 - protein, 11 aa, Japanese encephalitis virus
ITLTTSLTAMV

SEQ ID NO: 243180 - protein, 11 aa, Japanese encephalitis virus
TLTTVLTAMVL

SEQ ID NO: 243181 - protein, 11 aa, Japanese encephalitis virus
LTAVVLTTLHY

SEQ ID NO: 243182 - protein, 11 aa, Japanese encephalitis virus
TAMVLAILHYG

SEQ ID NO: 243183 - protein, 11 aa, Japanese encephalitis virus
VLATLHYGFML

SEQ ID NO: 243184 - protein, 11 aa, Japanese encephalitis virus
LTTLHYGYMLP

SEQ ID NO: 243185 - protein, 11 aa, Japanese encephalitis virus
ATLHYGFMLPG

SEQ ID NO: 243186 - protein, 11 aa, Japanese encephalitis virus
GSVAAFLVNPN

SEQ ID NO: 243187 - protein, 11 aa, Japanese encephalitis virus
VAAFLVNPNVS

SEQ ID NO: 243188 - protein, 11 aa, Japanese encephalitis virus
AAFLVNPNVST

SEQ ID NO: 243189 - protein, 11 aa, Japanese encephalitis virus
AFLVNPNVSTV

SEQ ID NO: 243190 - protein, 11 aa, Japanese encephalitis virus
FLVNPNVSTVR

SEQ ID NO: 243191 - protein, 11 aa, Japanese encephalitis virus
LVNPNVTTVKK

SEQ ID NO: 243192 - protein, 11 aa, Japanese encephalitis virus
VNPKITTVREA

SEQ ID NO: 243193 - protein, 11 aa, Japanese encephalitis virus
NPNVSTVRKAG

SEQ ID NO: 243194 - protein, 11 aa, Japanese encephalitis virus
PNVSTVRKAGV

SEQ ID NO: 243195 - protein, 11 aa, Japanese encephalitis virus
KITTVREAGVL

SEQ ID NO: 243196 - protein, 11 aa, Japanese encephalitis virus
VSTVRKAGVLV

SEQ ID NO: 243197 - protein, 11 aa, Japanese encephalitis virus
VRKAGVLVTAA

SEQ ID NO: 243198 - protein, 11 aa, Japanese encephalitis virus
RKAGVLVTAAT

SEQ ID NO: 243199 - protein, 11 aa, Japanese encephalitis virus
KPGVLVTAATL

SEQ ID NO: 243200 - protein, 11 aa, Japanese encephalitis virus
AGVLVTAATLS

SEQ ID NO: 243201 - protein, 11 aa, Japanese encephalitis virus
TLIKNADNPSL

SEQ ID NO: 243202 - protein, 11 aa, Japanese encephalitis virus
LIKNADNPSLK

SEQ ID NO: 243203 - protein, 11 aa, Japanese encephalitis virus
IKNADNPSLKR

SEQ ID NO: 243204 - protein, 11 aa, Japanese encephalitis virus
KNADKPSFKKG

SEQ ID NO: 243205 - protein, 11 aa, Japanese encephalitis virus
NADKPSFKKGR

SEQ ID NO: 243206 - protein, 11 aa, Japanese encephalitis virus
NPSLKRGGPGG

SEQ ID NO: 243207 - protein, 11 aa, Japanese encephalitis virus
PSLKRGGPGGR

SEQ ID NO: 243208 - protein, 11 aa, Japanese encephalitis virus
SFKKGRPGGRT

SEQ ID NO: 243209 - protein, 11 aa, Japanese encephalitis virus
LKRGGPGGRTL

SEQ ID NO: 243210 - protein, 11 aa, Japanese encephalitis virus
KRGGPGGRTLW

SEQ ID NO: 243211 - protein, 11 aa, Japanese encephalitis virus
RGRPGGRTLGD

SEQ ID NO: 243212 - protein, 11 aa, Japanese encephalitis virus
GRPGGRTLGDQ

SEQ ID NO: 243213 - protein, 11 aa, Japanese encephalitis virus
GPGGRTLWEQW

SEQ ID NO: 243214 - protein, 11 aa, Japanese encephalitis virus
PGGRTLWEQWK

SEQ ID NO: 243215 - protein, 11 aa, Japanese encephalitis virus
GGRTLWEQWKE

SEQ ID NO: 243216 - protein, 11 aa, Japanese encephalitis virus
GRTLWEQWKEK

SEQ ID NO: 243217 - protein, 11 aa, Japanese encephalitis virus
RTLGEQWKERL

SEQ ID NO: 243218 - protein, 11 aa, Japanese encephalitis virus
TLWEQWKEKLN

SEQ ID NO: 243219 - protein, 11 aa, Japanese encephalitis virus
LWEQWKEKLNA

SEQ ID NO: 243220 - protein, 11 aa, Japanese encephalitis virus
QWKEKLNALSR

SEQ ID NO: 243221 - protein, 11 aa, Japanese encephalitis virus
RLNAMSREEFF

SEQ ID NO: 243222 - protein, 11 aa, Japanese encephalitis virus
LNAMSREEFFQ

SEQ ID NO: 243223 - protein, 11 aa, Japanese encephalitis virus
NALSREEFFKY

SEQ ID NO: 243224 - protein, 11 aa, Japanese encephalitis virus
AMSREEFFQYR

SEQ ID NO: 243225 - protein, 11 aa, Japanese encephalitis virus
LSREEFFKYRR

SEQ ID NO: 243226 - protein, 11 aa, Japanese encephalitis virus
SREEFFQYRRE

SEQ ID NO: 243227 - protein, 11 aa, Japanese encephalitis virus
REEFFQYRREA

SEQ ID NO: 243228 - protein, 11 aa, Japanese encephalitis virus
EEFFQYRREAI

SEQ ID NO: 243229 - protein, 11 aa, Japanese encephalitis virus
EARRARRENNK

SEQ ID NO: 243230 - protein, 11 aa, Japanese encephalitis virus
ARRARRENNKV

SEQ ID NO: 243231 - protein, 11 aa, Japanese encephalitis virus
RRARSENNIVG

SEQ ID NO: 243232 - protein, 11 aa, Japanese encephalitis virus
RARRENNKVGG

SEQ ID NO: 243233 - protein, 11 aa, Japanese encephalitis virus
ARSENNIVGGH

SEQ ID NO: 243234 - protein, 11 aa, Japanese encephalitis virus
RRENNKVGGHP

SEQ ID NO: 243235 - protein, 11 aa, Japanese encephalitis virus
SENNIVGGHPV

SEQ ID NO: 243236 - protein, 11 aa, Japanese encephalitis virus
KVIDLGCGCGG

SEQ ID NO: 243237 - protein, 11 aa, Japanese encephalitis virus
VVDLGCGRGGW

SEQ ID NO: 243238 - protein, 11 aa, Japanese encephalitis virus
VDLGCGRGGWS

SEQ ID NO: 243239 - protein, 11 aa, Japanese encephalitis virus
LGCGRGGWSYC

SEQ ID NO: 243240 - protein, 11 aa, Japanese encephalitis virus
GCGRGGWSYCA

SEQ ID NO: 243241 - protein, 11 aa, Japanese encephalitis virus
CGRGGWSYCAA

SEQ ID NO: 243242 - protein, 11 aa, Japanese encephalitis virus
GCGGWSYYAAT

SEQ ID NO: 243243 - protein, 11 aa, Japanese encephalitis virus
CGGWSYYAATL

SEQ ID NO: 243244 - protein, 11 aa, Japanese encephalitis virus
GWSYYAATLKR

SEQ ID NO: 243245 - protein, 11 aa, Japanese encephalitis virus
WSYCAATLKKV

SEQ ID NO: 243246 - protein, 11 aa, Japanese encephalitis virus
SYYAATLKRVQ

SEQ ID NO: 243247 - protein, 11 aa, Japanese encephalitis virus
YAATLKRVQEV

SEQ ID NO: 243248 - protein, 11 aa, Japanese encephalitis virus
AATLKRVQEVR

SEQ ID NO: 243249 - protein, 11 aa, Japanese encephalitis virus
ATLKKVQEFRG

SEQ ID NO: 243250 - protein, 11 aa, Japanese encephalitis virus
TLKRVQEVRGY

SEQ ID NO: 243251 - protein, 11 aa, Japanese encephalitis virus
LKKVQEFRGYT

SEQ ID NO: 243252 - protein, 11 aa, Japanese encephalitis virus
KKVQEFRGYTK

SEQ ID NO: 243253 - protein, 11 aa, Japanese encephalitis virus
KVQEFRGYTKG

SEQ ID NO: 243254 - protein, 11 aa, Japanese encephalitis virus
WNLVSLKSGVH

SEQ ID NO: 243255 - protein, 11 aa, Japanese encephalitis virus
SLKSGVHVFYK

SEQ ID NO: 243256 - protein, 11 aa, Japanese encephalitis virus
LKSGVHVFYKP

SEQ ID NO: 243257 - protein, 11 aa, Japanese encephalitis virus
RMDRTVWRGPR

SEQ ID NO: 243258 - protein, 11 aa, Japanese encephalitis virus
MDRAVWRGPKY

SEQ ID NO: 243259 - protein, 11 aa, Japanese encephalitis virus
DRTVWRGPRYE

SEQ ID NO: 243260 - protein, 11 aa, Japanese encephalitis virus
RAVWRGPKYEE

SEQ ID NO: 243261 - protein, 11 aa, Japanese encephalitis virus
TVWRGPKYKED

SEQ ID NO: 243262 - protein, 11 aa, Japanese encephalitis virus
RAVGKGEVHST

SEQ ID NO: 243263 - protein, 11 aa, Japanese encephalitis virus
AVGKGEVHSTQ

SEQ ID NO: 243264 - protein, 11 aa, Japanese encephalitis virus
KIKKRIQKQKE

SEQ ID NO: 243265 - protein, 11 aa, Japanese encephalitis virus
RRIQKLREEFG

SEQ ID NO: 243266 - protein, 11 aa, Japanese encephalitis virus
RIQKQKEEFAT

SEQ ID NO: 243267 - protein, 11 aa, Japanese encephalitis virus
IQKLREEFGTT

SEQ ID NO: 243268 - protein, 11 aa, Japanese encephalitis virus
QKLREEFGTTW

SEQ ID NO: 243269 - protein, 11 aa, Japanese encephalitis virus
KLREGFATTWH

SEQ ID NO: 243270 - protein, 11 aa, Japanese encephalitis virus
REEFGTTWHKD

SEQ ID NO: 243271 - protein, 11 aa, Japanese encephalitis virus
EGFATTWHKDP

SEQ ID NO: 243272 - protein, 11 aa, Japanese encephalitis virus
EFATTWHKDHE

SEQ ID NO: 243273 - protein, 11 aa, Japanese encephalitis virus
FGTTWHKDPEH

SEQ ID NO: 243274 - protein, 11 aa, Japanese encephalitis virus
ATTWHKDHEHP

SEQ ID NO: 243275 - protein, 11 aa, Japanese encephalitis virus
WHRDPEHPYRT

SEQ ID NO: 243276 - protein, 11 aa, Japanese encephalitis virus
HKDHEHPYRTW

SEQ ID NO: 243277 - protein, 11 aa, Japanese encephalitis virus
KDHEHPYRTWT

SEQ ID NO: 243278 - protein, 11 aa, Japanese encephalitis virus
KLMSKPWDAIS

SEQ ID NO: 243279 - protein, 11 aa, Japanese encephalitis virus
KEEFINKVNSN

SEQ ID NO: 243280 - protein, 11 aa, Japanese encephalitis virus
EEFIKKVNSSA

SEQ ID NO: 243281 - protein, 11 aa, Japanese encephalitis virus
KVNSSAALGAV

SEQ ID NO: 243282 - protein, 11 aa, Japanese encephalitis virus
VNSDAALGAVF

SEQ ID NO: 243283 - protein, 11 aa, Japanese encephalitis virus
NSDAALGAVFA

SEQ ID NO: 243284 - protein, 11 aa, Japanese encephalitis virus
SNASLGTVFAE

SEQ ID NO: 243285 - protein, 11 aa, Japanese encephalitis virus
DAALGAVFAEQ

SEQ ID NO: 243286 - protein, 11 aa, Japanese encephalitis virus
NQWSTAREAVS

SEQ ID NO: 243287 - protein, 11 aa, Japanese encephalitis virus
QWSTAREAVND

SEQ ID NO: 243288 - protein, 11 aa, Japanese encephalitis virus
WSTAREAVNDP

SEQ ID NO: 243289 - protein, 11 aa, Japanese encephalitis virus
FWEIVDEEREN

SEQ ID NO: 243290 - protein, 11 aa, Japanese encephalitis virus
WEMVDVERENH

SEQ ID NO: 243291 - protein, 11 aa, Japanese encephalitis virus
EMVDVERENHL

SEQ ID NO: 243292 - protein, 11 aa, Japanese encephalitis virus
MVDVERENHLR

SEQ ID NO: 243293 - protein, 11 aa, Japanese encephalitis virus
LRGECHTRIYN

SEQ ID NO: 243294 - protein, 11 aa, Japanese encephalitis virus
RGECHTRIYNM

SEQ ID NO: 243295 - protein, 11 aa, Japanese encephalitis virus
GECHTRIYNMM

SEQ ID NO: 243296 - protein, 11 aa, Japanese encephalitis virus
ECHTCVYHMMG

SEQ ID NO: 243297 - protein, 11 aa, Japanese encephalitis virus
CHTRIYNMMGK

SEQ ID NO: 243298 - protein, 11 aa, Japanese encephalitis virus
HTRIYNMMGKR

SEQ ID NO: 243299 - protein, 11 aa, Japanese encephalitis virus
TRIYNMMGKRE

SEQ ID NO: 243300 - protein, 11 aa, Japanese encephalitis virus
RIYNMMGKREK

SEQ ID NO: 243301 - protein, 11 aa, Japanese encephalitis virus
EFEALGFLNEN

SEQ ID NO: 243302 - protein, 11 aa, Japanese encephalitis virus
FEALGFLNLDH

SEQ ID NO: 243303 - protein, 11 aa, Japanese encephalitis virus
EALGSLNEDHW

SEQ ID NO: 243304 - protein, 11 aa, Japanese encephalitis virus
ALGFLNENHWL

SEQ ID NO: 243305 - protein, 11 aa, Japanese encephalitis virus
LGFLNLDHWLS

SEQ ID NO: 243306 - protein, 11 aa, Japanese encephalitis virus
GSLNEDHWLSR

SEQ ID NO: 243307 - protein, 11 aa, Japanese encephalitis virus
SLNEDHWLSRE

SEQ ID NO: 243308 - protein, 11 aa, Japanese encephalitis virus
LNEDHWLSRRN

SEQ ID NO: 243309 - protein, 11 aa, Japanese encephalitis virus
NEDHWLSRRNS

SEQ ID NO: 243310 - protein, 11 aa, Japanese encephalitis virus
ENHWLSRENSG

SEQ ID NO: 243311 - protein, 11 aa, Japanese encephalitis virus
NHWLSRENSGG

SEQ ID NO: 243312 - protein, 11 aa, Japanese encephalitis virus
WLSRENSRGGV

SEQ ID NO: 243313 - protein, 11 aa, Japanese encephalitis virus
LSRRNSGGGVE

SEQ ID NO: 243314 - protein, 11 aa, Japanese encephalitis virus
SRENSRGGVEG

SEQ ID NO: 243315 - protein, 11 aa, Japanese encephalitis virus
RENSGGGVEGL

SEQ ID NO: 243316 - protein, 11 aa, Japanese encephalitis virus
NSGGGEEGSGV

SEQ ID NO: 243317 - protein, 11 aa, Japanese encephalitis virus
SGGGVEGLGVQ

SEQ ID NO: 243318 - protein, 11 aa, Japanese encephalitis virus
GGGEEGSGVQK

SEQ ID NO: 243319 - protein, 11 aa, Japanese encephalitis virus
GGEEGSGVQKL

SEQ ID NO: 243320 - protein, 11 aa, Japanese encephalitis virus
GVEGLGVQKLG

SEQ ID NO: 243321 - protein, 11 aa, Japanese encephalitis virus
EEGSGVQKLGY

SEQ ID NO: 243322 - protein, 11 aa, Japanese encephalitis virus
GVQKLGYIIRD

SEQ ID NO: 243323 - protein, 11 aa, Japanese encephalitis virus
VQKLGYIIRDI

SEQ ID NO: 243324 - protein, 11 aa, Japanese encephalitis virus
QKLGYIFRDIA

SEQ ID NO: 243325 - protein, 11 aa, Japanese encephalitis virus
RDIAVKQGGKM

SEQ ID NO: 243326 - protein, 11 aa, Japanese encephalitis virus
DITSRAIGKMY

SEQ ID NO: 243327 - protein, 11 aa, Japanese encephalitis virus
ITSRAIGKMYA

SEQ ID NO: 243328 - protein, 11 aa, Japanese encephalitis virus
AVKQGGKMYAD

SEQ ID NO: 243329 - protein, 11 aa, Japanese encephalitis virus
SRAIGKMYADD

SEQ ID NO: 243330 - protein, 11 aa, Japanese encephalitis virus
RAIGKMYADDT

SEQ ID NO: 243331 - protein, 11 aa, Japanese encephalitis virus
EGGKMYADDTA

SEQ ID NO: 243332 - protein, 11 aa, Japanese encephalitis virus
TAGWDTRITKT

SEQ ID NO: 243333 - protein, 11 aa, Japanese encephalitis virus
HKVVKVMRPST

SEQ ID NO: 243334 - protein, 11 aa, Japanese encephalitis virus
KVMRPAAKGKT

SEQ ID NO: 243335 - protein, 11 aa, Japanese encephalitis virus
VMRPAAKGKTG

SEQ ID NO: 243336 - protein, 11 aa, Japanese encephalitis virus
MRPASGGKTVM

SEQ ID NO: 243337 - protein, 11 aa, Japanese encephalitis virus
DGKTVMDVISR

SEQ ID NO: 243338 - protein, 11 aa, Japanese encephalitis virus
IGPQHLEHLPR

SEQ ID NO: 243339 - protein, 11 aa, Japanese encephalitis virus
GPQHVEQLPRK

SEQ ID NO: 243340 - protein, 11 aa, Japanese encephalitis virus
EQLPKKNKIAV

SEQ ID NO: 243341 - protein, 11 aa, Japanese encephalitis virus
QLPRENKIAVR

SEQ ID NO: 243342 - protein, 11 aa, Japanese encephalitis virus
LPKKNKIAVRT

SEQ ID NO: 243343 - protein, 11 aa, Japanese encephalitis virus
PRENKIAVRTW

SEQ ID NO: 243344 - protein, 11 aa, Japanese encephalitis virus
RENKIAVRTWL

SEQ ID NO: 243345 - protein, 11 aa, Japanese encephalitis virus
YFLNAMSKVRK

SEQ ID NO: 243346 - protein, 11 aa, Japanese encephalitis virus
NAMSKVTKDIQ

SEQ ID NO: 243347 - protein, 11 aa, Japanese encephalitis virus
AMSKVRKDILE

SEQ ID NO: 243348 - protein, 11 aa, Japanese encephalitis virus
MSKVRKDILEW

SEQ ID NO: 243349 - protein, 11 aa, Japanese encephalitis virus
SKVRKDILEWK

SEQ ID NO: 243350 - protein, 11 aa, Japanese encephalitis virus
KVRKDILEWKP

SEQ ID NO: 243351 - protein, 11 aa, Japanese encephalitis virus
VRRDIQEWKPS

SEQ ID NO: 243352 - protein, 11 aa, Japanese encephalitis virus
RKDILEWKPSH

SEQ ID NO: 243353 - protein, 11 aa, Japanese encephalitis virus
KDILEWKPSHG

SEQ ID NO: 243354 - protein, 11 aa, Japanese encephalitis virus
ILEWKPSHGWH

SEQ ID NO: 243355 - protein, 11 aa, Japanese encephalitis virus
LEWKPSHGWHD

SEQ ID NO: 243356 - protein, 11 aa, Japanese encephalitis virus
RISPGAGWNVR

SEQ ID NO: 243357 - protein, 11 aa, Japanese encephalitis virus
ISPGAGWNVMD

SEQ ID NO: 243358 - protein, 11 aa, Japanese encephalitis virus
SPGAGWNVMDT

SEQ ID NO: 243359 - protein, 11 aa, Japanese encephalitis virus
PGAGWNVRDTA

SEQ ID NO: 243360 - protein, 11 aa, Japanese encephalitis virus
GAGWNVRDTAC

SEQ ID NO: 243361 - protein, 11 aa, Japanese encephalitis virus
AGWNVMDTACL

SEQ ID NO: 243362 - protein, 11 aa, Japanese encephalitis virus
GWNVKDTACLP

SEQ ID NO: 243363 - protein, 11 aa, Japanese encephalitis virus
WNVRDTACLAK

SEQ ID NO: 243364 - protein, 11 aa, Japanese encephalitis virus
NVRDTACLAKA

SEQ ID NO: 243365 - protein, 11 aa, Japanese encephalitis virus
VMDTACLAKAY

SEQ ID NO: 243366 - protein, 11 aa, Japanese encephalitis virus
KDTACLPKAYA

SEQ ID NO: 243367 - protein, 11 aa, Japanese encephalitis virus
MWVLLYFHRRD

SEQ ID NO: 243368 - protein, 11 aa, Japanese encephalitis virus
WVLLYFHRRDL

SEQ ID NO: 243369 - protein, 11 aa, Japanese encephalitis virus
VLLYFHRRDLR

SEQ ID NO: 243370 - protein, 11 aa, Japanese encephalitis virus
LLYFHRRDQRL

SEQ ID NO: 243371 - protein, 11 aa, Japanese encephalitis virus
LYFHRRDLCLM

SEQ ID NO: 243372 - protein, 11 aa, Japanese encephalitis virus
YFHRRDLCLMA

SEQ ID NO: 243373 - protein, 11 aa, Japanese encephalitis virus
FHRRDLCLMAN

SEQ ID NO: 243374 - protein, 11 aa, Japanese encephalitis virus
HRRDQRLMANA

SEQ ID NO: 243375 - protein, 11 aa, Japanese encephalitis virus
RRDQRLMANAI

SEQ ID NO: 243376 - protein, 11 aa, Japanese encephalitis virus
RDLCLMANAIC

SEQ ID NO: 243377 - protein, 11 aa, Japanese encephalitis virus
DQRLMANAICS

SEQ ID NO: 243378 - protein, 11 aa, Japanese encephalitis virus
LRLMANAICST

SEQ ID NO: 243379 - protein, 11 aa, Japanese encephalitis virus
ANAICSAVPLD

SEQ ID NO: 243380 - protein, 11 aa, Japanese encephalitis virus
NAICSAVPLDW

SEQ ID NO: 243381 - protein, 11 aa, Japanese encephalitis virus
AICSAVPLDWV

SEQ ID NO: 243382 - protein, 11 aa, Japanese encephalitis virus
ICSAVPLDWVP

SEQ ID NO: 243383 - protein, 11 aa, Japanese encephalitis virus
CSAVPVNWVPT

SEQ ID NO: 243384 - protein, 11 aa, Japanese encephalitis virus
SAVPLDWVPTG

SEQ ID NO: 243385 - protein, 11 aa, Japanese encephalitis virus
AVPVNWVPTGR

SEQ ID NO: 243386 - protein, 11 aa, Japanese encephalitis virus
RVWIEENEWME

SEQ ID NO: 243387 - protein, 11 aa, Japanese encephalitis virus
VWIEENEWMED

SEQ ID NO: 243388 - protein, 11 aa, Japanese encephalitis virus
WIEENEWMEDK

SEQ ID NO: 243389 - protein, 11 aa, Japanese encephalitis virus
IEENEWMMDMT

SEQ ID NO: 243390 - protein, 11 aa, Japanese encephalitis virus
EENEWMEDKTP

SEQ ID NO: 243391 - protein, 11 aa, Japanese encephalitis virus
DMTPITSWTDV

SEQ ID NO: 243392 - protein, 11 aa, Japanese encephalitis virus
MTPITSWTDVP

SEQ ID NO: 243393 - protein, 11 aa, Japanese encephalitis virus
IWCGNLIGTRS

SEQ ID NO: 243394 - protein, 11 aa, Japanese encephalitis virus
WCGSLIGTRAR

SEQ ID NO: 243395 - protein, 11 aa, Japanese encephalitis virus
CGNLIGTRSRA

SEQ ID NO: 243396 - protein, 11 aa, Japanese encephalitis virus
GSLIGTRARAT

SEQ ID NO: 243397 - protein, 11 aa, Japanese encephalitis virus
NLIGTRSRATW

SEQ ID NO: 243398 - protein, 11 aa, Japanese encephalitis virus
LIGTRARATWA

SEQ ID NO: 243399 - protein, 11 aa, Japanese encephalitis virus
IGTRARATWAE

SEQ ID NO: 243400 - protein, 11 aa, Japanese encephalitis virus
GTRARATWAEN

SEQ ID NO: 243401 - protein, 11 aa, Japanese encephalitis virus
TRARATWAENI

SEQ ID NO: 243402 - protein, 11 aa, Japanese encephalitis virus
RARATWAENIY

SEQ ID NO: 243403 - protein, 11 aa, Japanese encephalitis virus
ARATWAENIYA

SEQ ID NO: 243404 - protein, 11 aa, Japanese encephalitis virus
NQVRAILGKEN

SEQ ID NO: 243405 - protein, 11 aa, Japanese encephalitis virus
QVRAIIGKETY

SEQ ID NO: 243406 - protein, 11 aa, Japanese encephalitis virus
VRAIIGKEDYV

SEQ ID NO: 243407 - protein, 11 aa, Japanese encephalitis virus
RAIIGKETYVD

SEQ ID NO: 243408 - protein, 11 aa, Japanese encephalitis virus
AIIGKETYVDY

SEQ ID NO: 243409 - protein, 11 aa, Japanese encephalitis virus
IIGKETYVDYM

SEQ ID NO: 243410 - protein, 11 aa, Japanese encephalitis virus
LGKENYVDYMD

SEQ ID NO: 243411 - protein, 11 aa, Japanese encephalitis virus
GKEDYVDYMTS

SEQ ID NO: 243412 - protein, 11 aa, Japanese encephalitis virus
KENYVDYMLSL

SEQ ID NO: 243413 - protein, 11 aa, Japanese encephalitis virus
ENYVDYMDFPQ

SEQ ID NO: 243414 - protein, 11 aa, Japanese encephalitis virus
DYVDYMTSLRR

SEQ ID NO: 243415 - protein, 11 aa, Japanese encephalitis virus
MDFPQRIEDVL

SEQ ID NO: 243416 - protein, 11 aa, Japanese encephalitis virus
FPQRIEDVLIQ

SEQ ID NO: 243417 - protein, 11 aa, Japanese encephalitis virus
LRRYEDVSIQE

SEQ ID NO: 243418 - protein, 11 aa, Japanese encephalitis virus
QRIEDVLIQED

SEQ ID NO: 243419 - protein, 11 aa, Japanese encephalitis virus
RIEDVLIQEDR

SEQ ID NO: 243420 - protein, 11 aa, Japanese encephalitis virus
YEDVLTQEDRV

SEQ ID NO: 243421 - protein, 11 aa, Japanese encephalitis virus
EDVLTQEDRVI

SEQ ID NO: 243422 - protein, 11 aa, Japanese encephalitis virus
RGPVRFVLAFI

SEQ ID NO: 243423 - protein, 11 aa, Japanese encephalitis virus
GPLRFVLALVS

SEQ ID NO: 243424 - protein, 11 aa, Japanese encephalitis virus
PLRFVLALVSF

SEQ ID NO: 243425 - protein, 11 aa, Japanese encephalitis virus
VRFVLAFITFF

SEQ ID NO: 243426 - protein, 11 aa, Japanese encephalitis virus
ALLGRWRALEK

SEQ ID NO: 243427 - protein, 11 aa, Japanese encephalitis virus
LLGRWRALEKS

SEQ ID NO: 243428 - protein, 11 aa, Japanese encephalitis virus
LGRWRALEKSV

SEQ ID NO: 243429 - protein, 11 aa, Japanese encephalitis virus
FKRELGILIDA

SEQ ID NO: 243430 - protein, 11 aa, Japanese encephalitis virus
KRELGTLIDVV

SEQ ID NO: 243431 - protein, 11 aa, Japanese encephalitis virus
RELGTLIDTVN

SEQ ID NO: 243432 - protein, 11 aa, Japanese encephalitis virus
ELGILIDAVNK

SEQ ID NO: 243433 - protein, 11 aa, Japanese encephalitis virus
LGTLIDTVNKR

SEQ ID NO: 243434 - protein, 11 aa, Japanese encephalitis virus
GILIDAVNKRG

SEQ ID NO: 243435 - protein, 11 aa, Japanese encephalitis virus
LIDGVNKRGRK

SEQ ID NO: 243436 - protein, 11 aa, Japanese encephalitis virus
VGALKLSNFQG

SEQ ID NO: 243437 - protein, 11 aa, Japanese encephalitis virus
PGNDPQDVDCW

SEQ ID NO: 243438 - protein, 11 aa, Japanese encephalitis virus
QTSRRSVSVHT

SEQ ID NO: 243439 - protein, 11 aa, Japanese encephalitis virus
TSRRSVSVHTH

SEQ ID NO: 243440 - protein, 11 aa, Japanese encephalitis virus
SRRSVSVQPNG

SEQ ID NO: 243441 - protein, 11 aa, Japanese encephalitis virus
GHRVVFTILLL

SEQ ID NO: 243442 - protein, 11 aa, Japanese encephalitis virus
HRVVFTILLLL

SEQ ID NO: 243443 - protein, 11 aa, Japanese encephalitis virus
GMGNRDFIEGV

SEQ ID NO: 243444 - protein, 11 aa, Japanese encephalitis virus
MGNRDFIQGAS

SEQ ID NO: 243445 - protein, 11 aa, Japanese encephalitis virus
GNRDFVEGASG

SEQ ID NO: 243446 - protein, 11 aa, Japanese encephalitis virus
NRDFVEGASGA

SEQ ID NO: 243447 - protein, 11 aa, Japanese encephalitis virus
RDFIEGVSGAT

SEQ ID NO: 243448 - protein, 11 aa, Japanese encephalitis virus
DFIERASGATW

SEQ ID NO: 243449 - protein, 11 aa, Japanese encephalitis virus
FIQGASGATWV

SEQ ID NO: 243450 - protein, 11 aa, Japanese encephalitis virus
IERASGATWVD

SEQ ID NO: 243451 - protein, 11 aa, Japanese encephalitis virus
NDKPTLDVRMT

SEQ ID NO: 243452 - protein, 11 aa, Japanese encephalitis virus
PTTGEAHNEKQ

SEQ ID NO: 243453 - protein, 11 aa, Japanese encephalitis virus
TTGEAHNEKQA

SEQ ID NO: 243454 - protein, 11 aa, Japanese encephalitis virus
DRGWGNGCGLS

SEQ ID NO: 243455 - protein, 11 aa, Japanese encephalitis virus
RGWRNGCGLFG

SEQ ID NO: 243456 - protein, 11 aa, Japanese encephalitis virus
GWGKGCGLFGK

SEQ ID NO: 243457 - protein, 11 aa, Japanese encephalitis virus
WGKGCGLFGKG

SEQ ID NO: 243458 - protein, 11 aa, Japanese encephalitis virus
GNGCGLSGKGS

SEQ ID NO: 243459 - protein, 11 aa, Japanese encephalitis virus
AKFSCTSKAIE

SEQ ID NO: 243460 - protein, 11 aa, Japanese encephalitis virus
KFSCTSKAIER

SEQ ID NO: 243461 - protein, 11 aa, Japanese encephalitis virus
SAQVGASQAAR

SEQ ID NO: 243462 - protein, 11 aa, Japanese encephalitis virus
AQVGVSQAAKF

SEQ ID NO: 243463 - protein, 11 aa, Japanese encephalitis virus
QVGASQAARFT

SEQ ID NO: 243464 - protein, 11 aa, Japanese encephalitis virus
GASQAARFTVT

SEQ ID NO: 243465 - protein, 11 aa, Japanese encephalitis virus
ASQAARFTVTP

SEQ ID NO: 243466 - protein, 11 aa, Japanese encephalitis virus
RFTVTPNAPSI

SEQ ID NO: 243467 - protein, 11 aa, Japanese encephalitis virus
FTVTPNAPSVT

SEQ ID NO: 243468 - protein, 11 aa, Japanese encephalitis virus
TVTPNAPSVAL

SEQ ID NO: 243469 - protein, 11 aa, Japanese encephalitis virus
TPNAPSVTLKL

SEQ ID NO: 243470 - protein, 11 aa, Japanese encephalitis virus
PNAPSVTLKLG

SEQ ID NO: 243471 - protein, 11 aa, Japanese encephalitis virus
NAPSVTLELGD

SEQ ID NO: 243472 - protein, 11 aa, Japanese encephalitis virus
FHDLALPWTSS

SEQ ID NO: 243473 - protein, 11 aa, Japanese encephalitis virus
HDLALPWTSSS

SEQ ID NO: 243474 - protein, 11 aa, Japanese encephalitis virus
DLALPWSSPSS

SEQ ID NO: 243475 - protein, 11 aa, Japanese encephalitis virus
LALPWSSPSST

SEQ ID NO: 243476 - protein, 11 aa, Japanese encephalitis virus
ALPWSSPSSTA

SEQ ID NO: 243477 - protein, 11 aa, Japanese encephalitis virus
ALGSQERALHQ

SEQ ID NO: 243478 - protein, 11 aa, Japanese encephalitis virus
LGSQEGSLHQA

SEQ ID NO: 243479 - protein, 11 aa, Japanese encephalitis virus
GSREGGLHQAL

SEQ ID NO: 243480 - protein, 11 aa, Japanese encephalitis virus
SQERALHQALA

SEQ ID NO: 243481 - protein, 11 aa, Japanese encephalitis virus
QERALHQALAG

SEQ ID NO: 243482 - protein, 11 aa, Japanese encephalitis virus
SNSVKLTSGHL

SEQ ID NO: 243483 - protein, 11 aa, Japanese encephalitis virus
KGTTYGVCTEK

SEQ ID NO: 243484 - protein, 11 aa, Japanese encephalitis virus
GTTYGMCTENS

SEQ ID NO: 243485 - protein, 11 aa, Japanese encephalitis virus
TTYGMCTENSS

SEQ ID NO: 243486 - protein, 11 aa, Japanese encephalitis virus
TYGVCTEKFSF

SEQ ID NO: 243487 - protein, 11 aa, Japanese encephalitis virus
YGVCTEKFSFA

SEQ ID NO: 243488 - protein, 11 aa, Japanese encephalitis virus
GVCTEKFSFAK

SEQ ID NO: 243489 - protein, 11 aa, Japanese encephalitis virus
VCTEKFSFAKN

SEQ ID NO: 243490 - protein, 11 aa, Japanese encephalitis virus
TENSSFRKNPA

SEQ ID NO: 243491 - protein, 11 aa, Japanese encephalitis virus
ENSSFRKNPAD

SEQ ID NO: 243492 - protein, 11 aa, Japanese encephalitis virus
IELLYSGSDGP

SEQ ID NO: 243493 - protein, 11 aa, Japanese encephalitis virus
ELLYSGSDGPC

SEQ ID NO: 243494 - protein, 11 aa, Japanese encephalitis virus
LLYSGSDGPCK

SEQ ID NO: 243495 - protein, 11 aa, Japanese encephalitis virus
SYSGSDGSCKI

SEQ ID NO: 243496 - protein, 11 aa, Japanese encephalitis virus
SVANLNDMTPV

SEQ ID NO: 243497 - protein, 11 aa, Japanese encephalitis virus
VVSLNDMTPVG

SEQ ID NO: 243498 - protein, 11 aa, Japanese encephalitis virus
ANLNDMTPVGR

SEQ ID NO: 243499 - protein, 11 aa, Japanese encephalitis virus
FVATSSSNSQV

SEQ ID NO: 243500 - protein, 11 aa, Japanese encephalitis virus
VATSSANSKAL

SEQ ID NO: 243501 - protein, 11 aa, Japanese encephalitis virus
SSSNSQVLVEM

SEQ ID NO: 243502 - protein, 11 aa, Japanese encephalitis virus
SANSKALVEME

SEQ ID NO: 243503 - protein, 11 aa, Japanese encephalitis virus
SNSQVLVEMEP

SEQ ID NO: 243504 - protein, 11 aa, Japanese encephalitis virus
FGDSYIVIGRG

SEQ ID NO: 243505 - protein, 11 aa, Japanese encephalitis virus
HHWYKAGSTLG

SEQ ID NO: 243506 - protein, 11 aa, Japanese encephalitis virus
HWYKAGSTLGK

SEQ ID NO: 243507 - protein, 11 aa, Japanese encephalitis virus
RHKAGSTLGKA

SEQ ID NO: 243508 - protein, 11 aa, Japanese encephalitis virus
SIGRVFNSIGK

SEQ ID NO: 243509 - protein, 11 aa, Japanese encephalitis virus
IGRVFNSIGKA

SEQ ID NO: 243510 - protein, 11 aa, Japanese encephalitis virus
GGAFNSIGKAV

SEQ ID NO: 243511 - protein, 11 aa, Japanese encephalitis virus
RVFNSIGKAVH

SEQ ID NO: 243512 - protein, 11 aa, Japanese encephalitis virus
HADTGSAIDIT

SEQ ID NO: 243513 - protein, 11 aa, Japanese encephalitis virus
ADTGCAIDVTR

SEQ ID NO: 243514 - protein, 11 aa, Japanese encephalitis virus
SLAKIVHKAHM

SEQ ID NO: 243515 - protein, 11 aa, Japanese encephalitis virus
KIVHKAHMEGI

SEQ ID NO: 243516 - protein, 11 aa, Japanese encephalitis virus
IVHKAHMEGIC

SEQ ID NO: 243517 - protein, 11 aa, Japanese encephalitis virus
VHKAYKEGVCG

SEQ ID NO: 243518 - protein, 11 aa, Japanese encephalitis virus
HKAHMEGICGV

SEQ ID NO: 243519 - protein, 11 aa, Japanese encephalitis virus
KAYKEGVCGIR

SEQ ID NO: 243520 - protein, 11 aa, Japanese encephalitis virus
AHMEGVCGVRS

SEQ ID NO: 243521 - protein, 11 aa, Japanese encephalitis virus
HMEGVCGVRSV

SEQ ID NO: 243522 - protein, 11 aa, Japanese encephalitis virus
MEGICGVRSVT

SEQ ID NO: 243523 - protein, 11 aa, Japanese encephalitis virus
CPVVHRAWNSM

SEQ ID NO: 243524 - protein, 11 aa, Japanese encephalitis virus
PVVHRAWNSMQ

SEQ ID NO: 243525 - protein, 11 aa, Japanese encephalitis virus
VVHRAWNSMQI

SEQ ID NO: 243526 - protein, 11 aa, Japanese encephalitis virus
ERRAWNSTQIE

SEQ ID NO: 243527 - protein, 11 aa, Japanese encephalitis virus
REETTDECDGA

SEQ ID NO: 243528 - protein, 11 aa, Japanese encephalitis virus
EENTDECDGTI

SEQ ID NO: 243529 - protein, 11 aa, Japanese encephalitis virus
ENTDECDGTII

SEQ ID NO: 243530 - protein, 11 aa, Japanese encephalitis virus
TTDECDGAIIG

SEQ ID NO: 243531 - protein, 11 aa, Japanese encephalitis virus
IGTAIKGHVAV

SEQ ID NO: 243532 - protein, 11 aa, Japanese encephalitis virus
GTAIKGHVAVH

SEQ ID NO: 243533 - protein, 11 aa, Japanese encephalitis virus
TAIKGHVAVHS

SEQ ID NO: 243534 - protein, 11 aa, Japanese encephalitis virus
AVKGHVALHSD

SEQ ID NO: 243535 - protein, 11 aa, Japanese encephalitis virus
VKGHVALHSDL

SEQ ID NO: 243536 - protein, 11 aa, Japanese encephalitis virus
NDTWKLERLVF

SEQ ID NO: 243537 - protein, 11 aa, Japanese encephalitis virus
DSWKLERAVFG

SEQ ID NO: 243538 - protein, 11 aa, Japanese encephalitis virus
TWKRERAVFEE

SEQ ID NO: 243539 - protein, 11 aa, Japanese encephalitis virus
RKLERAVFGEV

SEQ ID NO: 243540 - protein, 11 aa, Japanese encephalitis virus
TLWGDDAEESE

SEQ ID NO: 243541 - protein, 11 aa, Japanese encephalitis virus
GVEESDLVIPH

SEQ ID NO: 243542 - protein, 11 aa, Japanese encephalitis virus
LIIPDTIAGPK

SEQ ID NO: 243543 - protein, 11 aa, Japanese encephalitis virus
VIPHTIAGPRS

SEQ ID NO: 243544 - protein, 11 aa, Japanese encephalitis virus
KSKHNRREGYM

SEQ ID NO: 243545 - protein, 11 aa, Japanese encephalitis virus
QNQGPWDENGL

SEQ ID NO: 243546 - protein, 11 aa, Japanese encephalitis virus
NQGPWDEKGIV

SEQ ID NO: 243547 - protein, 11 aa, Japanese encephalitis virus
QGPWDESGIVL

SEQ ID NO: 243548 - protein, 11 aa, Japanese encephalitis virus
GPWDEDGIVLD

SEQ ID NO: 243549 - protein, 11 aa, Japanese encephalitis virus
PWDEDGIVLDF

SEQ ID NO: 243550 - protein, 11 aa, Japanese encephalitis virus
WDEKGIVLDFD

SEQ ID NO: 243551 - protein, 11 aa, Japanese encephalitis virus
DEDGIVLDFDY

SEQ ID NO: 243552 - protein, 11 aa, Japanese encephalitis virus
ENGLVPGLDYC

SEQ ID NO: 243553 - protein, 11 aa, Japanese encephalitis virus
NGLVPGLDYCP

SEQ ID NO: 243554 - protein, 11 aa, Japanese encephalitis virus
TEDCGKRGPSL

SEQ ID NO: 243555 - protein, 11 aa, Japanese encephalitis virus
EDCGKRAPWVR

SEQ ID NO: 243556 - protein, 11 aa, Japanese encephalitis virus
DCGKRAPWVRT

SEQ ID NO: 243557 - protein, 11 aa, Japanese encephalitis virus
CGKRGPSLRTT

SEQ ID NO: 243558 - protein, 11 aa, Japanese encephalitis virus
GKRGPSLRTTT

SEQ ID NO: 243559 - protein, 11 aa, Japanese encephalitis virus
HDETTLVRSRV

SEQ ID NO: 243560 - protein, 11 aa, Japanese encephalitis virus
PAFLAMKMLST

SEQ ID NO: 243561 - protein, 11 aa, Japanese encephalitis virus
NTLSTRWTNQE

SEQ ID NO: 243562 - protein, 11 aa, Japanese encephalitis virus
STRWTNQENVI

SEQ ID NO: 243563 - protein, 11 aa, Japanese encephalitis virus
AKWTNQENMVL

SEQ ID NO: 243564 - protein, 11 aa, Japanese encephalitis virus
ENVILVLGAAF

SEQ ID NO: 243565 - protein, 11 aa, Japanese encephalitis virus
NVILVLGAAFF

SEQ ID NO: 243566 - protein, 11 aa, Japanese encephalitis virus
MVLVLGAAFFQ

SEQ ID NO: 243567 - protein, 11 aa, Japanese encephalitis virus
AITFPTTSTIT

SEQ ID NO: 243568 - protein, 11 aa, Japanese encephalitis virus
ITFPTTSTVTM

SEQ ID NO: 243569 - protein, 11 aa, Japanese encephalitis virus
TFPTTSTVTMP

SEQ ID NO: 243570 - protein, 11 aa, Japanese encephalitis virus
PLLALLAPGMR

SEQ ID NO: 243571 - protein, 11 aa, Japanese encephalitis virus
VLTLLTPGMRA

SEQ ID NO: 243572 - protein, 11 aa, Japanese encephalitis virus
LTLLTPGMRAL

SEQ ID NO: 243573 - protein, 11 aa, Japanese encephalitis virus
LLTPGMRAFDL

SEQ ID NO: 243574 - protein, 11 aa, Japanese encephalitis virus
LTPGMKALYLD

SEQ ID NO: 243575 - protein, 11 aa, Japanese encephalitis virus
TPGMRALCLDT

SEQ ID NO: 243576 - protein, 11 aa, Japanese encephalitis virus
LLVIGICSLQQ

SEQ ID NO: 243577 - protein, 11 aa, Japanese encephalitis virus
LIIGVCSLLQE

SEQ ID NO: 243578 - protein, 11 aa, Japanese encephalitis virus
IIGVCSLLQER

SEQ ID NO: 243579 - protein, 11 aa, Japanese encephalitis virus
ERRRTMAKKKG

SEQ ID NO: 243580 - protein, 11 aa, Japanese encephalitis virus
REKTMAKKKGA

SEQ ID NO: 243581 - protein, 11 aa, Japanese encephalitis virus
RRTMAKKKGAV

SEQ ID NO: 243582 - protein, 11 aa, Japanese encephalitis virus
SWGMDAAITGS

SEQ ID NO: 243583 - protein, 11 aa, Japanese encephalitis virus
WGMDAAITGSS

SEQ ID NO: 243584 - protein, 11 aa, Japanese encephalitis virus
GMDAAITGSSR

SEQ ID NO: 243585 - protein, 11 aa, Japanese encephalitis virus
WKIWLLRMSCI

SEQ ID NO: 243586 - protein, 11 aa, Japanese encephalitis virus
LRTSCIGLAAL

SEQ ID NO: 243587 - protein, 11 aa, Japanese encephalitis virus
RMSCIGLVALT

SEQ ID NO: 243588 - protein, 11 aa, Japanese encephalitis virus
MSCIGLVALTP

SEQ ID NO: 243589 - protein, 11 aa, Japanese encephalitis virus
YQAGVGVMYQN

SEQ ID NO: 243590 - protein, 11 aa, Japanese encephalitis virus
AGVGVMYQNVF

SEQ ID NO: 243591 - protein, 11 aa, Japanese encephalitis virus
GVGVMYESVFH

SEQ ID NO: 243592 - protein, 11 aa, Japanese encephalitis virus
VGVMYQNVFHT

SEQ ID NO: 243593 - protein, 11 aa, Japanese encephalitis virus
GVMYENVLHTL

SEQ ID NO: 243594 - protein, 11 aa, Japanese encephalitis virus
VIYENVFHTLW

SEQ ID NO: 243595 - protein, 11 aa, Japanese encephalitis virus
IYENVFHTLWH

SEQ ID NO: 243596 - protein, 11 aa, Japanese encephalitis virus
YESVFHTLWHT

SEQ ID NO: 243597 - protein, 11 aa, Japanese encephalitis virus
QNVFHTLWHTT

SEQ ID NO: 243598 - protein, 11 aa, Japanese encephalitis virus
TRGAAIMSGGG

SEQ ID NO: 243599 - protein, 11 aa, Japanese encephalitis virus
RGAAIMSGGGK

SEQ ID NO: 243600 - protein, 11 aa, Japanese encephalitis virus
GAAIMSGKGKL

SEQ ID NO: 243601 - protein, 11 aa, Japanese encephalitis virus
AAIMSGGGKLT

SEQ ID NO: 243602 - protein, 11 aa, Japanese encephalitis virus
AIMSGKGKLTP

SEQ ID NO: 243603 - protein, 11 aa, Japanese encephalitis virus
IMSGGGKLTPY

SEQ ID NO: 243604 - protein, 11 aa, Japanese encephalitis virus
VQVIVVEQGKP

SEQ ID NO: 243605 - protein, 11 aa, Japanese encephalitis virus
QVIVVEPGKVA

SEQ ID NO: 243606 - protein, 11 aa, Japanese encephalitis virus
IQTKPGIFPPP

SEQ ID NO: 243607 - protein, 11 aa, Japanese encephalitis virus
QTKPGVFCTPF

SEQ ID NO: 243608 - protein, 11 aa, Japanese encephalitis virus
TKPGIFPTPFG

SEQ ID NO: 243609 - protein, 11 aa, Japanese encephalitis virus
PLGEVGAVSLD

SEQ ID NO: 243610 - protein, 11 aa, Japanese encephalitis virus
FGKVGTVSLDY

SEQ ID NO: 243611 - protein, 11 aa, Japanese encephalitis virus
EEPIPEAYNPS

SEQ ID NO: 243612 - protein, 11 aa, Japanese encephalitis virus
EPIPEAYNPSM

SEQ ID NO: 243613 - protein, 11 aa, Japanese encephalitis virus
PIPEAYNPSML

SEQ ID NO: 243614 - protein, 11 aa, Japanese encephalitis virus
IIRDAIQQRLR

SEQ ID NO: 243615 - protein, 11 aa, Japanese encephalitis virus
EYGGATSEDDS

SEQ ID NO: 243616 - protein, 11 aa, Japanese encephalitis virus
KRSAISFIEVR

SEQ ID NO: 243617 - protein, 11 aa, Japanese encephalitis virus
RSAVSFIEEPG

SEQ ID NO: 243618 - protein, 11 aa, Japanese encephalitis virus
SATSFIEVLGR

SEQ ID NO: 243619 - protein, 11 aa, Japanese encephalitis virus
AVSFIEEPGRM

SEQ ID NO: 243620 - protein, 11 aa, Japanese encephalitis virus
VSFIEEPGRMP

SEQ ID NO: 243621 - protein, 11 aa, Japanese encephalitis virus
PDALETITLII

SEQ ID NO: 243622 - protein, 11 aa, Japanese encephalitis virus
DALETITLIIA

SEQ ID NO: 243623 - protein, 11 aa, Japanese encephalitis virus
ALETITLIIAI

SEQ ID NO: 243624 - protein, 11 aa, Japanese encephalitis virus
PEPEKQRSQTG

SEQ ID NO: 243625 - protein, 11 aa, Japanese encephalitis virus
EPEKQKSQTDN

SEQ ID NO: 243626 - protein, 11 aa, Japanese encephalitis virus
PEKQRSQTGNQ

SEQ ID NO: 243627 - protein, 11 aa, Japanese encephalitis virus
EKQKSQTDNQL

SEQ ID NO: 243628 - protein, 11 aa, Japanese encephalitis virus
RTKADLKSMFG

SEQ ID NO: 243629 - protein, 11 aa, Japanese encephalitis virus
KADIKSMFAGK

SEQ ID NO: 243630 - protein, 11 aa, Japanese encephalitis virus
QASGLTGLPSV

SEQ ID NO: 243631 - protein, 11 aa, Japanese encephalitis virus
QITLTTVLTAM

SEQ ID NO: 243632 - protein, 11 aa, Japanese encephalitis virus
ITLTTVLTAMV

SEQ ID NO: 243633 - protein, 11 aa, Japanese encephalitis virus
LTAMVLAILHY

SEQ ID NO: 243634 - protein, 11 aa, Japanese encephalitis virus
TAVVLTTLHYG

SEQ ID NO: 243635 - protein, 11 aa, Japanese encephalitis virus
VLAILHYGYML

SEQ ID NO: 243636 - protein, 11 aa, Japanese encephalitis virus
LATLHYGFMLP

SEQ ID NO: 243637 - protein, 11 aa, Japanese encephalitis virus
AILHYGYMLPG

SEQ ID NO: 243638 - protein, 11 aa, Japanese encephalitis virus
FLVNPNVTTVK

SEQ ID NO: 243639 - protein, 11 aa, Japanese encephalitis virus
IKNADKPSFKK

SEQ ID NO: 243640 - protein, 11 aa, Japanese encephalitis virus
KNADKPSLKKG

SEQ ID NO: 243641 - protein, 11 aa, Japanese encephalitis virus
NADNPSLKRGG

SEQ ID NO: 243642 - protein, 11 aa, Japanese encephalitis virus
KPSFKKGRPGG

SEQ ID NO: 243643 - protein, 11 aa, Japanese encephalitis virus
PSFKKGRPGGR

SEQ ID NO: 243644 - protein, 11 aa, Japanese encephalitis virus
SLKRGGPGGRT

SEQ ID NO: 243645 - protein, 11 aa, Japanese encephalitis virus
FKKGRPGGRTL

SEQ ID NO: 243646 - protein, 11 aa, Japanese encephalitis virus
RGGPGGRTLWE

SEQ ID NO: 243647 - protein, 11 aa, Japanese encephalitis virus
GRTLGDQWKEK

SEQ ID NO: 243648 - protein, 11 aa, Japanese encephalitis virus
RTLGEQWKRKL

SEQ ID NO: 243649 - protein, 11 aa, Japanese encephalitis virus
TLGDQWKEKLN

SEQ ID NO: 243650 - protein, 11 aa, Japanese encephalitis virus
LGDQWKEKLNA

SEQ ID NO: 243651 - protein, 11 aa, Japanese encephalitis virus
QWKRKLNAMGR

SEQ ID NO: 243652 - protein, 11 aa, Japanese encephalitis virus
KLNALSREEFF

SEQ ID NO: 243653 - protein, 11 aa, Japanese encephalitis virus
LNALSREEFFK

SEQ ID NO: 243654 - protein, 11 aa, Japanese encephalitis virus
NAMSREEFFQY

SEQ ID NO: 243655 - protein, 11 aa, Japanese encephalitis virus
ALSREEFFKYR

SEQ ID NO: 243656 - protein, 11 aa, Japanese encephalitis virus
MSREEFFQYRR

SEQ ID NO: 243657 - protein, 11 aa, Japanese encephalitis virus
EARRARSENNI

SEQ ID NO: 243658 - protein, 11 aa, Japanese encephalitis virus
ARRARSENNIV

SEQ ID NO: 243659 - protein, 11 aa, Japanese encephalitis virus
RRARRENNKVG

SEQ ID NO: 243660 - protein, 11 aa, Japanese encephalitis virus
DRAVWRGPKYE

SEQ ID NO: 243661 - protein, 11 aa, Japanese encephalitis virus
KIRRRIQKLRE

SEQ ID NO: 243662 - protein, 11 aa, Japanese encephalitis virus
KRIQKLREGFA

SEQ ID NO: 243663 - protein, 11 aa, Japanese encephalitis virus
RIQKLREEFGT

SEQ ID NO: 243664 - protein, 11 aa, Japanese encephalitis virus
IQKQKEEFATT

SEQ ID NO: 243665 - protein, 11 aa, Japanese encephalitis virus
QKQKEEFATTW

SEQ ID NO: 243666 - protein, 11 aa, Japanese encephalitis virus
KLREEFGTTWH

SEQ ID NO: 243667 - protein, 11 aa, Japanese encephalitis virus
REGFATTWHKD

SEQ ID NO: 243668 - protein, 11 aa, Japanese encephalitis virus
EEFGTTWHKDP

SEQ ID NO: 243669 - protein, 11 aa, Japanese encephalitis virus
GFATTWHKDPE

SEQ ID NO: 243670 - protein, 11 aa, Japanese encephalitis virus
KEEFIKKVNSD

SEQ ID NO: 243671 - protein, 11 aa, Japanese encephalitis virus
EEFINKVNSNA

SEQ ID NO: 243672 - protein, 11 aa, Japanese encephalitis virus
KVNSNASLGAV

SEQ ID NO: 243673 - protein, 11 aa, Japanese encephalitis virus
VNSNASLGTVF

SEQ ID NO: 243674 - protein, 11 aa, Japanese encephalitis virus
NSSAALGAVFA

SEQ ID NO: 243675 - protein, 11 aa, Japanese encephalitis virus
SSAALGAVFAE

SEQ ID NO: 243676 - protein, 11 aa, Japanese encephalitis virus
NASLGTVFAEQ

SEQ ID NO: 243677 - protein, 11 aa, Japanese encephalitis virus
WSTAREAVGDS

SEQ ID NO: 243678 - protein, 11 aa, Japanese encephalitis virus
FWEMVDVEREN

SEQ ID NO: 243679 - protein, 11 aa, Japanese encephalitis virus
FLNLDHWLSRE

SEQ ID NO: 243680 - protein, 11 aa, Japanese encephalitis virus
RENSGGGEEGS

SEQ ID NO: 243681 - protein, 11 aa, Japanese encephalitis virus
NSRGGVEGSSV

SEQ ID NO: 243682 - protein, 11 aa, Japanese encephalitis virus
SGGGEEGSGVQ

SEQ ID NO: 243683 - protein, 11 aa, Japanese encephalitis virus
GGGVEGLGVQK

SEQ ID NO: 243684 - protein, 11 aa, Japanese encephalitis virus
GVQKLGYIFRD

SEQ ID NO: 243685 - protein, 11 aa, Japanese encephalitis virus
KVMRPASGGKT

SEQ ID NO: 243686 - protein, 11 aa, Japanese encephalitis virus
VMRPASGGKTV

SEQ ID NO: 243687 - protein, 11 aa, Japanese encephalitis virus
MRPSTDGKTVM

SEQ ID NO: 243688 - protein, 11 aa, Japanese encephalitis virus
EGKTVMVVYSR

SEQ ID NO: 243689 - protein, 11 aa, Japanese encephalitis virus
GPQHLEQLPKK

SEQ ID NO: 243690 - protein, 11 aa, Japanese encephalitis virus
EQLPRENKIAV

SEQ ID NO: 243691 - protein, 11 aa, Japanese encephalitis virus
QLPKKNKIAVR

SEQ ID NO: 243692 - protein, 11 aa, Japanese encephalitis virus
GWNVRDTACLA

SEQ ID NO: 243693 - protein, 11 aa, Japanese encephalitis virus
WNVKDTACLPK

SEQ ID NO: 243694 - protein, 11 aa, Japanese encephalitis virus
WLLLYFHRRDQ

SEQ ID NO: 243695 - protein, 11 aa, Japanese encephalitis virus
LLLYFHRRDQR

SEQ ID NO: 243696 - protein, 11 aa, Japanese encephalitis virus
RVWIEENEWMT

SEQ ID NO: 243697 - protein, 11 aa, Japanese encephalitis virus
WIEENEWMMDM

SEQ ID NO: 243698 - protein, 11 aa, Japanese encephalitis virus
IEENEWMEDKT

SEQ ID NO: 243699 - protein, 11 aa, Japanese encephalitis virus
EENEWMMDMTP

SEQ ID NO: 243700 - protein, 11 aa, Japanese encephalitis virus
WCGNLIGTRSR

SEQ ID NO: 243701 - protein, 11 aa, Japanese encephalitis virus
CGSLIGTRARA

SEQ ID NO: 243702 - protein, 11 aa, Japanese encephalitis virus
GNLIGTRSRAT

SEQ ID NO: 243703 - protein, 11 aa, Japanese encephalitis virus
SLIGTRARATW

SEQ ID NO: 243704 - protein, 11 aa, Japanese encephalitis virus
TRSRATWAENV

SEQ ID NO: 243705 - protein, 11 aa, Japanese encephalitis virus
RSRATWAENVY

SEQ ID NO: 243706 - protein, 11 aa, Japanese encephalitis virus
SRATWAENVYA

SEQ ID NO: 243707 - protein, 11 aa, Japanese encephalitis virus
NQVRAIIGKET

SEQ ID NO: 243708 - protein, 11 aa, Japanese encephalitis virus
QVRAIIGKEDY

SEQ ID NO: 243709 - protein, 11 aa, Japanese encephalitis virus
VRAIIGKETYV

SEQ ID NO: 243710 - protein, 11 aa, Japanese encephalitis virus
RAILGKENYVD

SEQ ID NO: 243711 - protein, 11 aa, Japanese encephalitis virus
AILGKENYVDY

SEQ ID NO: 243712 - protein, 11 aa, Japanese encephalitis virus
ILGKENYVDYM

SEQ ID NO: 243713 - protein, 11 aa, Japanese encephalitis virus
IGKETYVDYMT

SEQ ID NO: 243714 - protein, 11 aa, Japanese encephalitis virus
GKENYVDYMDF

SEQ ID NO: 243715 - protein, 11 aa, Japanese encephalitis virus
KETYVDYMTSL

SEQ ID NO: 243716 - protein, 11 aa, Japanese encephalitis virus
EDYVDYMTSLR

SEQ ID NO: 243717 - protein, 11 aa, Japanese encephalitis virus
NYVDYMLSLRR

SEQ ID NO: 243718 - protein, 11 aa, Japanese encephalitis virus
SLRRYEDVLTQ

SEQ ID NO: 243719 - protein, 11 aa, Japanese encephalitis virus
PQRIEDVLIQE

SEQ ID NO: 243720 - protein, 11 aa, Japanese encephalitis virus
RRYEDVLTQED

SEQ ID NO: 243721 - protein, 11 aa, Japanese encephalitis virus
RYEDVSIQEDR

SEQ ID NO: 243722 - protein, 11 aa, Japanese encephalitis virus
YEDVSIQEDRV

SEQ ID NO: 243723 - protein, 8 aa, Dengue virus
SQLAKRFS

SEQ ID NO: 243724 - protein, 8 aa, Dengue virus
QLAKRFSK

SEQ ID NO: 243725 - protein, 8 aa, Dengue virus
LAKRFSKG

SEQ ID NO: 243726 - protein, 8 aa, Dengue virus
AKRFSKGL

SEQ ID NO: 243727 - protein, 8 aa, Dengue virus
GKSLLFKT

SEQ ID NO: 243728 - protein, 8 aa, Dengue virus
EPEDIDCW

SEQ ID NO: 243729 - protein, 8 aa, Dengue virus
PEDIDCWC

SEQ ID NO: 243730 - protein, 8 aa, Dengue virus
VLEHGSCV

SEQ ID NO: 243731 - protein, 8 aa, Dengue virus
LEHGSCVT

SEQ ID NO: 243732 - protein, 8 aa, Dengue virus
VDRGWGNG

SEQ ID NO: 243733 - protein, 8 aa, Dengue virus
DRGWGNGC

SEQ ID NO: 243734 - protein, 8 aa, Dengue virus
RGWGNGCG

SEQ ID NO: 243735 - protein, 8 aa, Dengue virus
GWGNGCGL

SEQ ID NO: 243736 - protein, 8 aa, Dengue virus
WGNGCGLF

SEQ ID NO: 243737 - protein, 8 aa, Dengue virus
GNGCGLFG

SEQ ID NO: 243738 - protein, 8 aa, Dengue virus
NGCGLFGK

SEQ ID NO: 243739 - protein, 8 aa, Dengue virus
GCGLFGKG

SEQ ID NO: 243740 - protein, 8 aa, Dengue virus
CGLFGKGS

SEQ ID NO: 243741 - protein, 8 aa, Dengue virus
GLFGKGSL

SEQ ID NO: 243742 - protein, 8 aa, Dengue virus
TGDQHQVG

SEQ ID NO: 243743 - protein, 8 aa, Dengue virus
GDQHQVGN

SEQ ID NO: 243744 - protein, 8 aa, Dengue virus
CSPRTGLD

SEQ ID NO: 243745 - protein, 8 aa, Dengue virus
VLGSQEGA

SEQ ID NO: 243746 - protein, 8 aa, Dengue virus
LGSQEGAM

SEQ ID NO: 243747 - protein, 8 aa, Dengue virus
GSQEGAMH

SEQ ID NO: 243748 - protein, 8 aa, Dengue virus
EPPFGESY

SEQ ID NO: 243749 - protein, 8 aa, Dengue virus
PPFGDSYI

SEQ ID NO: 243750 - protein, 8 aa, Dengue virus
GARRMAIL

SEQ ID NO: 243751 - protein, 8 aa, Dengue virus
ARRMAILG

SEQ ID NO: 243752 - protein, 8 aa, Dengue virus
RMAILGDT

SEQ ID NO: 243753 - protein, 8 aa, Dengue virus
MAILGDTA

SEQ ID NO: 243754 - protein, 8 aa, Dengue virus
AILGDTAW

SEQ ID NO: 243755 - protein, 8 aa, Dengue virus
ILGDTAWD

SEQ ID NO: 243756 - protein, 8 aa, Dengue virus
LGDTAWDF

SEQ ID NO: 243757 - protein, 8 aa, Dengue virus
GDTAWDFG

SEQ ID NO: 243758 - protein, 8 aa, Dengue virus
DTAWDFGS

SEQ ID NO: 243759 - protein, 8 aa, Dengue virus
TAWDFGSI

SEQ ID NO: 243760 - protein, 8 aa, Dengue virus
AWDFGSIG

SEQ ID NO: 243761 - protein, 8 aa, Dengue virus
WDFGSIGG

SEQ ID NO: 243762 - protein, 8 aa, Dengue virus
ELKCGSGI

SEQ ID NO: 243763 - protein, 8 aa, Dengue virus
LKCGSGIF

SEQ ID NO: 243764 - protein, 8 aa, Dengue virus
VHTWTEQY

SEQ ID NO: 243765 - protein, 8 aa, Dengue virus
HTWTEQYK

SEQ ID NO: 243766 - protein, 8 aa, Dengue virus
EVEDYGFG

SEQ ID NO: 243767 - protein, 8 aa, Dengue virus
AVHADMGY

SEQ ID NO: 243768 - protein, 8 aa, Dengue virus
VHADMGYW

SEQ ID NO: 243769 - protein, 8 aa, Dengue virus
HADMGYWI

SEQ ID NO: 243770 - protein, 8 aa, Dengue virus
ADMGYWIE

SEQ ID NO: 243771 - protein, 8 aa, Dengue virus
DMGYWIES

SEQ ID NO: 243772 - protein, 8 aa, Dengue virus
WPKSHTLW

SEQ ID NO: 243773 - protein, 8 aa, Dengue virus
PKSHTLWS

SEQ ID NO: 243774 - protein, 8 aa, Dengue virus
KSHTLWSN

SEQ ID NO: 243775 - protein, 8 aa, Dengue virus
SHTLWSNG

SEQ ID NO: 243776 - protein, 8 aa, Dengue virus
EWCCRSCT

SEQ ID NO: 243777 - protein, 8 aa, Dengue virus
WCCRSCTL

SEQ ID NO: 243778 - protein, 8 aa, Dengue virus
CCRSCTLP

SEQ ID NO: 243779 - protein, 8 aa, Dengue virus
CRSCTLPP

SEQ ID NO: 243780 - protein, 8 aa, Dengue virus
RSCTLPPL

SEQ ID NO: 243781 - protein, 8 aa, Dengue virus
SCTLPPLR

SEQ ID NO: 243782 - protein, 8 aa, Dengue virus
GEDGCWYG

SEQ ID NO: 243783 - protein, 8 aa, Dengue virus
EDGCWYGM

SEQ ID NO: 243784 - protein, 8 aa, Dengue virus
DGCWYGME

SEQ ID NO: 243785 - protein, 8 aa, Dengue virus
GCWYGMEI

SEQ ID NO: 243786 - protein, 8 aa, Dengue virus
CWYGMEIR

SEQ ID NO: 243787 - protein, 8 aa, Dengue virus
WYGMEIRP

SEQ ID NO: 243788 - protein, 8 aa, Dengue virus
VFHTMWHV

SEQ ID NO: 243789 - protein, 8 aa, Dengue virus
FHTMWHVT

SEQ ID NO: 243790 - protein, 8 aa, Dengue virus
HTMWHVTR

SEQ ID NO: 243791 - protein, 8 aa, Dengue virus
TMWHVTRG

SEQ ID NO: 243792 - protein, 8 aa, Dengue virus
MWHVTRGA

SEQ ID NO: 243793 - protein, 8 aa, Dengue virus
WHVTRGAV

SEQ ID NO: 243794 - protein, 8 aa, Dengue virus
HVTRGAVL

SEQ ID NO: 243795 - protein, 8 aa, Dengue virus
PGTSGSPI

SEQ ID NO: 243796 - protein, 8 aa, Dengue virus
GTSGSPIV

SEQ ID NO: 243797 - protein, 8 aa, Dengue virus
VVGLYGNG

SEQ ID NO: 243798 - protein, 8 aa, Dengue virus
VGLYGNGV

SEQ ID NO: 243799 - protein, 8 aa, Dengue virus
GLYGNGVV

SEQ ID NO: 243800 - protein, 8 aa, Dengue virus
LYGNGVVT

SEQ ID NO: 243801 - protein, 8 aa, Dengue virus
LTIMDLHP

SEQ ID NO: 243802 - protein, 8 aa, Dengue virus
TIMDLHPG

SEQ ID NO: 243803 - protein, 8 aa, Dengue virus
MDLHPGSG

SEQ ID NO: 243804 - protein, 8 aa, Dengue virus
DLHPGSGK

SEQ ID NO: 243805 - protein, 8 aa, Dengue virus
LHPGSGKT

SEQ ID NO: 243806 - protein, 8 aa, Dengue virus
HPGSGKTR

SEQ ID NO: 243807 - protein, 8 aa, Dengue virus
LRTLILAP

SEQ ID NO: 243808 - protein, 8 aa, Dengue virus
RTLILAPT

SEQ ID NO: 243809 - protein, 8 aa, Dengue virus
TLILAPTR

SEQ ID NO: 243810 - protein, 8 aa, Dengue virus
LILAPTRV

SEQ ID NO: 243811 - protein, 8 aa, Dengue virus
ILAPTRVV

SEQ ID NO: 243812 - protein, 8 aa, Dengue virus
LAPTRVVA

SEQ ID NO: 243813 - protein, 8 aa, Dengue virus
APTRVVAA

SEQ ID NO: 243814 - protein, 8 aa, Dengue virus
PTRVVAAE

SEQ ID NO: 243815 - protein, 8 aa, Dengue virus
TRVVAAEM

SEQ ID NO: 243816 - protein, 8 aa, Dengue virus
RVVAAEME

SEQ ID NO: 243817 - protein, 8 aa, Dengue virus
VVAAEMEE

SEQ ID NO: 243818 - protein, 8 aa, Dengue virus
VAAEMEEA

SEQ ID NO: 243819 - protein, 8 aa, Dengue virus
AAEMEEAL

SEQ ID NO: 243820 - protein, 8 aa, Dengue virus
GLPIRYQT

SEQ ID NO: 243821 - protein, 8 aa, Dengue virus
GREIVDLM

SEQ ID NO: 243822 - protein, 8 aa, Dengue virus
REIVDLMC

SEQ ID NO: 243823 - protein, 8 aa, Dengue virus
EIVDLMCH

SEQ ID NO: 243824 - protein, 8 aa, Dengue virus
IVDLMCHA

SEQ ID NO: 243825 - protein, 8 aa, Dengue virus
VDLMCHAT

SEQ ID NO: 243826 - protein, 8 aa, Dengue virus
DLMCHATF

SEQ ID NO: 243827 - protein, 8 aa, Dengue virus
LMCHATFT

SEQ ID NO: 243828 - protein, 8 aa, Dengue virus
MCHATFTM

SEQ ID NO: 243829 - protein, 8 aa, Dengue virus
CHATFTMR

SEQ ID NO: 243830 - protein, 8 aa, Dengue virus
HATFTMRL

SEQ ID NO: 243831 - protein, 8 aa, Dengue virus
ATFTMRLL

SEQ ID NO: 243832 - protein, 8 aa, Dengue virus
TFTMRLLS

SEQ ID NO: 243833 - protein, 8 aa, Dengue virus
FTMRLLSP

SEQ ID NO: 243834 - protein, 8 aa, Dengue virus
RVPNYNLI

SEQ ID NO: 243835 - protein, 8 aa, Dengue virus
IIMDEAHF

SEQ ID NO: 243836 - protein, 8 aa, Dengue virus
IMDEAHFT

SEQ ID NO: 243837 - protein, 8 aa, Dengue virus
MDEAHFTD

SEQ ID NO: 243838 - protein, 8 aa, Dengue virus
DEAHFTDP

SEQ ID NO: 243839 - protein, 8 aa, Dengue virus
EAHFTDPA

SEQ ID NO: 243840 - protein, 8 aa, Dengue virus
AHFTDPAS

SEQ ID NO: 243841 - protein, 8 aa, Dengue virus
HFTDPASI

SEQ ID NO: 243842 - protein, 8 aa, Dengue virus
FTDPASIA

SEQ ID NO: 243843 - protein, 8 aa, Dengue virus
TDPASIAA

SEQ ID NO: 243844 - protein, 8 aa, Dengue virus
DPASIAAR

SEQ ID NO: 243845 - protein, 8 aa, Dengue virus
PASIAARG

SEQ ID NO: 243846 - protein, 8 aa, Dengue virus
ASIAARGY

SEQ ID NO: 243847 - protein, 8 aa, Dengue virus
SIAARGYI

SEQ ID NO: 243848 - protein, 8 aa, Dengue virus
IAARGYIS

SEQ ID NO: 243849 - protein, 8 aa, Dengue virus
AARGYIST

SEQ ID NO: 243850 - protein, 8 aa, Dengue virus
ARGYISTR

SEQ ID NO: 243851 - protein, 8 aa, Dengue virus
RGYISTRV

SEQ ID NO: 243852 - protein, 8 aa, Dengue virus
GYISTRVG

SEQ ID NO: 243853 - protein, 8 aa, Dengue virus
TRVGMGEA

SEQ ID NO: 243854 - protein, 8 aa, Dengue virus
RVGMGEAA

SEQ ID NO: 243855 - protein, 8 aa, Dengue virus
MGEAAAIF

SEQ ID NO: 243856 - protein, 8 aa, Dengue virus
GEAAAIFM

SEQ ID NO: 243857 - protein, 8 aa, Dengue virus
EAAAIFMT

SEQ ID NO: 243858 - protein, 8 aa, Dengue virus
AAAIFMTA

SEQ ID NO: 243859 - protein, 8 aa, Dengue virus
AAIFMTAT

SEQ ID NO: 243860 - protein, 8 aa, Dengue virus
AIFMTATP

SEQ ID NO: 243861 - protein, 8 aa, Dengue virus
IFMTATPP

SEQ ID NO: 243862 - protein, 8 aa, Dengue virus
FMTATPPG

SEQ ID NO: 243863 - protein, 8 aa, Dengue virus
MTATPPGS

SEQ ID NO: 243864 - protein, 8 aa, Dengue virus
GKTVWFVP

SEQ ID NO: 243865 - protein, 8 aa, Dengue virus
KTVWFVPS

SEQ ID NO: 243866 - protein, 8 aa, Dengue virus
TVWFVPSI

SEQ ID NO: 243867 - protein, 8 aa, Dengue virus
VWFVPSIK

SEQ ID NO: 243868 - protein, 8 aa, Dengue virus
VIQLSRKT

SEQ ID NO: 243869 - protein, 8 aa, Dengue virus
IQLSRKTF

SEQ ID NO: 243870 - protein, 8 aa, Dengue virus
QLSRKTFD

SEQ ID NO: 243871 - protein, 8 aa, Dengue virus
DWDFVVTT

SEQ ID NO: 243872 - protein, 8 aa, Dengue virus
WDFVVTTD

SEQ ID NO: 243873 - protein, 8 aa, Dengue virus
DFVVTTDI

SEQ ID NO: 243874 - protein, 8 aa, Dengue virus
FVVTTDIS

SEQ ID NO: 243875 - protein, 8 aa, Dengue virus
VVTTDISE

SEQ ID NO: 243876 - protein, 8 aa, Dengue virus
VTTDISEM

SEQ ID NO: 243877 - protein, 8 aa, Dengue virus
TTDISEMG

SEQ ID NO: 243878 - protein, 8 aa, Dengue virus
TDISEMGA

SEQ ID NO: 243879 - protein, 8 aa, Dengue virus
DISEMGAN

SEQ ID NO: 243880 - protein, 8 aa, Dengue virus
ISEMGANF

SEQ ID NO: 243881 - protein, 8 aa, Dengue virus
SEMGANFK

SEQ ID NO: 243882 - protein, 8 aa, Dengue virus
EMGANFKA

SEQ ID NO: 243883 - protein, 8 aa, Dengue virus
RVIDPRRC

SEQ ID NO: 243884 - protein, 8 aa, Dengue virus
VIDPRRCL

SEQ ID NO: 243885 - protein, 8 aa, Dengue virus
IDPRRCLK

SEQ ID NO: 243886 - protein, 8 aa, Dengue virus
DPRRCLKP

SEQ ID NO: 243887 - protein, 8 aa, Dengue virus
PRRCLKPV

SEQ ID NO: 243888 - protein, 8 aa, Dengue virus
RRCLKPVI

SEQ ID NO: 243889 - protein, 8 aa, Dengue virus
RCLKPVIL

SEQ ID NO: 243890 - protein, 8 aa, Dengue virus
ASAAQRRG

SEQ ID NO: 243891 - protein, 8 aa, Dengue virus
SAAQRRGR

SEQ ID NO: 243892 - protein, 8 aa, Dengue virus
AAQRRGRI

SEQ ID NO: 243893 - protein, 8 aa, Dengue virus
AQRRGRIG

SEQ ID NO: 243894 - protein, 8 aa, Dengue virus
QRRGRIGR

SEQ ID NO: 243895 - protein, 8 aa, Dengue virus
RRGRIGRN

SEQ ID NO: 243896 - protein, 8 aa, Dengue virus
WTEAKMLL

SEQ ID NO: 243897 - protein, 8 aa, Dengue virus
TEAKMLLD

SEQ ID NO: 243898 - protein, 8 aa, Dengue virus
EAKMLLDN

SEQ ID NO: 243899 - protein, 8 aa, Dengue virus
AKMLLDNI

SEQ ID NO: 243900 - protein, 8 aa, Dengue virus
DGEYRLRG

SEQ ID NO: 243901 - protein, 8 aa, Dengue virus
GEYRLRGE

SEQ ID NO: 243902 - protein, 8 aa, Dengue virus
LMRRGDLP

SEQ ID NO: 243903 - protein, 8 aa, Dengue virus
MRRGDLPV

SEQ ID NO: 243904 - protein, 8 aa, Dengue virus
RRGDLPVW

SEQ ID NO: 243905 - protein, 8 aa, Dengue virus
RGDLPVWL

SEQ ID NO: 243906 - protein, 8 aa, Dengue virus
GDLPVWLA

SEQ ID NO: 243907 - protein, 8 aa, Dengue virus
DLPVWLSY

SEQ ID NO: 243908 - protein, 8 aa, Dengue virus
DRRWCFDG

SEQ ID NO: 243909 - protein, 8 aa, Dengue virus
FAAGRRSV

SEQ ID NO: 243910 - protein, 8 aa, Dengue virus
LLIPEPEK

SEQ ID NO: 243911 - protein, 8 aa, Dengue virus
LIPEPEKQ

SEQ ID NO: 243912 - protein, 8 aa, Dengue virus
IPEPEKQR

SEQ ID NO: 243913 - protein, 8 aa, Dengue virus
PEPEKQRT

SEQ ID NO: 243914 - protein, 8 aa, Dengue virus
EPEKQRTP

SEQ ID NO: 243915 - protein, 8 aa, Dengue virus
PEKQRTPQ

SEQ ID NO: 243916 - protein, 8 aa, Dengue virus
EKQRTPQD

SEQ ID NO: 243917 - protein, 8 aa, Dengue virus
KQRTPQDN

SEQ ID NO: 243918 - protein, 8 aa, Dengue virus
QRTPQDNQ

SEQ ID NO: 243919 - protein, 8 aa, Dengue virus
RTPQDNQL

SEQ ID NO: 243920 - protein, 8 aa, Dengue virus
TPQDNQLA

SEQ ID NO: 243921 - protein, 8 aa, Dengue virus
DLHPASAW

SEQ ID NO: 243922 - protein, 8 aa, Dengue virus
PASAWTLY

SEQ ID NO: 243923 - protein, 8 aa, Dengue virus
ASAWTLYA

SEQ ID NO: 243924 - protein, 8 aa, Dengue virus
SAWTLYAV

SEQ ID NO: 243925 - protein, 8 aa, Dengue virus
AWTLYAVA

SEQ ID NO: 243926 - protein, 8 aa, Dengue virus
WTLYAVAT

SEQ ID NO: 243927 - protein, 8 aa, Dengue virus
TLYAVATT

SEQ ID NO: 243928 - protein, 8 aa, Dengue virus
HYAIIGPG

SEQ ID NO: 243929 - protein, 8 aa, Dengue virus
YAIIGPGL

SEQ ID NO: 243930 - protein, 8 aa, Dengue virus
AIIGPGLQ

SEQ ID NO: 243931 - protein, 8 aa, Dengue virus
IIGPGLQA

SEQ ID NO: 243932 - protein, 8 aa, Dengue virus
IGPGLQAK

SEQ ID NO: 243933 - protein, 8 aa, Dengue virus
GPGLQAKA

SEQ ID NO: 243934 - protein, 8 aa, Dengue virus
PGLQAKAT

SEQ ID NO: 243935 - protein, 8 aa, Dengue virus
GLQAKATR

SEQ ID NO: 243936 - protein, 8 aa, Dengue virus
LQAKATRE

SEQ ID NO: 243937 - protein, 8 aa, Dengue virus
QAKATREA

SEQ ID NO: 243938 - protein, 8 aa, Dengue virus
AKATREAQ

SEQ ID NO: 243939 - protein, 8 aa, Dengue virus
KATREAQK

SEQ ID NO: 243940 - protein, 8 aa, Dengue virus
ATREAQKR

SEQ ID NO: 243941 - protein, 8 aa, Dengue virus
REAQKRTA

SEQ ID NO: 243942 - protein, 8 aa, Dengue virus
EAQKRTAA

SEQ ID NO: 243943 - protein, 8 aa, Dengue virus
AQKRTAAG

SEQ ID NO: 243944 - protein, 8 aa, Dengue virus
QKRTAAGI

SEQ ID NO: 243945 - protein, 8 aa, Dengue virus
KRTAAGIM

SEQ ID NO: 243946 - protein, 8 aa, Dengue virus
RTAAGIMK

SEQ ID NO: 243947 - protein, 8 aa, Dengue virus
TAAGIMKN

SEQ ID NO: 243948 - protein, 8 aa, Dengue virus
AAGIMKNP

SEQ ID NO: 243949 - protein, 8 aa, Dengue virus
AGIMKNPT

SEQ ID NO: 243950 - protein, 8 aa, Dengue virus
GIMKNPTV

SEQ ID NO: 243951 - protein, 8 aa, Dengue virus
IMKNPTVD

SEQ ID NO: 243952 - protein, 8 aa, Dengue virus
MKNPTVDG

SEQ ID NO: 243953 - protein, 8 aa, Dengue virus
FEKQLGQV

SEQ ID NO: 243954 - protein, 8 aa, Dengue virus
GKFWNTTI

SEQ ID NO: 243955 - protein, 8 aa, Dengue virus
KFWNTTIA

SEQ ID NO: 243956 - protein, 8 aa, Dengue virus
FWNTTIAV

SEQ ID NO: 243957 - protein, 8 aa, Dengue virus
WNTTIAVS

SEQ ID NO: 243958 - protein, 8 aa, Dengue virus
ANIFRGSY

SEQ ID NO: 243959 - protein, 8 aa, Dengue virus
NIFRGSYL

SEQ ID NO: 243960 - protein, 8 aa, Dengue virus
IFRGSYLA

SEQ ID NO: 243961 - protein, 8 aa, Dengue virus
FRGSYLAG

SEQ ID NO: 243962 - protein, 8 aa, Dengue virus
RGSYLAGA

SEQ ID NO: 243963 - protein, 8 aa, Dengue virus
GSYLAGAG

SEQ ID NO: 243964 - protein, 8 aa, Dengue virus
SYLAGAGL

SEQ ID NO: 243965 - protein, 8 aa, Dengue virus
GETLGEKW

SEQ ID NO: 243966 - protein, 8 aa, Dengue virus
ETLGEKWK

SEQ ID NO: 243967 - protein, 8 aa, Dengue virus
AVSRGSAK

SEQ ID NO: 243968 - protein, 8 aa, Dengue virus
VSRGSAKL

SEQ ID NO: 243969 - protein, 8 aa, Dengue virus
SRGTAKLR

SEQ ID NO: 243970 - protein, 8 aa, Dengue virus
RGTAKLRW

SEQ ID NO: 243971 - protein, 8 aa, Dengue virus
AKLRWFVE

SEQ ID NO: 243972 - protein, 8 aa, Dengue virus
GKVIDLGC

SEQ ID NO: 243973 - protein, 8 aa, Dengue virus
KVIDLGCG

SEQ ID NO: 243974 - protein, 8 aa, Dengue virus
VIDLGCGR

SEQ ID NO: 243975 - protein, 8 aa, Dengue virus
IDLGCGRG

SEQ ID NO: 243976 - protein, 8 aa, Dengue virus
DLGCGRGG

SEQ ID NO: 243977 - protein, 8 aa, Dengue virus
LGCGRGGW

SEQ ID NO: 243978 - protein, 8 aa, Dengue virus
GCGRGGWS

SEQ ID NO: 243979 - protein, 8 aa, Dengue virus
CGRGGWSY

SEQ ID NO: 243980 - protein, 8 aa, Dengue virus
GRGGWSYY

SEQ ID NO: 243981 - protein, 8 aa, Dengue virus
RGGWSYYC

SEQ ID NO: 243982 - protein, 8 aa, Dengue virus
EVKGYTKG

SEQ ID NO: 243983 - protein, 8 aa, Dengue virus
VKGYTKGG

SEQ ID NO: 243984 - protein, 8 aa, Dengue virus
GYTKGGPG

SEQ ID NO: 243985 - protein, 8 aa, Dengue virus
YTKGGPGH

SEQ ID NO: 243986 - protein, 8 aa, Dengue virus
TKGGPGHE

SEQ ID NO: 243987 - protein, 8 aa, Dengue virus
KGGPGHEE

SEQ ID NO: 243988 - protein, 8 aa, Dengue virus
GGPGHEEP

SEQ ID NO: 243989 - protein, 8 aa, Dengue virus
CDTLLCDI

SEQ ID NO: 243990 - protein, 8 aa, Dengue virus
DTLLCDIG

SEQ ID NO: 243991 - protein, 8 aa, Dengue virus
TLLCDIGE

SEQ ID NO: 243992 - protein, 8 aa, Dengue virus
LLCDIGES

SEQ ID NO: 243993 - protein, 8 aa, Dengue virus
LCDIGESS

SEQ ID NO: 243994 - protein, 8 aa, Dengue virus
CDIGESSP

SEQ ID NO: 243995 - protein, 8 aa, Dengue virus
DIGESSPN

SEQ ID NO: 243996 - protein, 8 aa, Dengue virus
KVLNPYMP

SEQ ID NO: 243997 - protein, 8 aa, Dengue virus
LVRNPLSR

SEQ ID NO: 243998 - protein, 8 aa, Dengue virus
VRNPLSRN

SEQ ID NO: 243999 - protein, 8 aa, Dengue virus
RNPLSRNS

SEQ ID NO: 244000 - protein, 8 aa, Dengue virus
NPLSRNST

SEQ ID NO: 244001 - protein, 8 aa, Dengue virus
PLSRNSTH

SEQ ID NO: 244002 - protein, 8 aa, Dengue virus
LSRNSTHE

SEQ ID NO: 244003 - protein, 8 aa, Dengue virus
SRNSTHEM

SEQ ID NO: 244004 - protein, 8 aa, Dengue virus
RNSTHEMY

SEQ ID NO: 244005 - protein, 8 aa, Dengue virus
NSTHEMYW

SEQ ID NO: 244006 - protein, 8 aa, Dengue virus
STHEMYWV

SEQ ID NO: 244007 - protein, 8 aa, Dengue virus
THEMYWVS

SEQ ID NO: 244008 - protein, 8 aa, Dengue virus
PYKTWAYH

SEQ ID NO: 244009 - protein, 8 aa, Dengue virus
YKTWAYHG

SEQ ID NO: 244010 - protein, 8 aa, Dengue virus
KTWAYHGS

SEQ ID NO: 244011 - protein, 8 aa, Dengue virus
TWAYHGSY

SEQ ID NO: 244012 - protein, 8 aa, Dengue virus
WAYHGSYE

SEQ ID NO: 244013 - protein, 8 aa, Dengue virus
GSASSMVN

SEQ ID NO: 244014 - protein, 8 aa, Dengue virus
SASSMVNG

SEQ ID NO: 244015 - protein, 8 aa, Dengue virus
ASSMVNGV

SEQ ID NO: 244016 - protein, 8 aa, Dengue virus
SSMVNGVV

SEQ ID NO: 244017 - protein, 8 aa, Dengue virus
VNGVVRLL

SEQ ID NO: 244018 - protein, 8 aa, Dengue virus
NGVVKLLT

SEQ ID NO: 244019 - protein, 8 aa, Dengue virus
GVVKLLTK

SEQ ID NO: 244020 - protein, 8 aa, Dengue virus
VVKLLTKP

SEQ ID NO: 244021 - protein, 8 aa, Dengue virus
VKLLTKPW

SEQ ID NO: 244022 - protein, 8 aa, Dengue virus
KLLTKPWD

SEQ ID NO: 244023 - protein, 8 aa, Dengue virus
LLTKPWDV

SEQ ID NO: 244024 - protein, 8 aa, Dengue virus
QMAMTDTT

SEQ ID NO: 244025 - protein, 8 aa, Dengue virus
MAMTDTTP

SEQ ID NO: 244026 - protein, 8 aa, Dengue virus
AMTDTTPF

SEQ ID NO: 244027 - protein, 8 aa, Dengue virus
MTDTTPFG

SEQ ID NO: 244028 - protein, 8 aa, Dengue virus
TDTTPFGQ

SEQ ID NO: 244029 - protein, 8 aa, Dengue virus
DTTPFGQQ

SEQ ID NO: 244030 - protein, 8 aa, Dengue virus
TTPFGQQR

SEQ ID NO: 244031 - protein, 8 aa, Dengue virus
TPFGQQRV

SEQ ID NO: 244032 - protein, 8 aa, Dengue virus
PFGQQRVF

SEQ ID NO: 244033 - protein, 8 aa, Dengue virus
FGQQRVFK

SEQ ID NO: 244034 - protein, 8 aa, Dengue virus
GQQRVFKE

SEQ ID NO: 244035 - protein, 8 aa, Dengue virus
QQRVFKEK

SEQ ID NO: 244036 - protein, 8 aa, Dengue virus
QRVFKEKV

SEQ ID NO: 244037 - protein, 8 aa, Dengue virus
RVFKEKVD

SEQ ID NO: 244038 - protein, 8 aa, Dengue virus
VFKEKVDT

SEQ ID NO: 244039 - protein, 8 aa, Dengue virus
FKEKVDTR

SEQ ID NO: 244040 - protein, 8 aa, Dengue virus
KEKVDTRT

SEQ ID NO: 244041 - protein, 8 aa, Dengue virus
EKVDTRTP

SEQ ID NO: 244042 - protein, 8 aa, Dengue virus
TCVYNMMG

SEQ ID NO: 244043 - protein, 8 aa, Dengue virus
CVYNMMGK

SEQ ID NO: 244044 - protein, 8 aa, Dengue virus
VYNMMGKR

SEQ ID NO: 244045 - protein, 8 aa, Dengue virus
YNMMGKRE

SEQ ID NO: 244046 - protein, 8 aa, Dengue virus
NMMGKREK

SEQ ID NO: 244047 - protein, 8 aa, Dengue virus
MMGKREKK

SEQ ID NO: 244048 - protein, 8 aa, Dengue virus
MGKREKKL

SEQ ID NO: 244049 - protein, 8 aa, Dengue virus
GKREKKLG

SEQ ID NO: 244050 - protein, 8 aa, Dengue virus
KREKKLGE

SEQ ID NO: 244051 - protein, 8 aa, Dengue virus
REKKLGEF

SEQ ID NO: 244052 - protein, 8 aa, Dengue virus
EKKLGEFG

SEQ ID NO: 244053 - protein, 8 aa, Dengue virus
KKLGEFGK

SEQ ID NO: 244054 - protein, 8 aa, Dengue virus
KLGEFGKA

SEQ ID NO: 244055 - protein, 8 aa, Dengue virus
LGEFGKAK

SEQ ID NO: 244056 - protein, 8 aa, Dengue virus
GEFGKAKG

SEQ ID NO: 244057 - protein, 8 aa, Dengue virus
EFGKAKGS

SEQ ID NO: 244058 - protein, 8 aa, Dengue virus
FGKAKGSR

SEQ ID NO: 244059 - protein, 8 aa, Dengue virus
GKAKGSRA

SEQ ID NO: 244060 - protein, 8 aa, Dengue virus
KAKGSRAI

SEQ ID NO: 244061 - protein, 8 aa, Dengue virus
AKGSRAIW

SEQ ID NO: 244062 - protein, 8 aa, Dengue virus
KGSRAIWY

SEQ ID NO: 244063 - protein, 8 aa, Dengue virus
GSRAIWYM

SEQ ID NO: 244064 - protein, 8 aa, Dengue virus
SRAIWYMW

SEQ ID NO: 244065 - protein, 8 aa, Dengue virus
RAIWYMWL

SEQ ID NO: 244066 - protein, 8 aa, Dengue virus
AIWYMWLG

SEQ ID NO: 244067 - protein, 8 aa, Dengue virus
IWYMWLGA

SEQ ID NO: 244068 - protein, 8 aa, Dengue virus
WYMWLGAR

SEQ ID NO: 244069 - protein, 8 aa, Dengue virus
YMWLGARF

SEQ ID NO: 244070 - protein, 8 aa, Dengue virus
MWLGARFL

SEQ ID NO: 244071 - protein, 8 aa, Dengue virus
WLGARFLE

SEQ ID NO: 244072 - protein, 8 aa, Dengue virus
LGARFLEF

SEQ ID NO: 244073 - protein, 8 aa, Dengue virus
GARFLEFE

SEQ ID NO: 244074 - protein, 8 aa, Dengue virus
ARFLEFEA

SEQ ID NO: 244075 - protein, 8 aa, Dengue virus
RFLEFEAL

SEQ ID NO: 244076 - protein, 8 aa, Dengue virus
FLEFEALG

SEQ ID NO: 244077 - protein, 8 aa, Dengue virus
LEFEALGF

SEQ ID NO: 244078 - protein, 8 aa, Dengue virus
EFEALGFL

SEQ ID NO: 244079 - protein, 8 aa, Dengue virus
FEALGFLN

SEQ ID NO: 244080 - protein, 8 aa, Dengue virus
EALGFLNE

SEQ ID NO: 244081 - protein, 8 aa, Dengue virus
ALGFLNED

SEQ ID NO: 244082 - protein, 8 aa, Dengue virus
LGFLNEDH

SEQ ID NO: 244083 - protein, 8 aa, Dengue virus
GFLNEDHW

SEQ ID NO: 244084 - protein, 8 aa, Dengue virus
FLNEDHWF

SEQ ID NO: 244085 - protein, 8 aa, Dengue virus
NEDHWFSR

SEQ ID NO: 244086 - protein, 8 aa, Dengue virus
SGVEGEGL

SEQ ID NO: 244087 - protein, 8 aa, Dengue virus
GVEGEGLH

SEQ ID NO: 244088 - protein, 8 aa, Dengue virus
MYADDTAG

SEQ ID NO: 244089 - protein, 8 aa, Dengue virus
YADDTAGW

SEQ ID NO: 244090 - protein, 8 aa, Dengue virus
ADDTAGWD

SEQ ID NO: 244091 - protein, 8 aa, Dengue virus
DDTAGWDT

SEQ ID NO: 244092 - protein, 8 aa, Dengue virus
DTAGWDTR

SEQ ID NO: 244093 - protein, 8 aa, Dengue virus
TAGWDTRI

SEQ ID NO: 244094 - protein, 8 aa, Dengue virus
AGWDTRIT

SEQ ID NO: 244095 - protein, 8 aa, Dengue virus
IFKLTYQN

SEQ ID NO: 244096 - protein, 8 aa, Dengue virus
FKLTYQNK

SEQ ID NO: 244097 - protein, 8 aa, Dengue virus
KLTYQNKV

SEQ ID NO: 244098 - protein, 8 aa, Dengue virus
LTYQNKVV

SEQ ID NO: 244099 - protein, 8 aa, Dengue virus
TYQNKVVR

SEQ ID NO: 244100 - protein, 8 aa, Dengue virus
YQNKVVRV

SEQ ID NO: 244101 - protein, 8 aa, Dengue virus
NKVVRVQR

SEQ ID NO: 244102 - protein, 8 aa, Dengue virus
KVVRVQRP

SEQ ID NO: 244103 - protein, 8 aa, Dengue virus
TVMDVISR

SEQ ID NO: 244104 - protein, 8 aa, Dengue virus
MDVISRRD

SEQ ID NO: 244105 - protein, 8 aa, Dengue virus
DVISRRDQ

SEQ ID NO: 244106 - protein, 8 aa, Dengue virus
VISRRDQR

SEQ ID NO: 244107 - protein, 8 aa, Dengue virus
ISRRDQRG

SEQ ID NO: 244108 - protein, 8 aa, Dengue virus
SRRDQRGS

SEQ ID NO: 244109 - protein, 8 aa, Dengue virus
RRDQRGSG

SEQ ID NO: 244110 - protein, 8 aa, Dengue virus
RDQRGSGQ

SEQ ID NO: 244111 - protein, 8 aa, Dengue virus
DQRGSGQV

SEQ ID NO: 244112 - protein, 8 aa, Dengue virus
QRGSGQVG

SEQ ID NO: 244113 - protein, 8 aa, Dengue virus
RGSGQVGT

SEQ ID NO: 244114 - protein, 8 aa, Dengue virus
GSGQVGTY

SEQ ID NO: 244115 - protein, 8 aa, Dengue virus
SGQVGTYG

SEQ ID NO: 244116 - protein, 8 aa, Dengue virus
GQVGTYGL

SEQ ID NO: 244117 - protein, 8 aa, Dengue virus
QVGTYGLN

SEQ ID NO: 244118 - protein, 8 aa, Dengue virus
VGTYGLNT

SEQ ID NO: 244119 - protein, 8 aa, Dengue virus
RMAISGDD

SEQ ID NO: 244120 - protein, 8 aa, Dengue virus
MAISGDDC

SEQ ID NO: 244121 - protein, 8 aa, Dengue virus
AISGDDCV

SEQ ID NO: 244122 - protein, 8 aa, Dengue virus
ISGDDCVV

SEQ ID NO: 244123 - protein, 8 aa, Dengue virus
SGDDCVVK

SEQ ID NO: 244124 - protein, 8 aa, Dengue virus
GDDCVVKP

SEQ ID NO: 244125 - protein, 8 aa, Dengue virus
LNDMGKVR

SEQ ID NO: 244126 - protein, 8 aa, Dengue virus
NDMGKVRK

SEQ ID NO: 244127 - protein, 8 aa, Dengue virus
DMGKVRKD

SEQ ID NO: 244128 - protein, 8 aa, Dengue virus
MGKVRKDI

SEQ ID NO: 244129 - protein, 8 aa, Dengue virus
DWQQVPFC

SEQ ID NO: 244130 - protein, 8 aa, Dengue virus
WQQVPFCS

SEQ ID NO: 244131 - protein, 8 aa, Dengue virus
QVPFCSHH

SEQ ID NO: 244132 - protein, 8 aa, Dengue virus
VPFCSHHF

SEQ ID NO: 244133 - protein, 8 aa, Dengue virus
PFCSHHFH

SEQ ID NO: 244134 - protein, 8 aa, Dengue virus
FCSHHFHE

SEQ ID NO: 244135 - protein, 8 aa, Dengue virus
CSHHFHEL

SEQ ID NO: 244136 - protein, 8 aa, Dengue virus
VPCRNQDE

SEQ ID NO: 244137 - protein, 8 aa, Dengue virus
PCRNQDEL

SEQ ID NO: 244138 - protein, 8 aa, Dengue virus
QDELIGRA

SEQ ID NO: 244139 - protein, 8 aa, Dengue virus
DELIGRAR

SEQ ID NO: 244140 - protein, 8 aa, Dengue virus
ELIGRARI

SEQ ID NO: 244141 - protein, 8 aa, Dengue virus
LIGRARIS

SEQ ID NO: 244142 - protein, 8 aa, Dengue virus
GRARISQG

SEQ ID NO: 244143 - protein, 8 aa, Dengue virus
RARISQGA

SEQ ID NO: 244144 - protein, 8 aa, Dengue virus
ARISQGAG

SEQ ID NO: 244145 - protein, 8 aa, Dengue virus
RISQGAGW

SEQ ID NO: 244146 - protein, 8 aa, Dengue virus
ISQGAGWS

SEQ ID NO: 244147 - protein, 8 aa, Dengue virus
SQGAGWSL

SEQ ID NO: 244148 - protein, 8 aa, Dengue virus
ETACLGKS

SEQ ID NO: 244149 - protein, 8 aa, Dengue virus
TACLGKSY

SEQ ID NO: 244150 - protein, 8 aa, Dengue virus
ACLGKSYA

SEQ ID NO: 244151 - protein, 8 aa, Dengue virus
CLGKSYAQ

SEQ ID NO: 244152 - protein, 8 aa, Dengue virus
LGKSYAQM

SEQ ID NO: 244153 - protein, 8 aa, Dengue virus
LMYFHRRD

SEQ ID NO: 244154 - protein, 8 aa, Dengue virus
MYFHRRDL

SEQ ID NO: 244155 - protein, 8 aa, Dengue virus
YFHRRDLR

SEQ ID NO: 244156 - protein, 8 aa, Dengue virus
FHRRDLRL

SEQ ID NO: 244157 - protein, 8 aa, Dengue virus
HRRDLRLA

SEQ ID NO: 244158 - protein, 8 aa, Dengue virus
RRDLRLAA

SEQ ID NO: 244159 - protein, 8 aa, Dengue virus
ANAICSAV

SEQ ID NO: 244160 - protein, 8 aa, Dengue virus
NAICSAVP

SEQ ID NO: 244161 - protein, 8 aa, Dengue virus
PTSRTTWS

SEQ ID NO: 244162 - protein, 8 aa, Dengue virus
TSRTTWSI

SEQ ID NO: 244163 - protein, 8 aa, Dengue virus
SRTTWSIH

SEQ ID NO: 244164 - protein, 8 aa, Dengue virus
RTTWSIHA

SEQ ID NO: 244165 - protein, 8 aa, Dengue virus
HQWMTTED

SEQ ID NO: 244166 - protein, 8 aa, Dengue virus
QWMTTEDM

SEQ ID NO: 244167 - protein, 8 aa, Dengue virus
WMTTEDML

SEQ ID NO: 244168 - protein, 8 aa, Dengue virus
VWNRVWIE

SEQ ID NO: 244169 - protein, 8 aa, Dengue virus
PYLGKRED

SEQ ID NO: 244170 - protein, 8 aa, Dengue virus
GKREDQWC

SEQ ID NO: 244171 - protein, 8 aa, Dengue virus
KREDQWCG

SEQ ID NO: 244172 - protein, 8 aa, Dengue virus
REDQWCGS

SEQ ID NO: 244173 - protein, 8 aa, Dengue virus
EDQWCGSL

SEQ ID NO: 244174 - protein, 8 aa, Dengue virus
DQWCGSLI

SEQ ID NO: 244175 - protein, 8 aa, Dengue virus
QWCGSLIG

SEQ ID NO: 244176 - protein, 8 aa, Dengue virus
WCGSLIGL

SEQ ID NO: 244177 - protein, 8 aa, Dengue virus
CGSLIGLT

SEQ ID NO: 244178 - protein, 8 aa, Dengue virus
QQLTKRFS

SEQ ID NO: 244179 - protein, 8 aa, Dengue virus
QLTKRFSL

SEQ ID NO: 244180 - protein, 8 aa, Dengue virus
LTKRFSLG

SEQ ID NO: 244181 - protein, 8 aa, Dengue virus
TKRFSLGM

SEQ ID NO: 244182 - protein, 8 aa, Dengue virus
TDVITIPT

SEQ ID NO: 244183 - protein, 8 aa, Dengue virus
EPDDVDCW

SEQ ID NO: 244184 - protein, 8 aa, Dengue virus
PDDVDCWC

SEQ ID NO: 244185 - protein, 8 aa, Dengue virus
VLEHGGCV

SEQ ID NO: 244186 - protein, 8 aa, Dengue virus
LEHGGCVT

SEQ ID NO: 244187 - protein, 8 aa, Dengue virus
TDRGWGNG

SEQ ID NO: 244188 - protein, 8 aa, Dengue virus
DRGWGNHC

SEQ ID NO: 244189 - protein, 8 aa, Dengue virus
RGWGNHCG

SEQ ID NO: 244190 - protein, 8 aa, Dengue virus
GWGNHCGL

SEQ ID NO: 244191 - protein, 8 aa, Dengue virus
WGNHCGLF

SEQ ID NO: 244192 - protein, 8 aa, Dengue virus
GNHCGLFG

SEQ ID NO: 244193 - protein, 8 aa, Dengue virus
NHCGLFGK

SEQ ID NO: 244194 - protein, 8 aa, Dengue virus
HCGLFGKG

SEQ ID NO: 244195 - protein, 8 aa, Dengue virus
CGLFGKGG

SEQ ID NO: 244196 - protein, 8 aa, Dengue virus
GLFGKGGI

SEQ ID NO: 244197 - protein, 8 aa, Dengue virus
SGEEHAVG

SEQ ID NO: 244198 - protein, 8 aa, Dengue virus
GEEHAVGN

SEQ ID NO: 244199 - protein, 8 aa, Dengue virus
CEPRSGID

SEQ ID NO: 244200 - protein, 8 aa, Dengue virus
ALGSQEGA

SEQ ID NO: 244201 - protein, 8 aa, Dengue virus
LGSQEGAL

SEQ ID NO: 244202 - protein, 8 aa, Dengue virus
GSQEGALH

SEQ ID NO: 244203 - protein, 8 aa, Dengue virus
EPPFGDSY

SEQ ID NO: 244204 - protein, 8 aa, Dengue virus
PPFGESYI

SEQ ID NO: 244205 - protein, 8 aa, Dengue virus
GAKRMAIL

SEQ ID NO: 244206 - protein, 8 aa, Dengue virus
AKRMAILG

SEQ ID NO: 244207 - protein, 8 aa, Dengue virus
RLAALGDT

SEQ ID NO: 244208 - protein, 8 aa, Dengue virus
LAALGDTA

SEQ ID NO: 244209 - protein, 8 aa, Dengue virus
AALGDTAW

SEQ ID NO: 244210 - protein, 8 aa, Dengue virus
ALGDTAWD

SEQ ID NO: 244211 - protein, 8 aa, Dengue virus
LGETAWDF

SEQ ID NO: 244212 - protein, 8 aa, Dengue virus
GETAWDFG

SEQ ID NO: 244213 - protein, 8 aa, Dengue virus
ETAWDFGS

SEQ ID NO: 244214 - protein, 8 aa, Dengue virus
TAWDFGSV

SEQ ID NO: 244215 - protein, 8 aa, Dengue virus
AWDFGSVG

SEQ ID NO: 244216 - protein, 8 aa, Dengue virus
WDFGSVGG

SEQ ID NO: 244217 - protein, 8 aa, Dengue virus
ELRCGSGV

SEQ ID NO: 244218 - protein, 8 aa, Dengue virus
LRCGSGVF

SEQ ID NO: 244219 - protein, 8 aa, Dengue virus
VEAWMDRY

SEQ ID NO: 244220 - protein, 8 aa, Dengue virus
EAWMDRYK

SEQ ID NO: 244221 - protein, 8 aa, Dengue virus
EVEDFGFG

SEQ ID NO: 244222 - protein, 8 aa, Dengue virus
AIHSDLSY

SEQ ID NO: 244223 - protein, 8 aa, Dengue virus
IHSDLSYW

SEQ ID NO: 244224 - protein, 8 aa, Dengue virus
HSDLSYWI

SEQ ID NO: 244225 - protein, 8 aa, Dengue virus
SDLSYWIE

SEQ ID NO: 244226 - protein, 8 aa, Dengue virus
DLSYWIES

SEQ ID NO: 244227 - protein, 8 aa, Dengue virus
WPETHTLW

SEQ ID NO: 244228 - protein, 8 aa, Dengue virus
PETHTLWG

SEQ ID NO: 244229 - protein, 8 aa, Dengue virus
ETHTLWGD

SEQ ID NO: 244230 - protein, 8 aa, Dengue virus
THTLWGDG

SEQ ID NO: 244231 - protein, 8 aa, Dengue virus
DWCCRSCT

SEQ ID NO: 244232 - protein, 8 aa, Dengue virus
WCCRSCTM

SEQ ID NO: 244233 - protein, 8 aa, Dengue virus
CCRSCTMP

SEQ ID NO: 244234 - protein, 8 aa, Dengue virus
CRSCTMPP

SEQ ID NO: 244235 - protein, 8 aa, Dengue virus
RSCTMPPL

SEQ ID NO: 244236 - protein, 8 aa, Dengue virus
SCTMPPLR

SEQ ID NO: 244237 - protein, 8 aa, Dengue virus
TDSGCWYG

SEQ ID NO: 244238 - protein, 8 aa, Dengue virus
DSGCWYGM

SEQ ID NO: 244239 - protein, 8 aa, Dengue virus
SGCWYGME

SEQ ID NO: 244240 - protein, 8 aa, Dengue virus
DCWYAMEI

SEQ ID NO: 244241 - protein, 8 aa, Dengue virus
CWYAMEIR

SEQ ID NO: 244242 - protein, 8 aa, Dengue virus
WYAMEIRP

SEQ ID NO: 244243 - protein, 8 aa, Dengue virus
TFHTMWHV

SEQ ID NO: 244244 - protein, 8 aa, Dengue virus
FHTLWHTT

SEQ ID NO: 244245 - protein, 8 aa, Dengue virus
HTLWHTTK

SEQ ID NO: 244246 - protein, 8 aa, Dengue virus
TLWHTTKG

SEQ ID NO: 244247 - protein, 8 aa, Dengue virus
LWHTTKGA

SEQ ID NO: 244248 - protein, 8 aa, Dengue virus
WHTTKGAA

SEQ ID NO: 244249 - protein, 8 aa, Dengue virus
HTTKGAAL

SEQ ID NO: 244250 - protein, 8 aa, Dengue virus
TGTSGSPI

SEQ ID NO: 244251 - protein, 8 aa, Dengue virus
GTSGSPII

SEQ ID NO: 244252 - protein, 8 aa, Dengue virus
IVGLYGNG

SEQ ID NO: 244253 - protein, 8 aa, Dengue virus
IGLYGNGV

SEQ ID NO: 244254 - protein, 8 aa, Dengue virus
GLYGNGVI

SEQ ID NO: 244255 - protein, 8 aa, Dengue virus
LYGNGVIM

SEQ ID NO: 244256 - protein, 8 aa, Dengue virus
ITVLDLHP

SEQ ID NO: 244257 - protein, 8 aa, Dengue virus
TVLDLHPG

SEQ ID NO: 244258 - protein, 8 aa, Dengue virus
MDLHPGAG

SEQ ID NO: 244259 - protein, 8 aa, Dengue virus
DLHPGAGK

SEQ ID NO: 244260 - protein, 8 aa, Dengue virus
LHPGAGKT

SEQ ID NO: 244261 - protein, 8 aa, Dengue virus
HPGAGKTK

SEQ ID NO: 244262 - protein, 8 aa, Dengue virus
LRTAVLAP

SEQ ID NO: 244263 - protein, 8 aa, Dengue virus
RTAVLAPT

SEQ ID NO: 244264 - protein, 8 aa, Dengue virus
TAVLAPTR

SEQ ID NO: 244265 - protein, 8 aa, Dengue virus
AVLAPTRV

SEQ ID NO: 244266 - protein, 8 aa, Dengue virus
VLAPTRVV

SEQ ID NO: 244267 - protein, 8 aa, Dengue virus
LAPTRVVL

SEQ ID NO: 244268 - protein, 8 aa, Dengue virus
APTRVVAS

SEQ ID NO: 244269 - protein, 8 aa, Dengue virus
PTRVVASE

SEQ ID NO: 244270 - protein, 8 aa, Dengue virus
TRVVASEM

SEQ ID NO: 244271 - protein, 8 aa, Dengue virus
RVVASEMA

SEQ ID NO: 244272 - protein, 8 aa, Dengue virus
VVASEMAE

SEQ ID NO: 244273 - protein, 8 aa, Dengue virus
VASEMAEA

SEQ ID NO: 244274 - protein, 8 aa, Dengue virus
ASEMAEAL

SEQ ID NO: 244275 - protein, 8 aa, Dengue virus
GMPIRYQT

SEQ ID NO: 244276 - protein, 8 aa, Dengue virus
GKEIVDLM

SEQ ID NO: 244277 - protein, 8 aa, Dengue virus
KEIVDLMC

SEQ ID NO: 244278 - protein, 8 aa, Dengue virus
EIVDVMCH

SEQ ID NO: 244279 - protein, 8 aa, Dengue virus
IVDVMCHA

SEQ ID NO: 244280 - protein, 8 aa, Dengue virus
VDVMCHAT

SEQ ID NO: 244281 - protein, 8 aa, Dengue virus
DVMCHATL

SEQ ID NO: 244282 - protein, 8 aa, Dengue virus
VMCHATLT

SEQ ID NO: 244283 - protein, 8 aa, Dengue virus
MCHATLTH

SEQ ID NO: 244284 - protein, 8 aa, Dengue virus
CHATLTHR

SEQ ID NO: 244285 - protein, 8 aa, Dengue virus
HATLTHRL

SEQ ID NO: 244286 - protein, 8 aa, Dengue virus
ATLTHRLM

SEQ ID NO: 244287 - protein, 8 aa, Dengue virus
TLTHRLMS

SEQ ID NO: 244288 - protein, 8 aa, Dengue virus
LTHRLMSP

SEQ ID NO: 244289 - protein, 8 aa, Dengue virus
RVPNYNMI

SEQ ID NO: 244290 - protein, 8 aa, Dengue virus
FVMDEAHF

SEQ ID NO: 244291 - protein, 8 aa, Dengue virus
VMDEAHFT

SEQ ID NO: 244292 - protein, 8 aa, Dengue virus
MDEAHWTD

SEQ ID NO: 244293 - protein, 8 aa, Dengue virus
DEAHWTDP

SEQ ID NO: 244294 - protein, 8 aa, Dengue virus
EAHFTDPS

SEQ ID NO: 244295 - protein, 8 aa, Dengue virus
AHFTDPSS

SEQ ID NO: 244296 - protein, 8 aa, Dengue virus
HFTDPSSI

SEQ ID NO: 244297 - protein, 8 aa, Dengue virus
FTDPSSIA

SEQ ID NO: 244298 - protein, 8 aa, Dengue virus
TDPSSIAA

SEQ ID NO: 244299 - protein, 8 aa, Dengue virus
DPSSIAAR

SEQ ID NO: 244300 - protein, 8 aa, Dengue virus
PSSIAARG

SEQ ID NO: 244301 - protein, 8 aa, Dengue virus
SSIAARGY

SEQ ID NO: 244302 - protein, 8 aa, Dengue virus
SVAARGYI

SEQ ID NO: 244303 - protein, 8 aa, Dengue virus
VAARGYIS

SEQ ID NO: 244304 - protein, 8 aa, Dengue virus
AARGYIAT

SEQ ID NO: 244305 - protein, 8 aa, Dengue virus
ARGYISTK

SEQ ID NO: 244306 - protein, 8 aa, Dengue virus
RGYISTKV

SEQ ID NO: 244307 - protein, 8 aa, Dengue virus
GYISTRVE

SEQ ID NO: 244308 - protein, 8 aa, Dengue virus
TRVEMGEA

SEQ ID NO: 244309 - protein, 8 aa, Dengue virus
RVEMGEAA

SEQ ID NO: 244310 - protein, 8 aa, Dengue virus
MGEAAGIF

SEQ ID NO: 244311 - protein, 8 aa, Dengue virus
GEAAGIFM

SEQ ID NO: 244312 - protein, 8 aa, Dengue virus
EAAGIFMT

SEQ ID NO: 244313 - protein, 8 aa, Dengue virus
AAGIFMTA

SEQ ID NO: 244314 - protein, 8 aa, Dengue virus
AGIFMTAT

SEQ ID NO: 244315 - protein, 8 aa, Dengue virus
GIFMTATP

SEQ ID NO: 244316 - protein, 8 aa, Dengue virus
VLMTATPP

SEQ ID NO: 244317 - protein, 8 aa, Dengue virus
LMTATPPG

SEQ ID NO: 244318 - protein, 8 aa, Dengue virus
MTATPPGT

SEQ ID NO: 244319 - protein, 8 aa, Dengue virus
GKTVWFVA

SEQ ID NO: 244320 - protein, 8 aa, Dengue virus
KTVWFVAS

SEQ ID NO: 244321 - protein, 8 aa, Dengue virus
TVWFVPSV

SEQ ID NO: 244322 - protein, 8 aa, Dengue virus
VWFVPSVK

SEQ ID NO: 244323 - protein, 8 aa, Dengue virus
VVQLNRKS

SEQ ID NO: 244324 - protein, 8 aa, Dengue virus
VQLNRKSY

SEQ ID NO: 244325 - protein, 8 aa, Dengue virus
QLNRKSYE

SEQ ID NO: 244326 - protein, 8 aa, Dengue virus
DWDYVVTT

SEQ ID NO: 244327 - protein, 8 aa, Dengue virus
WDYVVTTD

SEQ ID NO: 244328 - protein, 8 aa, Dengue virus
DYVVTTDI

SEQ ID NO: 244329 - protein, 8 aa, Dengue virus
YVVTTDIS

SEQ ID NO: 244330 - protein, 8 aa, Dengue virus
VITTDISE

SEQ ID NO: 244331 - protein, 8 aa, Dengue virus
ITTDISEM

SEQ ID NO: 244332 - protein, 8 aa, Dengue virus
ISEMGANL

SEQ ID NO: 244333 - protein, 8 aa, Dengue virus
SEMGANFR

SEQ ID NO: 244334 - protein, 8 aa, Dengue virus
EMGANFRA

SEQ ID NO: 244335 - protein, 8 aa, Dengue virus
RVIDSRKS

SEQ ID NO: 244336 - protein, 8 aa, Dengue virus
VIDPRRCM

SEQ ID NO: 244337 - protein, 8 aa, Dengue virus
IDPRRCMK

SEQ ID NO: 244338 - protein, 8 aa, Dengue virus
DPRRCMKP

SEQ ID NO: 244339 - protein, 8 aa, Dengue virus
PRRCMKPV

SEQ ID NO: 244340 - protein, 8 aa, Dengue virus
RRCMKPVI

SEQ ID NO: 244341 - protein, 8 aa, Dengue virus
RCMKPVIL

SEQ ID NO: 244342 - protein, 8 aa, Dengue virus
SSAAQRRG

SEQ ID NO: 244343 - protein, 8 aa, Dengue virus
AAQRRGRV

SEQ ID NO: 244344 - protein, 8 aa, Dengue virus
AQRRGRVG

SEQ ID NO: 244345 - protein, 8 aa, Dengue virus
QRRGRVGR

SEQ ID NO: 244346 - protein, 8 aa, Dengue virus
RRGRVGRN

SEQ ID NO: 244347 - protein, 8 aa, Dengue virus
WKEAKMLL

SEQ ID NO: 244348 - protein, 8 aa, Dengue virus
KEAKMLLD

SEQ ID NO: 244349 - protein, 8 aa, Dengue virus
EARIMLDN

SEQ ID NO: 244350 - protein, 8 aa, Dengue virus
ARIMLDNI

SEQ ID NO: 244351 - protein, 8 aa, Dengue virus
DGEYRLKG

SEQ ID NO: 244352 - protein, 8 aa, Dengue virus
GEYRLKGE

SEQ ID NO: 244353 - protein, 8 aa, Dengue virus
LLRTADLP

SEQ ID NO: 244354 - protein, 8 aa, Dengue virus
LRTADLPV

SEQ ID NO: 244355 - protein, 8 aa, Dengue virus
RTADLPVW

SEQ ID NO: 244356 - protein, 8 aa, Dengue virus
TADLPVWL

SEQ ID NO: 244357 - protein, 8 aa, Dengue virus
GDLPVWLS

SEQ ID NO: 244358 - protein, 8 aa, Dengue virus
DLPVWLAY

SEQ ID NO: 244359 - protein, 8 aa, Dengue virus
DRKWCFDG

SEQ ID NO: 244360 - protein, 8 aa, Dengue virus
FAAGRKSL

SEQ ID NO: 244361 - protein, 8 aa, Dengue virus
LLIPEPDR

SEQ ID NO: 244362 - protein, 8 aa, Dengue virus
LIPEPDRQ

SEQ ID NO: 244363 - protein, 8 aa, Dengue virus
IPEPDRQR

SEQ ID NO: 244364 - protein, 8 aa, Dengue virus
PEPDRQRT

SEQ ID NO: 244365 - protein, 8 aa, Dengue virus
EPDRQRTP

SEQ ID NO: 244366 - protein, 8 aa, Dengue virus
PDRQRTPQ

SEQ ID NO: 244367 - protein, 8 aa, Dengue virus
DRQRTPQD

SEQ ID NO: 244368 - protein, 8 aa, Dengue virus
RQRTPQDN

SEQ ID NO: 244369 - protein, 8 aa, Dengue virus
QRSQTDNQ

SEQ ID NO: 244370 - protein, 8 aa, Dengue virus
RSQTDNQL

SEQ ID NO: 244371 - protein, 8 aa, Dengue virus
TPQDNQLT

SEQ ID NO: 244372 - protein, 8 aa, Dengue virus
DLRPASAW

SEQ ID NO: 244373 - protein, 8 aa, Dengue virus
PATAWSLY

SEQ ID NO: 244374 - protein, 8 aa, Dengue virus
ATAWSLYA

SEQ ID NO: 244375 - protein, 8 aa, Dengue virus
TAWSLYAV

SEQ ID NO: 244376 - protein, 8 aa, Dengue virus
AWSLYAVT

SEQ ID NO: 244377 - protein, 8 aa, Dengue virus
WSLYAVTT

SEQ ID NO: 244378 - protein, 8 aa, Dengue virus
SLYAVTTA

SEQ ID NO: 244379 - protein, 8 aa, Dengue virus
HYAYMVPG

SEQ ID NO: 244380 - protein, 8 aa, Dengue virus
YAYMVPGW

SEQ ID NO: 244381 - protein, 8 aa, Dengue virus
AYMVPGWQ

SEQ ID NO: 244382 - protein, 8 aa, Dengue virus
YMVPGWQA

SEQ ID NO: 244383 - protein, 8 aa, Dengue virus
MVPGWQAE

SEQ ID NO: 244384 - protein, 8 aa, Dengue virus
VPGWQAEA

SEQ ID NO: 244385 - protein, 8 aa, Dengue virus
PGWQAEAM

SEQ ID NO: 244386 - protein, 8 aa, Dengue virus
GWQAEAMR

SEQ ID NO: 244387 - protein, 8 aa, Dengue virus
WQAEAMRS

SEQ ID NO: 244388 - protein, 8 aa, Dengue virus
QAEAMRSA

SEQ ID NO: 244389 - protein, 8 aa, Dengue virus
AEAMRSAQ

SEQ ID NO: 244390 - protein, 8 aa, Dengue virus
EAMRSAQR

SEQ ID NO: 244391 - protein, 8 aa, Dengue virus
AMRSAQRR

SEQ ID NO: 244392 - protein, 8 aa, Dengue virus
REAQKRAA

SEQ ID NO: 244393 - protein, 8 aa, Dengue virus
EAQKRAAA

SEQ ID NO: 244394 - protein, 8 aa, Dengue virus
AQKRAAAG

SEQ ID NO: 244395 - protein, 8 aa, Dengue virus
QKRAAAGI

SEQ ID NO: 244396 - protein, 8 aa, Dengue virus
KRAAAGIM

SEQ ID NO: 244397 - protein, 8 aa, Dengue virus
RAAAGIMK

SEQ ID NO: 244398 - protein, 8 aa, Dengue virus
AAAGIMKN

SEQ ID NO: 244399 - protein, 8 aa, Dengue virus
AAGIMKNA

SEQ ID NO: 244400 - protein, 8 aa, Dengue virus
AGIMKNAV

SEQ ID NO: 244401 - protein, 8 aa, Dengue virus
GIMKNAVV

SEQ ID NO: 244402 - protein, 8 aa, Dengue virus
IMKNAVVD

SEQ ID NO: 244403 - protein, 8 aa, Dengue virus
MKNAVVDG

SEQ ID NO: 244404 - protein, 8 aa, Dengue virus
FEKQLGQI

SEQ ID NO: 244405 - protein, 8 aa, Dengue virus
GRFWNTTI

SEQ ID NO: 244406 - protein, 8 aa, Dengue virus
RFWNTTIA

SEQ ID NO: 244407 - protein, 8 aa, Dengue virus
VWNATTAI

SEQ ID NO: 244408 - protein, 8 aa, Dengue virus
WNATTAIG

SEQ ID NO: 244409 - protein, 8 aa, Dengue virus
CHIMRGGW

SEQ ID NO: 244410 - protein, 8 aa, Dengue virus
HIMRGGWL

SEQ ID NO: 244411 - protein, 8 aa, Dengue virus
IMRGGWLS

SEQ ID NO: 244412 - protein, 8 aa, Dengue virus
MRGGWLSC

SEQ ID NO: 244413 - protein, 8 aa, Dengue virus
RGGWLSCL

SEQ ID NO: 244414 - protein, 8 aa, Dengue virus
GGWLSCLS

SEQ ID NO: 244415 - protein, 8 aa, Dengue virus
GWLSCLSI

SEQ ID NO: 244416 - protein, 8 aa, Dengue virus
GRTLGEVW

SEQ ID NO: 244417 - protein, 8 aa, Dengue virus
RTLGEVWK

SEQ ID NO: 244418 - protein, 8 aa, Dengue virus
AVSRGTAK

SEQ ID NO: 244419 - protein, 8 aa, Dengue virus
VSRGTAKL

SEQ ID NO: 244420 - protein, 8 aa, Dengue virus
SRGSAKLR

SEQ ID NO: 244421 - protein, 8 aa, Dengue virus
RGSAKLRW

SEQ ID NO: 244422 - protein, 8 aa, Dengue virus
AKLQWFVE

SEQ ID NO: 244423 - protein, 8 aa, Dengue virus
GKVVDLGC

SEQ ID NO: 244424 - protein, 8 aa, Dengue virus
KVVDLGCG

SEQ ID NO: 244425 - protein, 8 aa, Dengue virus
VVDLGCGR

SEQ ID NO: 244426 - protein, 8 aa, Dengue virus
VDLGCGRG

SEQ ID NO: 244427 - protein, 8 aa, Dengue virus
GCGRGGWC

SEQ ID NO: 244428 - protein, 8 aa, Dengue virus
CGRGGWCY

SEQ ID NO: 244429 - protein, 8 aa, Dengue virus
GRGGWCYY

SEQ ID NO: 244430 - protein, 8 aa, Dengue virus
RGGWCYYM

SEQ ID NO: 244431 - protein, 8 aa, Dengue virus
EVKGLTKG

SEQ ID NO: 244432 - protein, 8 aa, Dengue virus
VKGLTKGG

SEQ ID NO: 244433 - protein, 8 aa, Dengue virus
GLTKGGPG

SEQ ID NO: 244434 - protein, 8 aa, Dengue virus
LTKGGPGH

SEQ ID NO: 244435 - protein, 8 aa, Dengue virus
TKGGAGHE

SEQ ID NO: 244436 - protein, 8 aa, Dengue virus
KGGAGHEE

SEQ ID NO: 244437 - protein, 8 aa, Dengue virus
GGAGHEEP

SEQ ID NO: 244438 - protein, 8 aa, Dengue virus
VDTLLCDI

SEQ ID NO: 244439 - protein, 8 aa, Dengue virus
DTLFCDIG

SEQ ID NO: 244440 - protein, 8 aa, Dengue virus
TLFCDIGE

SEQ ID NO: 244441 - protein, 8 aa, Dengue virus
LFCDIGES

SEQ ID NO: 244442 - protein, 8 aa, Dengue virus
FCDIGESS

SEQ ID NO: 244443 - protein, 8 aa, Dengue virus
CDIGESSS

SEQ ID NO: 244444 - protein, 8 aa, Dengue virus
DIGESSPS

SEQ ID NO: 244445 - protein, 8 aa, Dengue virus
KILNPYMP

SEQ ID NO: 244446 - protein, 8 aa, Dengue virus
LVRCPLSR

SEQ ID NO: 244447 - protein, 8 aa, Dengue virus
VRCPLSRN

SEQ ID NO: 244448 - protein, 8 aa, Dengue virus
RCPLSRNS

SEQ ID NO: 244449 - protein, 8 aa, Dengue virus
CPLSRNST

SEQ ID NO: 244450 - protein, 8 aa, Dengue virus
PLSRNSNH

SEQ ID NO: 244451 - protein, 8 aa, Dengue virus
LSRNSNHE

SEQ ID NO: 244452 - protein, 8 aa, Dengue virus
SRNSNHEM

SEQ ID NO: 244453 - protein, 8 aa, Dengue virus
RNSNHEMY

SEQ ID NO: 244454 - protein, 8 aa, Dengue virus
NSNHEMYW

SEQ ID NO: 244455 - protein, 8 aa, Dengue virus
STHEMYWI

SEQ ID NO: 244456 - protein, 8 aa, Dengue virus
THEMYWIS

SEQ ID NO: 244457 - protein, 8 aa, Dengue virus
PYRTWNYH

SEQ ID NO: 244458 - protein, 8 aa, Dengue virus
YRTWNYHG

SEQ ID NO: 244459 - protein, 8 aa, Dengue virus
RTWNYHGS

SEQ ID NO: 244460 - protein, 8 aa, Dengue virus
TWNYHGSY

SEQ ID NO: 244461 - protein, 8 aa, Dengue virus
WNYHGSYD

SEQ ID NO: 244462 - protein, 8 aa, Dengue virus
GSASSMIN

SEQ ID NO: 244463 - protein, 8 aa, Dengue virus
SASSMING

SEQ ID NO: 244464 - protein, 8 aa, Dengue virus
ASSMINGV

SEQ ID NO: 244465 - protein, 8 aa, Dengue virus
SSMINGVV

SEQ ID NO: 244466 - protein, 8 aa, Dengue virus
VNGVVKLL

SEQ ID NO: 244467 - protein, 8 aa, Dengue virus
NGVVRLLT

SEQ ID NO: 244468 - protein, 8 aa, Dengue virus
GVVRLLTK

SEQ ID NO: 244469 - protein, 8 aa, Dengue virus
VVRLLTKP

SEQ ID NO: 244470 - protein, 8 aa, Dengue virus
VRLLTKPW

SEQ ID NO: 244471 - protein, 8 aa, Dengue virus
RLLTKPWD

SEQ ID NO: 244472 - protein, 8 aa, Dengue virus
LLSKPWDT

SEQ ID NO: 244473 - protein, 8 aa, Dengue virus
QIAMTDTT

SEQ ID NO: 244474 - protein, 8 aa, Dengue virus
IAMTDTTP

SEQ ID NO: 244475 - protein, 8 aa, Dengue virus
AMTDTTAF

SEQ ID NO: 244476 - protein, 8 aa, Dengue virus
MTDTTAFG

SEQ ID NO: 244477 - protein, 8 aa, Dengue virus
TDTTAFGQ

SEQ ID NO: 244478 - protein, 8 aa, Dengue virus
DTTAFGQQ

SEQ ID NO: 244479 - protein, 8 aa, Dengue virus
TTAFGQQR

SEQ ID NO: 244480 - protein, 8 aa, Dengue virus
TAFGQQRV

SEQ ID NO: 244481 - protein, 8 aa, Dengue virus
AFGQQRVF

SEQ ID NO: 244482 - protein, 8 aa, Dengue virus
FKEKVDTK

SEQ ID NO: 244483 - protein, 8 aa, Dengue virus
KEKVDTKA

SEQ ID NO: 244484 - protein, 8 aa, Dengue virus
EKVDTRTQ

SEQ ID NO: 244485 - protein, 8 aa, Dengue virus
SCVYNMMG

SEQ ID NO: 244486 - protein, 8 aa, Dengue virus
CIYNMMGK

SEQ ID NO: 244487 - protein, 8 aa, Dengue virus
IYNMMGKR

SEQ ID NO: 244488 - protein, 8 aa, Dengue virus
MGKREKKP

SEQ ID NO: 244489 - protein, 8 aa, Dengue virus
GKREKKPG

SEQ ID NO: 244490 - protein, 8 aa, Dengue virus
KREKKPGE

SEQ ID NO: 244491 - protein, 8 aa, Dengue virus
REKKPGEF

SEQ ID NO: 244492 - protein, 8 aa, Dengue virus
EKKPGEFG

SEQ ID NO: 244493 - protein, 8 aa, Dengue virus
KKPGEFGK

SEQ ID NO: 244494 - protein, 8 aa, Dengue virus
KPGEFGKA

SEQ ID NO: 244495 - protein, 8 aa, Dengue virus
PGEFGKAK

SEQ ID NO: 244496 - protein, 8 aa, Dengue virus
GEFGRAKG

SEQ ID NO: 244497 - protein, 8 aa, Dengue virus
EFGRAKGS

SEQ ID NO: 244498 - protein, 8 aa, Dengue virus
FGRAKGSR

SEQ ID NO: 244499 - protein, 8 aa, Dengue virus
GRAKGSRA

SEQ ID NO: 244500 - protein, 8 aa, Dengue virus
RAKGSRAI

SEQ ID NO: 244501 - protein, 8 aa, Dengue virus
KGSRAIWF

SEQ ID NO: 244502 - protein, 8 aa, Dengue virus
GSRAIWFM

SEQ ID NO: 244503 - protein, 8 aa, Dengue virus
SRAIWFMW

SEQ ID NO: 244504 - protein, 8 aa, Dengue virus
RAIWFMWL

SEQ ID NO: 244505 - protein, 8 aa, Dengue virus
AIWFMWLG

SEQ ID NO: 244506 - protein, 8 aa, Dengue virus
IWFMWLGA

SEQ ID NO: 244507 - protein, 8 aa, Dengue virus
WFMWLGAR

SEQ ID NO: 244508 - protein, 8 aa, Dengue virus
YMWLGARY

SEQ ID NO: 244509 - protein, 8 aa, Dengue virus
MWLGARYL

SEQ ID NO: 244510 - protein, 8 aa, Dengue virus
WLGARYLE

SEQ ID NO: 244511 - protein, 8 aa, Dengue virus
LGARYLEF

SEQ ID NO: 244512 - protein, 8 aa, Dengue virus
GARYLEFE

SEQ ID NO: 244513 - protein, 8 aa, Dengue virus
ARYLEFEA

SEQ ID NO: 244514 - protein, 8 aa, Dengue virus
RYLEFEAL

SEQ ID NO: 244515 - protein, 8 aa, Dengue virus
YLEFEALG

SEQ ID NO: 244516 - protein, 8 aa, Dengue virus
EFEALGFM

SEQ ID NO: 244517 - protein, 8 aa, Dengue virus
FEALGFMN

SEQ ID NO: 244518 - protein, 8 aa, Dengue virus
EALGFMNE

SEQ ID NO: 244519 - protein, 8 aa, Dengue virus
ALGFMNED

SEQ ID NO: 244520 - protein, 8 aa, Dengue virus
LGFMNEDH

SEQ ID NO: 244521 - protein, 8 aa, Dengue virus
GFMNEDHW

SEQ ID NO: 244522 - protein, 8 aa, Dengue virus
FMNEDHWF

SEQ ID NO: 244523 - protein, 8 aa, Dengue virus
NEDHWLGR

SEQ ID NO: 244524 - protein, 8 aa, Dengue virus
GGVEGLGL

SEQ ID NO: 244525 - protein, 8 aa, Dengue virus
GVEGLGLQ

SEQ ID NO: 244526 - protein, 8 aa, Dengue virus
IYADDTAG

SEQ ID NO: 244527 - protein, 8 aa, Dengue virus
DTAGWDTK

SEQ ID NO: 244528 - protein, 8 aa, Dengue virus
TAGWDTKV

SEQ ID NO: 244529 - protein, 8 aa, Dengue virus
AGWDTKVT

SEQ ID NO: 244530 - protein, 8 aa, Dengue virus
IIELTYRH

SEQ ID NO: 244531 - protein, 8 aa, Dengue virus
IELTYRHK

SEQ ID NO: 244532 - protein, 8 aa, Dengue virus
ELTYRHKV

SEQ ID NO: 244533 - protein, 8 aa, Dengue virus
LTYRHKVV

SEQ ID NO: 244534 - protein, 8 aa, Dengue virus
TYQNKVVK

SEQ ID NO: 244535 - protein, 8 aa, Dengue virus
YQNKVVKV

SEQ ID NO: 244536 - protein, 8 aa, Dengue virus
NKVVKVQR

SEQ ID NO: 244537 - protein, 8 aa, Dengue virus
KVVKVQRP

SEQ ID NO: 244538 - protein, 8 aa, Dengue virus
TVMDIISR

SEQ ID NO: 244539 - protein, 8 aa, Dengue virus
MDIISRKD

SEQ ID NO: 244540 - protein, 8 aa, Dengue virus
DIISRKDQ

SEQ ID NO: 244541 - protein, 8 aa, Dengue virus
IISRKDQR

SEQ ID NO: 244542 - protein, 8 aa, Dengue virus
ISRKDQRG

SEQ ID NO: 244543 - protein, 8 aa, Dengue virus
SRKDQRGS

SEQ ID NO: 244544 - protein, 8 aa, Dengue virus
RKDQRGSG

SEQ ID NO: 244545 - protein, 8 aa, Dengue virus
KDQRGSGQ

SEQ ID NO: 244546 - protein, 8 aa, Dengue virus
QRGSGQVV

SEQ ID NO: 244547 - protein, 8 aa, Dengue virus
RGSGQVVT

SEQ ID NO: 244548 - protein, 8 aa, Dengue virus
GSGQVVTY

SEQ ID NO: 244549 - protein, 8 aa, Dengue virus
SGQVVTYA

SEQ ID NO: 244550 - protein, 8 aa, Dengue virus
GQVVTYAL

SEQ ID NO: 244551 - protein, 8 aa, Dengue virus
QVVTYALN

SEQ ID NO: 244552 - protein, 8 aa, Dengue virus
VVTYALNT

SEQ ID NO: 244553 - protein, 8 aa, Dengue virus
RMAVSGDD

SEQ ID NO: 244554 - protein, 8 aa, Dengue virus
MAVSGDDC

SEQ ID NO: 244555 - protein, 8 aa, Dengue virus
AVSGDDCV

SEQ ID NO: 244556 - protein, 8 aa, Dengue virus
VSGDDCVV

SEQ ID NO: 244557 - protein, 8 aa, Dengue virus
SGDDCVVR

SEQ ID NO: 244558 - protein, 8 aa, Dengue virus
GDDCVVRP

SEQ ID NO: 244559 - protein, 8 aa, Dengue virus
LNDMGKIR

SEQ ID NO: 244560 - protein, 8 aa, Dengue virus
NDMGKIRK

SEQ ID NO: 244561 - protein, 8 aa, Dengue virus
DMGKIRKD

SEQ ID NO: 244562 - protein, 8 aa, Dengue virus
MGKIRKDI

SEQ ID NO: 244563 - protein, 8 aa, Dengue virus
DWTQVPFC

SEQ ID NO: 244564 - protein, 8 aa, Dengue virus
WTQVPFCS

SEQ ID NO: 244565 - protein, 8 aa, Dengue virus
QVPFCSNH

SEQ ID NO: 244566 - protein, 8 aa, Dengue virus
VPFCSNHF

SEQ ID NO: 244567 - protein, 8 aa, Dengue virus
PFCSNHFT

SEQ ID NO: 244568 - protein, 8 aa, Dengue virus
FCSHHFHQ

SEQ ID NO: 244569 - protein, 8 aa, Dengue virus
CSHHFHQL

SEQ ID NO: 244570 - protein, 8 aa, Dengue virus
VPCRPQDE

SEQ ID NO: 244571 - protein, 8 aa, Dengue virus
PCRPQDEL

SEQ ID NO: 244572 - protein, 8 aa, Dengue virus
QDELVGRA

SEQ ID NO: 244573 - protein, 8 aa, Dengue virus
DELVGRAR

SEQ ID NO: 244574 - protein, 8 aa, Dengue virus
ELVGRARV

SEQ ID NO: 244575 - protein, 8 aa, Dengue virus
LVGRARVS

SEQ ID NO: 244576 - protein, 8 aa, Dengue virus
GRARVSQG

SEQ ID NO: 244577 - protein, 8 aa, Dengue virus
RARVSQGA

SEQ ID NO: 244578 - protein, 8 aa, Dengue virus
ARVSQGAG

SEQ ID NO: 244579 - protein, 8 aa, Dengue virus
RVSQGAGW

SEQ ID NO: 244580 - protein, 8 aa, Dengue virus
VSQGAGWS

SEQ ID NO: 244581 - protein, 8 aa, Dengue virus
SPGAGWNV

SEQ ID NO: 244582 - protein, 8 aa, Dengue virus
ETACLGKA

SEQ ID NO: 244583 - protein, 8 aa, Dengue virus
TACLGKAY

SEQ ID NO: 244584 - protein, 8 aa, Dengue virus
ACLGKAYA

SEQ ID NO: 244585 - protein, 8 aa, Dengue virus
CLGKAYAQ

SEQ ID NO: 244586 - protein, 8 aa, Dengue virus
LGKAYAQM

SEQ ID NO: 244587 - protein, 8 aa, Dengue virus
LLYFHRRD

SEQ ID NO: 244588 - protein, 8 aa, Dengue virus
LYFHRRDL

SEQ ID NO: 244589 - protein, 8 aa, Dengue virus
YFHKRDMR

SEQ ID NO: 244590 - protein, 8 aa, Dengue virus
FHRRDLRT

SEQ ID NO: 244591 - protein, 8 aa, Dengue virus
HRRDLRLM

SEQ ID NO: 244592 - protein, 8 aa, Dengue virus
RRDLRLAS

SEQ ID NO: 244593 - protein, 8 aa, Dengue virus
SNAICSAV

SEQ ID NO: 244594 - protein, 8 aa, Dengue virus
MAICSAVP

SEQ ID NO: 244595 - protein, 8 aa, Dengue virus
PTGRTTWS

SEQ ID NO: 244596 - protein, 8 aa, Dengue virus
TGRTTWSI

SEQ ID NO: 244597 - protein, 8 aa, Dengue virus
GRTTWSIH

SEQ ID NO: 244598 - protein, 8 aa, Dengue virus
RTSWSIHS

SEQ ID NO: 244599 - protein, 8 aa, Dengue virus
HEWMTTED

SEQ ID NO: 244600 - protein, 8 aa, Dengue virus
EWMTTEDM

SEQ ID NO: 244601 - protein, 8 aa, Dengue virus
VWNRVWIQ

SEQ ID NO: 244602 - protein, 8 aa, Dengue virus
PYSGKRED

SEQ ID NO: 244603 - protein, 8 aa, Dengue virus
GKREDIWC

SEQ ID NO: 244604 - protein, 8 aa, Dengue virus
KREDIWCG

SEQ ID NO: 244605 - protein, 8 aa, Dengue virus
REDIWCGS

SEQ ID NO: 244606 - protein, 8 aa, Dengue virus
EDIWCGSL

SEQ ID NO: 244607 - protein, 8 aa, Dengue virus
DIWCGSLI

SEQ ID NO: 244608 - protein, 8 aa, Dengue virus
IWCGSLIG

SEQ ID NO: 244609 - protein, 8 aa, Dengue virus
WCGSLIGT

SEQ ID NO: 244610 - protein, 8 aa, Dengue virus
CGSLIGTR

SEQ ID NO: 244611 - protein, 8 aa, Dengue virus
QGLVKRFS

SEQ ID NO: 244612 - protein, 8 aa, Dengue virus
QLAKRFSR

SEQ ID NO: 244613 - protein, 8 aa, Dengue virus
LAKRFSRG

SEQ ID NO: 244614 - protein, 8 aa, Dengue virus
AKRFSRGL

SEQ ID NO: 244615 - protein, 8 aa, Dengue virus
GRPLLFKT

SEQ ID NO: 244616 - protein, 8 aa, Dengue virus
DPEDIDCW

SEQ ID NO: 244617 - protein, 8 aa, Dengue virus
PEDVDCWC

SEQ ID NO: 244618 - protein, 8 aa, Dengue virus
VLEGDSCV

SEQ ID NO: 244619 - protein, 8 aa, Dengue virus
LEGDSCVT

SEQ ID NO: 244620 - protein, 8 aa, Dengue virus
SDRGWGNH

SEQ ID NO: 244621 - protein, 8 aa, Dengue virus
GLFGKGSI

SEQ ID NO: 244622 - protein, 8 aa, Dengue virus
NGDTHAVG

SEQ ID NO: 244623 - protein, 8 aa, Dengue virus
GDTHAVGN

SEQ ID NO: 244624 - protein, 8 aa, Dengue virus
CEPRSGLN

SEQ ID NO: 244625 - protein, 8 aa, Dengue virus
ALGSQEGG

SEQ ID NO: 244626 - protein, 8 aa, Dengue virus
LGSQEGGL

SEQ ID NO: 244627 - protein, 8 aa, Dengue virus
GSQEGGLH

SEQ ID NO: 244628 - protein, 8 aa, Dengue virus
EPPFGESN

SEQ ID NO: 244629 - protein, 8 aa, Dengue virus
PPFGESNI

SEQ ID NO: 244630 - protein, 8 aa, Dengue virus
GAQRLAAL

SEQ ID NO: 244631 - protein, 8 aa, Dengue virus
AQRLAALG

SEQ ID NO: 244632 - protein, 8 aa, Dengue virus
RMAILGET

SEQ ID NO: 244633 - protein, 8 aa, Dengue virus
MAILGETA

SEQ ID NO: 244634 - protein, 8 aa, Dengue virus
AILGETAW

SEQ ID NO: 244635 - protein, 8 aa, Dengue virus
ILGETAWD

SEQ ID NO: 244636 - protein, 8 aa, Dengue virus
IGEHAWDF

SEQ ID NO: 244637 - protein, 8 aa, Dengue virus
GEHAWDFG

SEQ ID NO: 244638 - protein, 8 aa, Dengue virus
EHAWDFGS

SEQ ID NO: 244639 - protein, 8 aa, Dengue virus
TAWDFGSL

SEQ ID NO: 244640 - protein, 8 aa, Dengue virus
AWDFGSLG

SEQ ID NO: 244641 - protein, 8 aa, Dengue virus
WDFGSLGG

SEQ ID NO: 244642 - protein, 8 aa, Dengue virus
EMRCGSGI

SEQ ID NO: 244643 - protein, 8 aa, Dengue virus
MRCGSGIF

SEQ ID NO: 244644 - protein, 8 aa, Dengue virus
VEAWVDRY

SEQ ID NO: 244645 - protein, 8 aa, Dengue virus
EAWVDRYK

SEQ ID NO: 244646 - protein, 8 aa, Dengue virus
QIEDFGFG

SEQ ID NO: 244647 - protein, 8 aa, Dengue virus
AVHSDLSY

SEQ ID NO: 244648 - protein, 8 aa, Dengue virus
VHSDLSYW

SEQ ID NO: 244649 - protein, 8 aa, Dengue virus
HTDQSLWM

SEQ ID NO: 244650 - protein, 8 aa, Dengue virus
TDQSLWMK

SEQ ID NO: 244651 - protein, 8 aa, Dengue virus
DQSLWMKS

SEQ ID NO: 244652 - protein, 8 aa, Dengue virus
WPKTHTLW

SEQ ID NO: 244653 - protein, 8 aa, Dengue virus
PKTHTLWS

SEQ ID NO: 244654 - protein, 8 aa, Dengue virus
KTHTLWSN

SEQ ID NO: 244655 - protein, 8 aa, Dengue virus
THTLWSNG

SEQ ID NO: 244656 - protein, 8 aa, Dengue virus
QWCCRSCT

SEQ ID NO: 244657 - protein, 8 aa, Dengue virus
WCCRSCSL

SEQ ID NO: 244658 - protein, 8 aa, Dengue virus
CCRSCSLP

SEQ ID NO: 244659 - protein, 8 aa, Dengue virus
CRSCSLPP

SEQ ID NO: 244660 - protein, 8 aa, Dengue virus
RSCSLPPL

SEQ ID NO: 244661 - protein, 8 aa, Dengue virus
SCSLPPLR

SEQ ID NO: 244662 - protein, 8 aa, Dengue virus
TENGCWYG

SEQ ID NO: 244663 - protein, 8 aa, Dengue virus
ENGCWYGM

SEQ ID NO: 244664 - protein, 8 aa, Dengue virus
NGCWYGME

SEQ ID NO: 244665 - protein, 8 aa, Dengue virus
VFHTLWHT

SEQ ID NO: 244666 - protein, 8 aa, Dengue virus
LHTMWHVT

SEQ ID NO: 244667 - protein, 8 aa, Dengue virus
HTLWHTTR

SEQ ID NO: 244668 - protein, 8 aa, Dengue virus
TLWHTTRG

SEQ ID NO: 244669 - protein, 8 aa, Dengue virus
MWHVTRGS

SEQ ID NO: 244670 - protein, 8 aa, Dengue virus
WHVTRGSV

SEQ ID NO: 244671 - protein, 8 aa, Dengue virus
HVTRGSVI

SEQ ID NO: 244672 - protein, 8 aa, Dengue virus
RGTSGSPI

SEQ ID NO: 244673 - protein, 8 aa, Dengue virus
GTSGSPIL

SEQ ID NO: 244674 - protein, 8 aa, Dengue virus
VIGLYGNG

SEQ ID NO: 244675 - protein, 8 aa, Dengue virus
VGLYGNGL

SEQ ID NO: 244676 - protein, 8 aa, Dengue virus
GLYGNGVE

SEQ ID NO: 244677 - protein, 8 aa, Dengue virus
LYGNGVEL

SEQ ID NO: 244678 - protein, 8 aa, Dengue virus
MTVLDLHP

SEQ ID NO: 244679 - protein, 8 aa, Dengue virus
TVLDMHPG

SEQ ID NO: 244680 - protein, 8 aa, Dengue virus
LDLHPGAG

SEQ ID NO: 244681 - protein, 8 aa, Dengue virus
DMHPGSGK

SEQ ID NO: 244682 - protein, 8 aa, Dengue virus
MHPGSGKT

SEQ ID NO: 244683 - protein, 8 aa, Dengue virus
HPGAGKTR

SEQ ID NO: 244684 - protein, 8 aa, Dengue virus
LRTLVLAP

SEQ ID NO: 244685 - protein, 8 aa, Dengue virus
RTLVLAPT

SEQ ID NO: 244686 - protein, 8 aa, Dengue virus
TLVLAPTR

SEQ ID NO: 244687 - protein, 8 aa, Dengue virus
LVLAPTRV

SEQ ID NO: 244688 - protein, 8 aa, Dengue virus
APTRVVLK

SEQ ID NO: 244689 - protein, 8 aa, Dengue virus
PTRVVLKE

SEQ ID NO: 244690 - protein, 8 aa, Dengue virus
TRVVLKEM

SEQ ID NO: 244691 - protein, 8 aa, Dengue virus
RVVAAEMA

SEQ ID NO: 244692 - protein, 8 aa, Dengue virus
VVAAEMAE

SEQ ID NO: 244693 - protein, 8 aa, Dengue virus
VAAEMAEA

SEQ ID NO: 244694 - protein, 8 aa, Dengue virus
AAEMAEAL

SEQ ID NO: 244695 - protein, 8 aa, Dengue virus
GLPVRYQT

SEQ ID NO: 244696 - protein, 8 aa, Dengue virus
GNEIVDVM

SEQ ID NO: 244697 - protein, 8 aa, Dengue virus
NEIVDVMC

SEQ ID NO: 244698 - protein, 8 aa, Dengue virus
AIVDVMCH

SEQ ID NO: 244699 - protein, 8 aa, Dengue virus
IDAMCHAT

SEQ ID NO: 244700 - protein, 8 aa, Dengue virus
DVMCHATY

SEQ ID NO: 244701 - protein, 8 aa, Dengue virus
VMCHATYV

SEQ ID NO: 244702 - protein, 8 aa, Dengue virus
MCHATFTT

SEQ ID NO: 244703 - protein, 8 aa, Dengue virus
CHATFTTR

SEQ ID NO: 244704 - protein, 8 aa, Dengue virus
HATFTTRL

SEQ ID NO: 244705 - protein, 8 aa, Dengue virus
ATFTTRLL

SEQ ID NO: 244706 - protein, 8 aa, Dengue virus
TFTTRLLS

SEQ ID NO: 244707 - protein, 8 aa, Dengue virus
FTTRLLSS

SEQ ID NO: 244708 - protein, 8 aa, Dengue virus
RVPNYNLF

SEQ ID NO: 244709 - protein, 8 aa, Dengue virus
IVMDEAHF

SEQ ID NO: 244710 - protein, 8 aa, Dengue virus
IMDEAHWT

SEQ ID NO: 244711 - protein, 8 aa, Dengue virus
EAHWTDPH

SEQ ID NO: 244712 - protein, 8 aa, Dengue virus
AHWTDPHS

SEQ ID NO: 244713 - protein, 8 aa, Dengue virus
HFTDPSSV

SEQ ID NO: 244714 - protein, 8 aa, Dengue virus
FTDPSSVA

SEQ ID NO: 244715 - protein, 8 aa, Dengue virus
TDPSSVAA

SEQ ID NO: 244716 - protein, 8 aa, Dengue virus
DPSSVAAR

SEQ ID NO: 244717 - protein, 8 aa, Dengue virus
PSSVAARG

SEQ ID NO: 244718 - protein, 8 aa, Dengue virus
SSVAARGY

SEQ ID NO: 244719 - protein, 8 aa, Dengue virus
SIAARGHL

SEQ ID NO: 244720 - protein, 8 aa, Dengue virus
IAARGYIA

SEQ ID NO: 244721 - protein, 8 aa, Dengue virus
AARGHLYT

SEQ ID NO: 244722 - protein, 8 aa, Dengue virus
ARGYIATK

SEQ ID NO: 244723 - protein, 8 aa, Dengue virus
RGYIATKV

SEQ ID NO: 244724 - protein, 8 aa, Dengue virus
GYISTKVE

SEQ ID NO: 244725 - protein, 8 aa, Dengue virus
TKVELGEA

SEQ ID NO: 244726 - protein, 8 aa, Dengue virus
KVELGEAA

SEQ ID NO: 244727 - protein, 8 aa, Dengue virus
LGEAAAIF

SEQ ID NO: 244728 - protein, 8 aa, Dengue virus
NKCALVLM

SEQ ID NO: 244729 - protein, 8 aa, Dengue virus
KCALVLMT

SEQ ID NO: 244730 - protein, 8 aa, Dengue virus
CALVLMTA

SEQ ID NO: 244731 - protein, 8 aa, Dengue virus
ALVLMTAT

SEQ ID NO: 244732 - protein, 8 aa, Dengue virus
LVLMTATP

SEQ ID NO: 244733 - protein, 8 aa, Dengue virus
MTATPPGA

SEQ ID NO: 244734 - protein, 8 aa, Dengue virus
GRTAWFVP

SEQ ID NO: 244735 - protein, 8 aa, Dengue virus
RTAWFVPS

SEQ ID NO: 244736 - protein, 8 aa, Dengue virus
TVWFVASV

SEQ ID NO: 244737 - protein, 8 aa, Dengue virus
VWFVASVK

SEQ ID NO: 244738 - protein, 8 aa, Dengue virus
VIQLNRKS

SEQ ID NO: 244739 - protein, 8 aa, Dengue virus
IQLNRKSY

SEQ ID NO: 244740 - protein, 8 aa, Dengue virus
QLNRKSYD

SEQ ID NO: 244741 - protein, 8 aa, Dengue virus
DWDFVITT

SEQ ID NO: 244742 - protein, 8 aa, Dengue virus
WDFVITTD

SEQ ID NO: 244743 - protein, 8 aa, Dengue virus
DFVITTDI

SEQ ID NO: 244744 - protein, 8 aa, Dengue virus
FVITTDIS

SEQ ID NO: 244745 - protein, 8 aa, Dengue virus
SEMGANFG

SEQ ID NO: 244746 - protein, 8 aa, Dengue virus
EMGANFGA

SEQ ID NO: 244747 - protein, 8 aa, Dengue virus
RVIDCRKS

SEQ ID NO: 244748 - protein, 8 aa, Dengue virus
VIDSRKSV

SEQ ID NO: 244749 - protein, 8 aa, Dengue virus
IDSRKSVK

SEQ ID NO: 244750 - protein, 8 aa, Dengue virus
DSRKSVKP

SEQ ID NO: 244751 - protein, 8 aa, Dengue virus
SRKSVKPT

SEQ ID NO: 244752 - protein, 8 aa, Dengue virus
RKSVKPTI

SEQ ID NO: 244753 - protein, 8 aa, Dengue virus
KSVKPTII

SEQ ID NO: 244754 - protein, 8 aa, Dengue virus
RRGRVGRQ

SEQ ID NO: 244755 - protein, 8 aa, Dengue virus
WTEARIML

SEQ ID NO: 244756 - protein, 8 aa, Dengue virus
TEARIMLD

SEQ ID NO: 244757 - protein, 8 aa, Dengue virus
EAKIMLDN

SEQ ID NO: 244758 - protein, 8 aa, Dengue virus
AKIMLDNI

SEQ ID NO: 244759 - protein, 8 aa, Dengue virus
DGEFRLRG

SEQ ID NO: 244760 - protein, 8 aa, Dengue virus
GEFRLRGE

SEQ ID NO: 244761 - protein, 8 aa, Dengue virus
LLTHCDFT

SEQ ID NO: 244762 - protein, 8 aa, Dengue virus
LTHCDFTP

SEQ ID NO: 244763 - protein, 8 aa, Dengue virus
THCDFTPW

SEQ ID NO: 244764 - protein, 8 aa, Dengue virus
HCDFTPWL

SEQ ID NO: 244765 - protein, 8 aa, Dengue virus
ADLPVWLA

SEQ ID NO: 244766 - protein, 8 aa, Dengue virus
DLPVWLAH

SEQ ID NO: 244767 - protein, 8 aa, Dengue virus
DREWCFTG

SEQ ID NO: 244768 - protein, 8 aa, Dengue virus
FAAGRKSI

SEQ ID NO: 244769 - protein, 8 aa, Dengue virus
VLIPEPEK

SEQ ID NO: 244770 - protein, 8 aa, Dengue virus
LQPEAGKQ

SEQ ID NO: 244771 - protein, 8 aa, Dengue virus
QPEAGKQR

SEQ ID NO: 244772 - protein, 8 aa, Dengue virus
PEPEKQRS

SEQ ID NO: 244773 - protein, 8 aa, Dengue virus
EPEKQRSQ

SEQ ID NO: 244774 - protein, 8 aa, Dengue virus
PEKQRSQT

SEQ ID NO: 244775 - protein, 8 aa, Dengue virus
EKQRSQTD

SEQ ID NO: 244776 - protein, 8 aa, Dengue virus
KQRSQTDN

SEQ ID NO: 244777 - protein, 8 aa, Dengue virus
QRSSDDNK

SEQ ID NO: 244778 - protein, 8 aa, Dengue virus
RSSDDNKL

SEQ ID NO: 244779 - protein, 8 aa, Dengue virus
SQTDNQLA

SEQ ID NO: 244780 - protein, 8 aa, Dengue virus
DLRPATAW

SEQ ID NO: 244781 - protein, 8 aa, Dengue virus
PATAWALY

SEQ ID NO: 244782 - protein, 8 aa, Dengue virus
ATAWALYG

SEQ ID NO: 244783 - protein, 8 aa, Dengue virus
TAWALYGG

SEQ ID NO: 244784 - protein, 8 aa, Dengue virus
AWALYGGS

SEQ ID NO: 244785 - protein, 8 aa, Dengue virus
WALYGGST

SEQ ID NO: 244786 - protein, 8 aa, Dengue virus
ALYGGSTV

SEQ ID NO: 244787 - protein, 8 aa, Dengue virus
HYGYMLPG

SEQ ID NO: 244788 - protein, 8 aa, Dengue virus
YGYMLPGW

SEQ ID NO: 244789 - protein, 8 aa, Dengue virus
GYMLPGWQ

SEQ ID NO: 244790 - protein, 8 aa, Dengue virus
YMLPGWQA

SEQ ID NO: 244791 - protein, 8 aa, Dengue virus
MLPGWQAE

SEQ ID NO: 244792 - protein, 8 aa, Dengue virus
LPGWQAEA

SEQ ID NO: 244793 - protein, 8 aa, Dengue virus
PGWQAEAL

SEQ ID NO: 244794 - protein, 8 aa, Dengue virus
GWQAEALR

SEQ ID NO: 244795 - protein, 8 aa, Dengue virus
WQAEALRA

SEQ ID NO: 244796 - protein, 8 aa, Dengue virus
QAEALRAA

SEQ ID NO: 244797 - protein, 8 aa, Dengue virus
AEALRAAQ

SEQ ID NO: 244798 - protein, 8 aa, Dengue virus
EALRAAQR

SEQ ID NO: 244799 - protein, 8 aa, Dengue virus
ALRAAQRR

SEQ ID NO: 244800 - protein, 8 aa, Dengue virus
RSAQRRTA

SEQ ID NO: 244801 - protein, 8 aa, Dengue virus
SAQRRTAA

SEQ ID NO: 244802 - protein, 8 aa, Dengue virus
AQRRTAAG

SEQ ID NO: 244803 - protein, 8 aa, Dengue virus
QRRTAAGI

SEQ ID NO: 244804 - protein, 8 aa, Dengue virus
RRTAAGIM

SEQ ID NO: 244805 - protein, 8 aa, Dengue virus
VFFSAMVR

SEQ ID NO: 244806 - protein, 8 aa, Dengue virus
FFSAMVRN

SEQ ID NO: 244807 - protein, 8 aa, Dengue virus
FSAMVRNP

SEQ ID NO: 244808 - protein, 8 aa, Dengue virus
SAMVRNPM

SEQ ID NO: 244809 - protein, 8 aa, Dengue virus
GIMKNPTI

SEQ ID NO: 244810 - protein, 8 aa, Dengue virus
MVRNPMVD

SEQ ID NO: 244811 - protein, 8 aa, Dengue virus
VRNPMVDG

SEQ ID NO: 244812 - protein, 8 aa, Dengue virus
MQKKVGQI

SEQ ID NO: 244813 - protein, 8 aa, Dengue virus
SSVWNATT

SEQ ID NO: 244814 - protein, 8 aa, Dengue virus
SVWNATTA

SEQ ID NO: 244815 - protein, 8 aa, Dengue virus
VWNSTTAT

SEQ ID NO: 244816 - protein, 8 aa, Dengue virus
WNSTTATG

SEQ ID NO: 244817 - protein, 8 aa, Dengue virus
CHVMRGSY

SEQ ID NO: 244818 - protein, 8 aa, Dengue virus
HVMRGSYL

SEQ ID NO: 244819 - protein, 8 aa, Dengue virus
VMRGSYLA

SEQ ID NO: 244820 - protein, 8 aa, Dengue virus
MRGSYLAG

SEQ ID NO: 244821 - protein, 8 aa, Dengue virus
RGSYLAGG

SEQ ID NO: 244822 - protein, 8 aa, Dengue virus
GSYLAGGS

SEQ ID NO: 244823 - protein, 8 aa, Dengue virus
SYLAGGSI

SEQ ID NO: 244824 - protein, 8 aa, Dengue virus
GRTLGEQW

SEQ ID NO: 244825 - protein, 8 aa, Dengue virus
RTLGEQWK

SEQ ID NO: 244826 - protein, 8 aa, Dengue virus
PVSRGTAK

SEQ ID NO: 244827 - protein, 8 aa, Dengue virus
VSRGSSKI

SEQ ID NO: 244828 - protein, 8 aa, Dengue virus
SRGSAKLQ

SEQ ID NO: 244829 - protein, 8 aa, Dengue virus
RGSAKLQW

SEQ ID NO: 244830 - protein, 8 aa, Dengue virus
AKLRWLVE

SEQ ID NO: 244831 - protein, 8 aa, Dengue virus
GRVIDLGC

SEQ ID NO: 244832 - protein, 8 aa, Dengue virus
RVIDLGCG

SEQ ID NO: 244833 - protein, 8 aa, Dengue virus
VMDLGCGR

SEQ ID NO: 244834 - protein, 8 aa, Dengue virus
RGGWSYYM

SEQ ID NO: 244835 - protein, 8 aa, Dengue virus
EVRGYTKG

SEQ ID NO: 244836 - protein, 8 aa, Dengue virus
VRGYTKGG

SEQ ID NO: 244837 - protein, 8 aa, Dengue virus
GYTKGGAG

SEQ ID NO: 244838 - protein, 8 aa, Dengue virus
YTKGGAGH

SEQ ID NO: 244839 - protein, 8 aa, Dengue virus
TIGGKGHE

SEQ ID NO: 244840 - protein, 8 aa, Dengue virus
LGRDGHEK

SEQ ID NO: 244841 - protein, 8 aa, Dengue virus
GRDGHEKP

SEQ ID NO: 244842 - protein, 8 aa, Dengue virus
SDTLFCDI

SEQ ID NO: 244843 - protein, 8 aa, Dengue virus
DTIMCDIG

SEQ ID NO: 244844 - protein, 8 aa, Dengue virus
TIMCDIGE

SEQ ID NO: 244845 - protein, 8 aa, Dengue virus
IMCDIGES

SEQ ID NO: 244846 - protein, 8 aa, Dengue virus
MCDIGESN

SEQ ID NO: 244847 - protein, 8 aa, Dengue virus
DIGESSSS

SEQ ID NO: 244848 - protein, 8 aa, Dengue virus
KVLCPYMP

SEQ ID NO: 244849 - protein, 8 aa, Dengue virus
LVRLPLSR

SEQ ID NO: 244850 - protein, 8 aa, Dengue virus
VRLPLSRN

SEQ ID NO: 244851 - protein, 8 aa, Dengue virus
RLPLSRNS

SEQ ID NO: 244852 - protein, 8 aa, Dengue virus
LPLSRNSN

SEQ ID NO: 244853 - protein, 8 aa, Dengue virus
PFSRNSTH

SEQ ID NO: 244854 - protein, 8 aa, Dengue virus
FSRNSTHE

SEQ ID NO: 244855 - protein, 8 aa, Dengue virus
NSTHEMYY

SEQ ID NO: 244856 - protein, 8 aa, Dengue virus
SNHEMYWV

SEQ ID NO: 244857 - protein, 8 aa, Dengue virus
NHEMYWVS

SEQ ID NO: 244858 - protein, 8 aa, Dengue virus
PYRTWAYH

SEQ ID NO: 244859 - protein, 8 aa, Dengue virus
YRTWAYHG

SEQ ID NO: 244860 - protein, 8 aa, Dengue virus
RTWAYHGS

SEQ ID NO: 244861 - protein, 8 aa, Dengue virus
TWTYHGSY

SEQ ID NO: 244862 - protein, 8 aa, Dengue virus
WTYHGSYE

SEQ ID NO: 244863 - protein, 8 aa, Dengue virus
GSASSLVN

SEQ ID NO: 244864 - protein, 8 aa, Dengue virus
SASSLVNG

SEQ ID NO: 244865 - protein, 8 aa, Dengue virus
ASSLVNGV

SEQ ID NO: 244866 - protein, 8 aa, Dengue virus
SSLVNGVV

SEQ ID NO: 244867 - protein, 8 aa, Dengue virus
INGVVKLL

SEQ ID NO: 244868 - protein, 8 aa, Dengue virus
NGVVRLLS

SEQ ID NO: 244869 - protein, 8 aa, Dengue virus
GVVRLLSK

SEQ ID NO: 244870 - protein, 8 aa, Dengue virus
VVRLLSKP

SEQ ID NO: 244871 - protein, 8 aa, Dengue virus
VRLLSKPW

SEQ ID NO: 244872 - protein, 8 aa, Dengue virus
RLLSKPWD

SEQ ID NO: 244873 - protein, 8 aa, Dengue virus
LMSKPWDA

SEQ ID NO: 244874 - protein, 8 aa, Dengue virus
TMAMTDTT

SEQ ID NO: 244875 - protein, 8 aa, Dengue virus
LAMTDTTP

SEQ ID NO: 244876 - protein, 8 aa, Dengue virus
KEKVDTRA

SEQ ID NO: 244877 - protein, 8 aa, Dengue virus
EKVDTKAP

SEQ ID NO: 244878 - protein, 8 aa, Dengue virus
TCIYNMMG

SEQ ID NO: 244879 - protein, 8 aa, Dengue virus
GKREKKLS

SEQ ID NO: 244880 - protein, 8 aa, Dengue virus
KREKKLSE

SEQ ID NO: 244881 - protein, 8 aa, Dengue virus
REKKLSEF

SEQ ID NO: 244882 - protein, 8 aa, Dengue virus
EKKLSEFG

SEQ ID NO: 244883 - protein, 8 aa, Dengue virus
KKLGEFGR

SEQ ID NO: 244884 - protein, 8 aa, Dengue virus
KLGEFGRA

SEQ ID NO: 244885 - protein, 8 aa, Dengue virus
LGEFGRAK

SEQ ID NO: 244886 - protein, 8 aa, Dengue virus
GEFGVAKG

SEQ ID NO: 244887 - protein, 8 aa, Dengue virus
EFGVAKGS

SEQ ID NO: 244888 - protein, 8 aa, Dengue virus
FGVAKGSR

SEQ ID NO: 244889 - protein, 8 aa, Dengue virus
GVAKGSRA

SEQ ID NO: 244890 - protein, 8 aa, Dengue virus
VAKGSRAI

SEQ ID NO: 244891 - protein, 8 aa, Dengue virus
IWYMWLGS

SEQ ID NO: 244892 - protein, 8 aa, Dengue virus
WYMWLGSR

SEQ ID NO: 244893 - protein, 8 aa, Dengue virus
FMWLGARF

SEQ ID NO: 244894 - protein, 8 aa, Dengue virus
MWLGSRFL

SEQ ID NO: 244895 - protein, 8 aa, Dengue virus
WLGSRFLE

SEQ ID NO: 244896 - protein, 8 aa, Dengue virus
LGSRFLEF

SEQ ID NO: 244897 - protein, 8 aa, Dengue virus
GSRFLEFE

SEQ ID NO: 244898 - protein, 8 aa, Dengue virus
SRFLEFEA

SEQ ID NO: 244899 - protein, 8 aa, Dengue virus
FLNEDHWL

SEQ ID NO: 244900 - protein, 8 aa, Dengue virus
NEDHWFGR

SEQ ID NO: 244901 - protein, 8 aa, Dengue virus
GGVEGSGV

SEQ ID NO: 244902 - protein, 8 aa, Dengue virus
GVEGSGVQ

SEQ ID NO: 244903 - protein, 8 aa, Dengue virus
FYADDTAG

SEQ ID NO: 244904 - protein, 8 aa, Dengue virus
IMQKAYHA

SEQ ID NO: 244905 - protein, 8 aa, Dengue virus
MQKAYHAK

SEQ ID NO: 244906 - protein, 8 aa, Dengue virus
QKAYHAKV

SEQ ID NO: 244907 - protein, 8 aa, Dengue virus
KAYHAKVV

SEQ ID NO: 244908 - protein, 8 aa, Dengue virus
TYRHKVVK

SEQ ID NO: 244909 - protein, 8 aa, Dengue virus
YRHKVVKV

SEQ ID NO: 244910 - protein, 8 aa, Dengue virus
HKVVKVMR

SEQ ID NO: 244911 - protein, 8 aa, Dengue virus
KVVKVMRP

SEQ ID NO: 244912 - protein, 8 aa, Dengue virus
AVMDIISR

SEQ ID NO: 244913 - protein, 8 aa, Dengue virus
MDIISRRD

SEQ ID NO: 244914 - protein, 8 aa, Dengue virus
DIISRRDQ

SEQ ID NO: 244915 - protein, 8 aa, Dengue virus
IISRRDQR

SEQ ID NO: 244916 - protein, 8 aa, Dengue virus
ISREDQRG

SEQ ID NO: 244917 - protein, 8 aa, Dengue virus
SREDQRGS

SEQ ID NO: 244918 - protein, 8 aa, Dengue virus
REDQRGSG

SEQ ID NO: 244919 - protein, 8 aa, Dengue virus
EDQRGSGQ

SEQ ID NO: 244920 - protein, 8 aa, Dengue virus
SGQVVTYG

SEQ ID NO: 244921 - protein, 8 aa, Dengue virus
GQVVTYGL

SEQ ID NO: 244922 - protein, 8 aa, Dengue virus
QVVTYGLN

SEQ ID NO: 244923 - protein, 8 aa, Dengue virus
VVTYGLNT

SEQ ID NO: 244924 - protein, 8 aa, Dengue virus
RMLVSGDD

SEQ ID NO: 244925 - protein, 8 aa, Dengue virus
MLVSGDDC

SEQ ID NO: 244926 - protein, 8 aa, Dengue virus
LVSGDDCV

SEQ ID NO: 244927 - protein, 8 aa, Dengue virus
LNAMSKVR

SEQ ID NO: 244928 - protein, 8 aa, Dengue virus
NAMSKVRK

SEQ ID NO: 244929 - protein, 8 aa, Dengue virus
AMSKVRKD

SEQ ID NO: 244930 - protein, 8 aa, Dengue virus
MSKVRKDI

SEQ ID NO: 244931 - protein, 8 aa, Dengue virus
NWQEVPFC

SEQ ID NO: 244932 - protein, 8 aa, Dengue virus
WQEVPFCS

SEQ ID NO: 244933 - protein, 8 aa, Dengue virus
EVPFCSHH

SEQ ID NO: 244934 - protein, 8 aa, Dengue virus
PFCSNHFQ

SEQ ID NO: 244935 - protein, 8 aa, Dengue virus
FCSNHFTE

SEQ ID NO: 244936 - protein, 8 aa, Dengue virus
CSNHFTEL

SEQ ID NO: 244937 - protein, 8 aa, Dengue virus
VPCRGQDE

SEQ ID NO: 244938 - protein, 8 aa, Dengue virus
PCRGQDEL

SEQ ID NO: 244939 - protein, 8 aa, Dengue virus
QDELIGRG

SEQ ID NO: 244940 - protein, 8 aa, Dengue virus
DELIGRGR

SEQ ID NO: 244941 - protein, 8 aa, Dengue virus
ELVGRARI

SEQ ID NO: 244942 - protein, 8 aa, Dengue virus
LVGRARIS

SEQ ID NO: 244943 - protein, 8 aa, Dengue virus
GRARISPG

SEQ ID NO: 244944 - protein, 8 aa, Dengue virus
RARISPGA

SEQ ID NO: 244945 - protein, 8 aa, Dengue virus
ARISPGAG

SEQ ID NO: 244946 - protein, 8 aa, Dengue virus
RISPGAGW

SEQ ID NO: 244947 - protein, 8 aa, Dengue virus
ISPGAGWN

SEQ ID NO: 244948 - protein, 8 aa, Dengue virus
SPGCGWSV

SEQ ID NO: 244949 - protein, 8 aa, Dengue virus
DTACLAKS

SEQ ID NO: 244950 - protein, 8 aa, Dengue virus
TACLAKSY

SEQ ID NO: 244951 - protein, 8 aa, Dengue virus
ACLAKSYA

SEQ ID NO: 244952 - protein, 8 aa, Dengue virus
CLAKSYAQ

SEQ ID NO: 244953 - protein, 8 aa, Dengue virus
LAKSYAQM

SEQ ID NO: 244954 - protein, 8 aa, Dengue virus
LSYFHRRD

SEQ ID NO: 244955 - protein, 8 aa, Dengue virus
SYFHRRDL

SEQ ID NO: 244956 - protein, 8 aa, Dengue virus
FHKRDMRL

SEQ ID NO: 244957 - protein, 8 aa, Dengue virus
HRRDLRTL

SEQ ID NO: 244958 - protein, 8 aa, Dengue virus
RRDLRLMA

SEQ ID NO: 244959 - protein, 8 aa, Dengue virus
SMAICSAV

SEQ ID NO: 244960 - protein, 8 aa, Dengue virus
LAVSSAVP

SEQ ID NO: 244961 - protein, 8 aa, Dengue virus
PTGRTSWS

SEQ ID NO: 244962 - protein, 8 aa, Dengue virus
TGRTSWSI

SEQ ID NO: 244963 - protein, 8 aa, Dengue virus
GRTSWSIH

SEQ ID NO: 244964 - protein, 8 aa, Dengue virus
RTTWSIHG

SEQ ID NO: 244965 - protein, 8 aa, Dengue virus
GEWMTTED

SEQ ID NO: 244966 - protein, 8 aa, Dengue virus
AWMTTEDM

SEQ ID NO: 244967 - protein, 8 aa, Dengue virus
VWNRVWIR

SEQ ID NO: 244968 - protein, 8 aa, Dengue virus
PYVGKRED

SEQ ID NO: 244969 - protein, 8 aa, Dengue virus
GKREDLWC

SEQ ID NO: 244970 - protein, 8 aa, Dengue virus
KREDLWCG

SEQ ID NO: 244971 - protein, 8 aa, Dengue virus
REDLWCGS

SEQ ID NO: 244972 - protein, 8 aa, Dengue virus
EDLWCGSL

SEQ ID NO: 244973 - protein, 8 aa, Dengue virus
DLWCGSLI

SEQ ID NO: 244974 - protein, 8 aa, Dengue virus
LWCGSLIG

SEQ ID NO: 244975 - protein, 8 aa, Dengue virus
LCSSLVGR

SEQ ID NO: 244976 - protein, 8 aa, Dengue virus
CGSLIGLS

SEQ ID NO: 244977 - protein, 8 aa, Dengue virus
SNKIKQKT

SEQ ID NO: 244978 - protein, 8 aa, Dengue virus
GLVKRFST

SEQ ID NO: 244979 - protein, 8 aa, Dengue virus
LVKRFSTG

SEQ ID NO: 244980 - protein, 8 aa, Dengue virus
VKRFSTGL

SEQ ID NO: 244981 - protein, 8 aa, Dengue virus
ADVIVIPT

SEQ ID NO: 244982 - protein, 8 aa, Dengue virus
DPEDVDCW

SEQ ID NO: 244983 - protein, 8 aa, Dengue virus
PVDVDCFC

SEQ ID NO: 244984 - protein, 8 aa, Dengue virus
VLEGDSCL

SEQ ID NO: 244985 - protein, 8 aa, Dengue virus
LEGDSCLT

SEQ ID NO: 244986 - protein, 8 aa, Dengue virus
GLFGKGGV

SEQ ID NO: 244987 - protein, 8 aa, Dengue virus
SGEENAVG

SEQ ID NO: 244988 - protein, 8 aa, Dengue virus
GEENAVGN

SEQ ID NO: 244989 - protein, 8 aa, Dengue virus
CRVASGVD

SEQ ID NO: 244990 - protein, 8 aa, Dengue virus
NLGDQTGV

SEQ ID NO: 244991 - protein, 8 aa, Dengue virus
LGDQTGVL

SEQ ID NO: 244992 - protein, 8 aa, Dengue virus
GDQTGVLL

SEQ ID NO: 244993 - protein, 8 aa, Dengue virus
QLPPGDNI

SEQ ID NO: 244994 - protein, 8 aa, Dengue virus
LPPGDNII

SEQ ID NO: 244995 - protein, 8 aa, Dengue virus
GIERLTVI

SEQ ID NO: 244996 - protein, 8 aa, Dengue virus
IERLTVIG

SEQ ID NO: 244997 - protein, 8 aa, Dengue virus
RLTVIGEH

SEQ ID NO: 244998 - protein, 8 aa, Dengue virus
LTVIGEHA

SEQ ID NO: 244999 - protein, 8 aa, Dengue virus
TVIGEHAW

SEQ ID NO: 245000 - protein, 8 aa, Dengue virus
VIGEHAWD

SEQ ID NO: 245001 - protein, 8 aa, Dengue virus
MGDTAWDF

SEQ ID NO: 245002 - protein, 8 aa, Dengue virus
GDTAWDFS

SEQ ID NO: 245003 - protein, 8 aa, Dengue virus
DTAWDFSS

SEQ ID NO: 245004 - protein, 8 aa, Dengue virus
HAWDFGST

SEQ ID NO: 245005 - protein, 8 aa, Dengue virus
AWDFGSTG

SEQ ID NO: 245006 - protein, 8 aa, Dengue virus
WDFSSAGG

SEQ ID NO: 245007 - protein, 8 aa, Dengue virus
ELRCGEGL

SEQ ID NO: 245008 - protein, 8 aa, Dengue virus
LRCGEGLV

SEQ ID NO: 245009 - protein, 8 aa, Dengue virus
VSEWYDNY

SEQ ID NO: 245010 - protein, 8 aa, Dengue virus
SEWYDNYA

SEQ ID NO: 245011 - protein, 8 aa, Dengue virus
TVAEFGVG

SEQ ID NO: 245012 - protein, 8 aa, Dengue virus
SAHGSPTF

SEQ ID NO: 245013 - protein, 8 aa, Dengue virus
AHGSPTFW

SEQ ID NO: 245014 - protein, 8 aa, Dengue virus
HGSPTFWM

SEQ ID NO: 245015 - protein, 8 aa, Dengue virus
GSPTFWMG

SEQ ID NO: 245016 - protein, 8 aa, Dengue virus
SPTFWMGS

SEQ ID NO: 245017 - protein, 8 aa, Dengue virus
WPASHTID

SEQ ID NO: 245018 - protein, 8 aa, Dengue virus
PASHTIDN

SEQ ID NO: 245019 - protein, 8 aa, Dengue virus
ASHTIDNA

SEQ ID NO: 245020 - protein, 8 aa, Dengue virus
SHTIDNAE

SEQ ID NO: 245021 - protein, 8 aa, Dengue virus
DWCCRSCS

SEQ ID NO: 245022 - protein, 8 aa, Dengue virus
WCCRTCTL

SEQ ID NO: 245023 - protein, 8 aa, Dengue virus
CCRTCTLP

SEQ ID NO: 245024 - protein, 8 aa, Dengue virus
CRTCTLPP

SEQ ID NO: 245025 - protein, 8 aa, Dengue virus
RSCTMPPV

SEQ ID NO: 245026 - protein, 8 aa, Dengue virus
SCTMPPVS

SEQ ID NO: 245027 - protein, 8 aa, Dengue virus
TGTDCWYA

SEQ ID NO: 245028 - protein, 8 aa, Dengue virus
GTDCWYAM

SEQ ID NO: 245029 - protein, 8 aa, Dengue virus
TDCWYAME

SEQ ID NO: 245030 - protein, 8 aa, Dengue virus
VLHTMWHV

SEQ ID NO: 245031 - protein, 8 aa, Dengue virus
LWHTTRGA

SEQ ID NO: 245032 - protein, 8 aa, Dengue virus
WHTTRGAA

SEQ ID NO: 245033 - protein, 8 aa, Dengue virus
HTTRGAAI

SEQ ID NO: 245034 - protein, 8 aa, Dengue virus
KGTSGSPI

SEQ ID NO: 245035 - protein, 8 aa, Dengue virus
IIGLYGNG

SEQ ID NO: 245036 - protein, 8 aa, Dengue virus
IGLYGNGI

SEQ ID NO: 245037 - protein, 8 aa, Dengue virus
GLYGNGLK

SEQ ID NO: 245038 - protein, 8 aa, Dengue virus
LYGNGLKT

SEQ ID NO: 245039 - protein, 8 aa, Dengue virus
ITVLDMHP

SEQ ID NO: 245040 - protein, 8 aa, Dengue virus
TILDFHPG

SEQ ID NO: 245041 - protein, 8 aa, Dengue virus
LDLHPGSG

SEQ ID NO: 245042 - protein, 8 aa, Dengue virus
HPGSGKTH

SEQ ID NO: 245043 - protein, 8 aa, Dengue virus
RVVLKEME

SEQ ID NO: 245044 - protein, 8 aa, Dengue virus
VVLKEMER

SEQ ID NO: 245045 - protein, 8 aa, Dengue virus
VLKEMERA

SEQ ID NO: 245046 - protein, 8 aa, Dengue virus
LKEMERAL

SEQ ID NO: 245047 - protein, 8 aa, Dengue virus
GKRVRFHS

SEQ ID NO: 245048 - protein, 8 aa, Dengue virus
GGAIVDVM

SEQ ID NO: 245049 - protein, 8 aa, Dengue virus
GAIVDVMC

SEQ ID NO: 245050 - protein, 8 aa, Dengue virus
EVIDAMCH

SEQ ID NO: 245051 - protein, 8 aa, Dengue virus
MCHATYVN

SEQ ID NO: 245052 - protein, 8 aa, Dengue virus
CHATYVNR

SEQ ID NO: 245053 - protein, 8 aa, Dengue virus
HATYVNRR

SEQ ID NO: 245054 - protein, 8 aa, Dengue virus
ATYVNRRL

SEQ ID NO: 245055 - protein, 8 aa, Dengue virus
TYVNRRLL

SEQ ID NO: 245056 - protein, 8 aa, Dengue virus
YVNRRLLP

SEQ ID NO: 245057 - protein, 8 aa, Dengue virus
RVPNYNLV

SEQ ID NO: 245058 - protein, 8 aa, Dengue virus
VIMDEAHF

SEQ ID NO: 245059 - protein, 8 aa, Dengue virus
EAHFLDPA

SEQ ID NO: 245060 - protein, 8 aa, Dengue virus
AHFLDPAS

SEQ ID NO: 245061 - protein, 8 aa, Dengue virus
HWTDPHSI

SEQ ID NO: 245062 - protein, 8 aa, Dengue virus
WTDPHSIA

SEQ ID NO: 245063 - protein, 8 aa, Dengue virus
TDPHSIAA

SEQ ID NO: 245064 - protein, 8 aa, Dengue virus
DPHSIAAR

SEQ ID NO: 245065 - protein, 8 aa, Dengue virus
PHSIAARG

SEQ ID NO: 245066 - protein, 8 aa, Dengue virus
HSIAARGH

SEQ ID NO: 245067 - protein, 8 aa, Dengue virus
SIAARGWA

SEQ ID NO: 245068 - protein, 8 aa, Dengue virus
IAARGHLY

SEQ ID NO: 245069 - protein, 8 aa, Dengue virus
AARGWAAH

SEQ ID NO: 245070 - protein, 8 aa, Dengue virus
ARGHLYTL

SEQ ID NO: 245071 - protein, 8 aa, Dengue virus
RGHLYTLA

SEQ ID NO: 245072 - protein, 8 aa, Dengue virus
GYIATKVE

SEQ ID NO: 245073 - protein, 8 aa, Dengue virus
TLAKENKC

SEQ ID NO: 245074 - protein, 8 aa, Dengue virus
LAKENKCA

SEQ ID NO: 245075 - protein, 8 aa, Dengue virus
ENKCALVL

SEQ ID NO: 245076 - protein, 8 aa, Dengue virus
NESATILM

SEQ ID NO: 245077 - protein, 8 aa, Dengue virus
ESATILMT

SEQ ID NO: 245078 - protein, 8 aa, Dengue virus
SATILMTA

SEQ ID NO: 245079 - protein, 8 aa, Dengue virus
MTATPPGK

SEQ ID NO: 245080 - protein, 8 aa, Dengue virus
RPTAWFLP

SEQ ID NO: 245081 - protein, 8 aa, Dengue virus
PTAWFLPS

SEQ ID NO: 245082 - protein, 8 aa, Dengue virus
TAWFVPSI

SEQ ID NO: 245083 - protein, 8 aa, Dengue virus
AWFVPSIA

SEQ ID NO: 245084 - protein, 8 aa, Dengue virus
VICLNSKT

SEQ ID NO: 245085 - protein, 8 aa, Dengue virus
ICLNSKTF

SEQ ID NO: 245086 - protein, 8 aa, Dengue virus
CLNSKTFE

SEQ ID NO: 245087 - protein, 8 aa, Dengue virus
KPDFVVTT

SEQ ID NO: 245088 - protein, 8 aa, Dengue virus
PDFVVTTD

SEQ ID NO: 245089 - protein, 8 aa, Dengue virus
SEMGANLD

SEQ ID NO: 245090 - protein, 8 aa, Dengue virus
EMGANLDV

SEQ ID NO: 245091 - protein, 8 aa, Dengue virus
RVIDGRTN

SEQ ID NO: 245092 - protein, 8 aa, Dengue virus
VIDCRKSV

SEQ ID NO: 245093 - protein, 8 aa, Dengue virus
IDCRKSVK

SEQ ID NO: 245094 - protein, 8 aa, Dengue virus
DCRKSVKP

SEQ ID NO: 245095 - protein, 8 aa, Dengue virus
CRKSVKPT

SEQ ID NO: 245096 - protein, 8 aa, Dengue virus
RTAFKPVL

SEQ ID NO: 245097 - protein, 8 aa, Dengue virus
KSVKPTIL

SEQ ID NO: 245098 - protein, 8 aa, Dengue virus
WTEAKIML

SEQ ID NO: 245099 - protein, 8 aa, Dengue virus
TEAKIMLD

SEQ ID NO: 245100 - protein, 8 aa, Dengue virus
EAQILLDN

SEQ ID NO: 245101 - protein, 8 aa, Dengue virus
AQILLDNI

SEQ ID NO: 245102 - protein, 8 aa, Dengue virus
AGHFRLTE

SEQ ID NO: 245103 - protein, 8 aa, Dengue virus
GHFRLTEE

SEQ ID NO: 245104 - protein, 8 aa, Dengue virus
LVRNCDLP

SEQ ID NO: 245105 - protein, 8 aa, Dengue virus
VRNCDLPV

SEQ ID NO: 245106 - protein, 8 aa, Dengue virus
RNCDLPVW

SEQ ID NO: 245107 - protein, 8 aa, Dengue virus
CDFTPWLA

SEQ ID NO: 245108 - protein, 8 aa, Dengue virus
DFTPWLAW

SEQ ID NO: 245109 - protein, 8 aa, Dengue virus
DRKWCFEG

SEQ ID NO: 245110 - protein, 8 aa, Dengue virus
FASGRKSI

SEQ ID NO: 245111 - protein, 8 aa, Dengue virus
VLQPEAGK

SEQ ID NO: 245112 - protein, 8 aa, Dengue virus
VIPEPGQQ

SEQ ID NO: 245113 - protein, 8 aa, Dengue virus
IPEPGQQR

SEQ ID NO: 245114 - protein, 8 aa, Dengue virus
PEAGKQRS

SEQ ID NO: 245115 - protein, 8 aa, Dengue virus
EAGKQRSS

SEQ ID NO: 245116 - protein, 8 aa, Dengue virus
AGKQRSSD

SEQ ID NO: 245117 - protein, 8 aa, Dengue virus
GKQRSSDD

SEQ ID NO: 245118 - protein, 8 aa, Dengue virus
KQRSSDDN

SEQ ID NO: 245119 - protein, 8 aa, Dengue virus
TPQDNQLI

SEQ ID NO: 245120 - protein, 8 aa, Dengue virus
DIQPARSW

SEQ ID NO: 245121 - protein, 8 aa, Dengue virus
PARSWGTY

SEQ ID NO: 245122 - protein, 8 aa, Dengue virus
ARSWGTYV

SEQ ID NO: 245123 - protein, 8 aa, Dengue virus
RSWGTYVL

SEQ ID NO: 245124 - protein, 8 aa, Dengue virus
SWGTYVLV

SEQ ID NO: 245125 - protein, 8 aa, Dengue virus
WGTYVLVV

SEQ ID NO: 245126 - protein, 8 aa, Dengue virus
GTYVLVVS

SEQ ID NO: 245127 - protein, 8 aa, Dengue virus
HLAIVVSG

SEQ ID NO: 245128 - protein, 8 aa, Dengue virus
LAIVVSGL

SEQ ID NO: 245129 - protein, 8 aa, Dengue virus
AIVVSGLE

SEQ ID NO: 245130 - protein, 8 aa, Dengue virus
IVVSGLEA

SEQ ID NO: 245131 - protein, 8 aa, Dengue virus
VVSGLEAE

SEQ ID NO: 245132 - protein, 8 aa, Dengue virus
VSGLEAEL

SEQ ID NO: 245133 - protein, 8 aa, Dengue virus
SGLEAELT

SEQ ID NO: 245134 - protein, 8 aa, Dengue virus
GLEAELTQ

SEQ ID NO: 245135 - protein, 8 aa, Dengue virus
LEAELTQR

SEQ ID NO: 245136 - protein, 8 aa, Dengue virus
EAELTQRA

SEQ ID NO: 245137 - protein, 8 aa, Dengue virus
AELTQRAH

SEQ ID NO: 245138 - protein, 8 aa, Dengue virus
ELTQRAHK

SEQ ID NO: 245139 - protein, 8 aa, Dengue virus
LTQRAHKV

SEQ ID NO: 245140 - protein, 8 aa, Dengue virus
RAAQRRTA

SEQ ID NO: 245141 - protein, 8 aa, Dengue virus
AAQRRTAA

SEQ ID NO: 245142 - protein, 8 aa, Dengue virus
AHKVFFSA

SEQ ID NO: 245143 - protein, 8 aa, Dengue virus
HKVFFSAM

SEQ ID NO: 245144 - protein, 8 aa, Dengue virus
KVFFSAMV

SEQ ID NO: 245145 - protein, 8 aa, Dengue virus
FHGVAKNP

SEQ ID NO: 245146 - protein, 8 aa, Dengue virus
HGVAKNPV

SEQ ID NO: 245147 - protein, 8 aa, Dengue virus
AMVRNPMV

SEQ ID NO: 245148 - protein, 8 aa, Dengue virus
IMKNPTID

SEQ ID NO: 245149 - protein, 8 aa, Dengue virus
MKNPTIDG

SEQ ID NO: 245150 - protein, 8 aa, Dengue virus
MQKKVGQV

SEQ ID NO: 245151 - protein, 8 aa, Dengue virus
SAVWNSTT

SEQ ID NO: 245152 - protein, 8 aa, Dengue virus
AVWNSTTA

SEQ ID NO: 245153 - protein, 8 aa, Dengue virus
LWTMPVAC

SEQ ID NO: 245154 - protein, 8 aa, Dengue virus
WTMPVACG

SEQ ID NO: 245155 - protein, 8 aa, Dengue virus
SGVVRGSL

SEQ ID NO: 245156 - protein, 8 aa, Dengue virus
GVVRGSLW

SEQ ID NO: 245157 - protein, 8 aa, Dengue virus
VVRGSLWG

SEQ ID NO: 245158 - protein, 8 aa, Dengue virus
VRGSLWGF

SEQ ID NO: 245159 - protein, 8 aa, Dengue virus
RGSLWGFL

SEQ ID NO: 245160 - protein, 8 aa, Dengue virus
GSLWGFLP

SEQ ID NO: 245161 - protein, 8 aa, Dengue virus
SLWGFLPL

SEQ ID NO: 245162 - protein, 8 aa, Dengue virus
GDTLGDLW

SEQ ID NO: 245163 - protein, 8 aa, Dengue virus
DTLGDLWK

SEQ ID NO: 245164 - protein, 8 aa, Dengue virus
AVSRGSSK

SEQ ID NO: 245165 - protein, 8 aa, Dengue virus
SRGSSKIR

SEQ ID NO: 245166 - protein, 8 aa, Dengue virus
RGSSKIRW

SEQ ID NO: 245167 - protein, 8 aa, Dengue virus
SKIRWIVE

SEQ ID NO: 245168 - protein, 8 aa, Dengue virus
GEVVDLGC

SEQ ID NO: 245169 - protein, 8 aa, Dengue virus
EVVDLGCG

SEQ ID NO: 245170 - protein, 8 aa, Dengue virus
RGGWSYYA

SEQ ID NO: 245171 - protein, 8 aa, Dengue virus
GVKGFTLG

SEQ ID NO: 245172 - protein, 8 aa, Dengue virus
VKGFTLGR

SEQ ID NO: 245173 - protein, 8 aa, Dengue virus
AYTIGGKG

SEQ ID NO: 245174 - protein, 8 aa, Dengue virus
YTIGGKGH

SEQ ID NO: 245175 - protein, 8 aa, Dengue virus
TLGRDGHE

SEQ ID NO: 245176 - protein, 8 aa, Dengue virus
IGGKGHET

SEQ ID NO: 245177 - protein, 8 aa, Dengue virus
GGKGHETP

SEQ ID NO: 245178 - protein, 8 aa, Dengue virus
ADTIMCDI

SEQ ID NO: 245179 - protein, 8 aa, Dengue virus
DIGESSSN

SEQ ID NO: 245180 - protein, 8 aa, Dengue virus
KVLAPYRP

SEQ ID NO: 245181 - protein, 8 aa, Dengue virus
LVRTPFSR

SEQ ID NO: 245182 - protein, 8 aa, Dengue virus
VRTPFSRN

SEQ ID NO: 245183 - protein, 8 aa, Dengue virus
RTPFSRNS

SEQ ID NO: 245184 - protein, 8 aa, Dengue virus
TPFSRNST

SEQ ID NO: 245185 - protein, 8 aa, Dengue virus
STHEMYYS

SEQ ID NO: 245186 - protein, 8 aa, Dengue virus
THEMYYST

SEQ ID NO: 245187 - protein, 8 aa, Dengue virus
PYRTWTYH

SEQ ID NO: 245188 - protein, 8 aa, Dengue virus
YRTWTYHG

SEQ ID NO: 245189 - protein, 8 aa, Dengue virus
RTWTYHGS

SEQ ID NO: 245190 - protein, 8 aa, Dengue virus
TWQYWGSY

SEQ ID NO: 245191 - protein, 8 aa, Dengue virus
WQYWGSYR

SEQ ID NO: 245192 - protein, 8 aa, Dengue virus
GSAASLIN

SEQ ID NO: 245193 - protein, 8 aa, Dengue virus
SAASLING

SEQ ID NO: 245194 - protein, 8 aa, Dengue virus
AASLINGV

SEQ ID NO: 245195 - protein, 8 aa, Dengue virus
ASLINGVV

SEQ ID NO: 245196 - protein, 8 aa, Dengue virus
VNGVVKLM

SEQ ID NO: 245197 - protein, 8 aa, Dengue virus
NGVVKLMS

SEQ ID NO: 245198 - protein, 8 aa, Dengue virus
GVVKLMSK

SEQ ID NO: 245199 - protein, 8 aa, Dengue virus
VVKLMSKP

SEQ ID NO: 245200 - protein, 8 aa, Dengue virus
VKLMSKPW

SEQ ID NO: 245201 - protein, 8 aa, Dengue virus
KLMSKPWD

SEQ ID NO: 245202 - protein, 8 aa, Dengue virus
LLSWPWNA

SEQ ID NO: 245203 - protein, 8 aa, Dengue virus
QLAMTDTT

SEQ ID NO: 245204 - protein, 8 aa, Dengue virus
MAMTDTTA

SEQ ID NO: 245205 - protein, 8 aa, Dengue virus
EKVDTRAK

SEQ ID NO: 245206 - protein, 8 aa, Dengue virus
HCVYNMMG

SEQ ID NO: 245207 - protein, 8 aa, Dengue virus
KKLGEFGV

SEQ ID NO: 245208 - protein, 8 aa, Dengue virus
KLGEFGVA

SEQ ID NO: 245209 - protein, 8 aa, Dengue virus
LGEFGVAK

SEQ ID NO: 245210 - protein, 8 aa, Dengue virus
SEFGKAKG

SEQ ID NO: 245211 - protein, 8 aa, Dengue virus
FMWLGARY

SEQ ID NO: 245212 - protein, 8 aa, Dengue virus
FLNEDHWA

SEQ ID NO: 245213 - protein, 8 aa, Dengue virus
NEDHWLSR

SEQ ID NO: 245214 - protein, 8 aa, Dengue virus
GGVEGIGL

SEQ ID NO: 245215 - protein, 8 aa, Dengue virus
GVEGISLN

SEQ ID NO: 245216 - protein, 8 aa, Dengue virus
VMEMTYKN

SEQ ID NO: 245217 - protein, 8 aa, Dengue virus
MEMTYKNK

SEQ ID NO: 245218 - protein, 8 aa, Dengue virus
EMTYKNKV

SEQ ID NO: 245219 - protein, 8 aa, Dengue virus
MTYKNKVV

SEQ ID NO: 245220 - protein, 8 aa, Dengue virus
AYHAKVVK

SEQ ID NO: 245221 - protein, 8 aa, Dengue virus
YHAKVVKV

SEQ ID NO: 245222 - protein, 8 aa, Dengue virus
NKVVKVLR

SEQ ID NO: 245223 - protein, 8 aa, Dengue virus
KVVKVLRP

SEQ ID NO: 245224 - protein, 8 aa, Dengue virus
CIMDVITR

SEQ ID NO: 245225 - protein, 8 aa, Dengue virus
MDVISRED

SEQ ID NO: 245226 - protein, 8 aa, Dengue virus
DVISREDQ

SEQ ID NO: 245227 - protein, 8 aa, Dengue virus
VISREDQR

SEQ ID NO: 245228 - protein, 8 aa, Dengue virus
ITRRDQRG

SEQ ID NO: 245229 - protein, 8 aa, Dengue virus
TRRDQRGS

SEQ ID NO: 245230 - protein, 8 aa, Dengue virus
LNDMAKTR

SEQ ID NO: 245231 - protein, 8 aa, Dengue virus
NDMAKTRK

SEQ ID NO: 245232 - protein, 8 aa, Dengue virus
DMAKTRKD

SEQ ID NO: 245233 - protein, 8 aa, Dengue virus
MAKTRKDI

SEQ ID NO: 245234 - protein, 8 aa, Dengue virus
DWENVPFC

SEQ ID NO: 245235 - protein, 8 aa, Dengue virus
WEEVPFCS

SEQ ID NO: 245236 - protein, 8 aa, Dengue virus
NVPFCSHH

SEQ ID NO: 245237 - protein, 8 aa, Dengue virus
FCSHHFHK

SEQ ID NO: 245238 - protein, 8 aa, Dengue virus
CSHHFHKI

SEQ ID NO: 245239 - protein, 8 aa, Dengue virus
VPCRDQDE

SEQ ID NO: 245240 - protein, 8 aa, Dengue virus
PCRDQDEL

SEQ ID NO: 245241 - protein, 8 aa, Dengue virus
ELIGRGRV

SEQ ID NO: 245242 - protein, 8 aa, Dengue virus
LIGRGRVS

SEQ ID NO: 245243 - protein, 8 aa, Dengue virus
GRGRVSPG

SEQ ID NO: 245244 - protein, 8 aa, Dengue virus
RGRVSPGN

SEQ ID NO: 245245 - protein, 8 aa, Dengue virus
GRVSPGNG

SEQ ID NO: 245246 - protein, 8 aa, Dengue virus
RVSPGNGW

SEQ ID NO: 245247 - protein, 8 aa, Dengue virus
VSPGNGWM

SEQ ID NO: 245248 - protein, 8 aa, Dengue virus
SPGNGWMI

SEQ ID NO: 245249 - protein, 8 aa, Dengue virus
DTACLAKA

SEQ ID NO: 245250 - protein, 8 aa, Dengue virus
TACLAKAY

SEQ ID NO: 245251 - protein, 8 aa, Dengue virus
ACLAKAYA

SEQ ID NO: 245252 - protein, 8 aa, Dengue virus
CLAKAYAQ

SEQ ID NO: 245253 - protein, 8 aa, Dengue virus
LAKAYAQM

SEQ ID NO: 245254 - protein, 8 aa, Dengue virus
LMYFHKRD

SEQ ID NO: 245255 - protein, 8 aa, Dengue virus
MYFHKRDM

SEQ ID NO: 245256 - protein, 8 aa, Dengue virus
HKRDMRLL

SEQ ID NO: 245257 - protein, 8 aa, Dengue virus
RRDLRTLG

SEQ ID NO: 245258 - protein, 8 aa, Dengue virus
SLAVSSAV

SEQ ID NO: 245259 - protein, 8 aa, Dengue virus
LAICSAVP

SEQ ID NO: 245260 - protein, 8 aa, Dengue virus
PQGRTTWS

SEQ ID NO: 245261 - protein, 8 aa, Dengue virus
QGRTTWSI

SEQ ID NO: 245262 - protein, 8 aa, Dengue virus
GAWMTTED

SEQ ID NO: 245263 - protein, 8 aa, Dengue virus
VWNRVWIL

SEQ ID NO: 245264 - protein, 8 aa, Dengue virus
PYLTKRQD

SEQ ID NO: 245265 - protein, 8 aa, Dengue virus
TKRQDKLC

SEQ ID NO: 245266 - protein, 8 aa, Dengue virus
KRQDKLCG

SEQ ID NO: 245267 - protein, 8 aa, Dengue virus
RQDKLCGS

SEQ ID NO: 245268 - protein, 8 aa, Dengue virus
QDKLCGSL

SEQ ID NO: 245269 - protein, 8 aa, Dengue virus
DMLCSSLV

SEQ ID NO: 245270 - protein, 8 aa, Dengue virus
MLCSSLVG

SEQ ID NO: 245271 - protein, 8 aa, Dengue virus
LCGSLIGM

SEQ ID NO: 245272 - protein, 8 aa, Dengue virus
CSSLVGRK

SEQ ID NO: 245273 - protein, 8 aa, Dengue virus
NKIKQKTK

SEQ ID NO: 245274 - protein, 8 aa, Dengue virus
KIKQKTKQ

SEQ ID NO: 245275 - protein, 8 aa, Dengue virus
IKQKTKQI

SEQ ID NO: 245276 - protein, 8 aa, Dengue virus
DAATQVRV

SEQ ID NO: 245277 - protein, 8 aa, Dengue virus
EPVDVDCF

SEQ ID NO: 245278 - protein, 8 aa, Dengue virus
VLELGGCV

SEQ ID NO: 245279 - protein, 8 aa, Dengue virus
LELGGCVT

SEQ ID NO: 245280 - protein, 8 aa, Dengue virus
VGAKQENW

SEQ ID NO: 245281 - protein, 8 aa, Dengue virus
GAKQENWN

SEQ ID NO: 245282 - protein, 8 aa, Dengue virus
CQVQTAVD

SEQ ID NO: 245283 - protein, 8 aa, Dengue virus
ALGNQEGS

SEQ ID NO: 245284 - protein, 8 aa, Dengue virus
LGNQEGSL

SEQ ID NO: 245285 - protein, 8 aa, Dengue virus
GNQEGSLK

SEQ ID NO: 245286 - protein, 8 aa, Dengue virus
NPPFGDSY

SEQ ID NO: 245287 - protein, 8 aa, Dengue virus
GVERLAVM

SEQ ID NO: 245288 - protein, 8 aa, Dengue virus
VERLAVMG

SEQ ID NO: 245289 - protein, 8 aa, Dengue virus
RLAVMGDT

SEQ ID NO: 245290 - protein, 8 aa, Dengue virus
LAVMGDTA

SEQ ID NO: 245291 - protein, 8 aa, Dengue virus
AVMGDTAW

SEQ ID NO: 245292 - protein, 8 aa, Dengue virus
VMGDTAWD

SEQ ID NO: 245293 - protein, 8 aa, Dengue virus
TAWDFSSA

SEQ ID NO: 245294 - protein, 8 aa, Dengue virus
AWDFSSAG

SEQ ID NO: 245295 - protein, 8 aa, Dengue virus
WDFGSTGG

SEQ ID NO: 245296 - protein, 8 aa, Dengue virus
ELKCGDGI

SEQ ID NO: 245297 - protein, 8 aa, Dengue virus
LKCGDGIF

SEQ ID NO: 245298 - protein, 8 aa, Dengue virus
SDDWLNKY

SEQ ID NO: 245299 - protein, 8 aa, Dengue virus
DDWLNKYS

SEQ ID NO: 245300 - protein, 8 aa, Dengue virus
AVHTDQSL

SEQ ID NO: 245301 - protein, 8 aa, Dengue virus
VHTDQSLW

SEQ ID NO: 245302 - protein, 8 aa, Dengue virus
WPRSHTLW

SEQ ID NO: 245303 - protein, 8 aa, Dengue virus
PRSHTLWS

SEQ ID NO: 245304 - protein, 8 aa, Dengue virus
RSHTLWSN

SEQ ID NO: 245305 - protein, 8 aa, Dengue virus
THTLWGEG

SEQ ID NO: 245306 - protein, 8 aa, Dengue virus
EWCCRTCT

SEQ ID NO: 245307 - protein, 8 aa, Dengue virus
RTCTLPPV

SEQ ID NO: 245308 - protein, 8 aa, Dengue virus
TCTLPPVT

SEQ ID NO: 245309 - protein, 8 aa, Dengue virus
GSDGCWYP

SEQ ID NO: 245310 - protein, 8 aa, Dengue virus
SDGCWYPM

SEQ ID NO: 245311 - protein, 8 aa, Dengue virus
WHVTRGAA

SEQ ID NO: 245312 - protein, 8 aa, Dengue virus
HVTRGAAL

SEQ ID NO: 245313 - protein, 8 aa, Dengue virus
LYGNGILV

SEQ ID NO: 245314 - protein, 8 aa, Dengue virus
TTILDFHP

SEQ ID NO: 245315 - protein, 8 aa, Dengue virus
LDMHPGSG

SEQ ID NO: 245316 - protein, 8 aa, Dengue virus
RVVLSEMK

SEQ ID NO: 245317 - protein, 8 aa, Dengue virus
VVLSEMKE

SEQ ID NO: 245318 - protein, 8 aa, Dengue virus
VLSEMKEA

SEQ ID NO: 245319 - protein, 8 aa, Dengue virus
LSEMKEAF

SEQ ID NO: 245320 - protein, 8 aa, Dengue virus
GLDVKFHT

SEQ ID NO: 245321 - protein, 8 aa, Dengue virus
GREVIDAM

SEQ ID NO: 245322 - protein, 8 aa, Dengue virus
REVIDAMC

SEQ ID NO: 245323 - protein, 8 aa, Dengue virus
MCHATLTY

SEQ ID NO: 245324 - protein, 8 aa, Dengue virus
CHATLTYR

SEQ ID NO: 245325 - protein, 8 aa, Dengue virus
HATLTYRM

SEQ ID NO: 245326 - protein, 8 aa, Dengue virus
ATLTYRML

SEQ ID NO: 245327 - protein, 8 aa, Dengue virus
TLTYRMLE

SEQ ID NO: 245328 - protein, 8 aa, Dengue virus
LTYRMLEP

SEQ ID NO: 245329 - protein, 8 aa, Dengue virus
GRQNWEVA

SEQ ID NO: 245330 - protein, 8 aa, Dengue virus
AIMDEAHW

SEQ ID NO: 245331 - protein, 8 aa, Dengue virus
HFLDPASI

SEQ ID NO: 245332 - protein, 8 aa, Dengue virus
FLDPASIA

SEQ ID NO: 245333 - protein, 8 aa, Dengue virus
LDPASIAA

SEQ ID NO: 245334 - protein, 8 aa, Dengue virus
ASIAARGW

SEQ ID NO: 245335 - protein, 8 aa, Dengue virus
IAARGWAA

SEQ ID NO: 245336 - protein, 8 aa, Dengue virus
ARGWAAHR

SEQ ID NO: 245337 - protein, 8 aa, Dengue virus
GHLYTLAK

SEQ ID NO: 245338 - protein, 8 aa, Dengue virus
HRARANES

SEQ ID NO: 245339 - protein, 8 aa, Dengue virus
RARANESA

SEQ ID NO: 245340 - protein, 8 aa, Dengue virus
ANESATIL

SEQ ID NO: 245341 - protein, 8 aa, Dengue virus
AWFLPSIR

SEQ ID NO: 245342 - protein, 8 aa, Dengue virus
VVVLNRKT

SEQ ID NO: 245343 - protein, 8 aa, Dengue virus
VVLNRKTF

SEQ ID NO: 245344 - protein, 8 aa, Dengue virus
VLNRKTFE

SEQ ID NO: 245345 - protein, 8 aa, Dengue virus
VIDGRTNI

SEQ ID NO: 245346 - protein, 8 aa, Dengue virus
IDGRTNIK

SEQ ID NO: 245347 - protein, 8 aa, Dengue virus
DGRTNIKP

SEQ ID NO: 245348 - protein, 8 aa, Dengue virus
CRTAFKPV

SEQ ID NO: 245349 - protein, 8 aa, Dengue virus
TAFKPVLV

SEQ ID NO: 245350 - protein, 8 aa, Dengue virus
WKEAQILL

SEQ ID NO: 245351 - protein, 8 aa, Dengue virus
KEAQILLD

SEQ ID NO: 245352 - protein, 8 aa, Dengue virus
EASMLLDN

SEQ ID NO: 245353 - protein, 8 aa, Dengue virus
ASMLLDNM

SEQ ID NO: 245354 - protein, 8 aa, Dengue virus
PGEMRLRD

SEQ ID NO: 245355 - protein, 8 aa, Dengue virus
GEMRLRDD

SEQ ID NO: 245356 - protein, 8 aa, Dengue virus
LMKRGDLP

SEQ ID NO: 245357 - protein, 8 aa, Dengue virus
DLPVWLSW

SEQ ID NO: 245358 - protein, 8 aa, Dengue virus
SRNWTWEG

SEQ ID NO: 245359 - protein, 8 aa, Dengue virus
YASGRRSF

SEQ ID NO: 245360 - protein, 8 aa, Dengue virus
VVIPEPGQ

SEQ ID NO: 245361 - protein, 8 aa, Dengue virus
PEPGQQRS

SEQ ID NO: 245362 - protein, 8 aa, Dengue virus
EPGQQRSI

SEQ ID NO: 245363 - protein, 8 aa, Dengue virus
PGQQRSIQ

SEQ ID NO: 245364 - protein, 8 aa, Dengue virus
GQQRSIQD

SEQ ID NO: 245365 - protein, 8 aa, Dengue virus
SSDDNKLA

SEQ ID NO: 245366 - protein, 8 aa, Dengue virus
DLKPGAAW

SEQ ID NO: 245367 - protein, 8 aa, Dengue virus
AWTVYVGI

SEQ ID NO: 245368 - protein, 8 aa, Dengue virus
WTVYVGIV

SEQ ID NO: 245369 - protein, 8 aa, Dengue virus
TVYVGIVT

SEQ ID NO: 245370 - protein, 8 aa, Dengue virus
HWSLILPG

SEQ ID NO: 245371 - protein, 8 aa, Dengue virus
WSLILPGI

SEQ ID NO: 245372 - protein, 8 aa, Dengue virus
SLILPGIK

SEQ ID NO: 245373 - protein, 8 aa, Dengue virus
LILPGIKA

SEQ ID NO: 245374 - protein, 8 aa, Dengue virus
ILPGIKAQ

SEQ ID NO: 245375 - protein, 8 aa, Dengue virus
LPGIKAQQ

SEQ ID NO: 245376 - protein, 8 aa, Dengue virus
PGIKAQQS

SEQ ID NO: 245377 - protein, 8 aa, Dengue virus
GIKAQQSK

SEQ ID NO: 245378 - protein, 8 aa, Dengue virus
IKAQQSKL

SEQ ID NO: 245379 - protein, 8 aa, Dengue virus
KAQQSKLA

SEQ ID NO: 245380 - protein, 8 aa, Dengue virus
AQQSKLAQ

SEQ ID NO: 245381 - protein, 8 aa, Dengue virus
QQSKLAQR

SEQ ID NO: 245382 - protein, 8 aa, Dengue virus
QSKLAQRR

SEQ ID NO: 245383 - protein, 8 aa, Dengue virus
QRAHKVFF

SEQ ID NO: 245384 - protein, 8 aa, Dengue virus
RAHKVFFS

SEQ ID NO: 245385 - protein, 8 aa, Dengue virus
GVAKNPVV

SEQ ID NO: 245386 - protein, 8 aa, Dengue virus
VAKNPVVD

SEQ ID NO: 245387 - protein, 8 aa, Dengue virus
AKNPVVDG

SEQ ID NO: 245388 - protein, 8 aa, Dengue virus
DTLWTMPV

SEQ ID NO: 245389 - protein, 8 aa, Dengue virus
TLWTMPVA

SEQ ID NO: 245390 - protein, 8 aa, Dengue virus
TGVMRGNH

SEQ ID NO: 245391 - protein, 8 aa, Dengue virus
GVMRGNHY

SEQ ID NO: 245392 - protein, 8 aa, Dengue virus
VMRGNHYA

SEQ ID NO: 245393 - protein, 8 aa, Dengue virus
MRGNHYAF

SEQ ID NO: 245394 - protein, 8 aa, Dengue virus
RGNHYAFV

SEQ ID NO: 245395 - protein, 8 aa, Dengue virus
GNHYAFVG

SEQ ID NO: 245396 - protein, 8 aa, Dengue virus
NHYAFVGV

SEQ ID NO: 245397 - protein, 8 aa, Dengue virus
GKTLGEVW

SEQ ID NO: 245398 - protein, 8 aa, Dengue virus
KTLGEVWK

SEQ ID NO: 245399 - protein, 8 aa, Dengue virus
PVSRGSAK

SEQ ID NO: 245400 - protein, 8 aa, Dengue virus
SRGTAKLA

SEQ ID NO: 245401 - protein, 8 aa, Dengue virus
RGTAKLAW

SEQ ID NO: 245402 - protein, 8 aa, Dengue virus
AKLAWLEE

SEQ ID NO: 245403 - protein, 8 aa, Dengue virus
KVMDLGCG

SEQ ID NO: 245404 - protein, 8 aa, Dengue virus
RGGWCYYA

SEQ ID NO: 245405 - protein, 8 aa, Dengue virus
SVKAYTIG

SEQ ID NO: 245406 - protein, 8 aa, Dengue virus
VKAYTIGG

SEQ ID NO: 245407 - protein, 8 aa, Dengue virus
GFTLGRDG

SEQ ID NO: 245408 - protein, 8 aa, Dengue virus
FTLGRDGH

SEQ ID NO: 245409 - protein, 8 aa, Dengue virus
SDTLLCDI

SEQ ID NO: 245410 - protein, 8 aa, Dengue virus
DIGESNPD

SEQ ID NO: 245411 - protein, 8 aa, Dengue virus
VIRNPLSR

SEQ ID NO: 245412 - protein, 8 aa, Dengue virus
IRNPLSRN

SEQ ID NO: 245413 - protein, 8 aa, Dengue virus
STHEMYYV

SEQ ID NO: 245414 - protein, 8 aa, Dengue virus
THEMYYVS

SEQ ID NO: 245415 - protein, 8 aa, Dengue virus
PYRTWQYW

SEQ ID NO: 245416 - protein, 8 aa, Dengue virus
YRTWQYWG

SEQ ID NO: 245417 - protein, 8 aa, Dengue virus
RTWQYWGS

SEQ ID NO: 245418 - protein, 8 aa, Dengue virus
WHYCGSYV

SEQ ID NO: 245419 - protein, 8 aa, Dengue virus
GSAASMVN

SEQ ID NO: 245420 - protein, 8 aa, Dengue virus
SAASMVNG

SEQ ID NO: 245421 - protein, 8 aa, Dengue virus
AASMVNGV

SEQ ID NO: 245422 - protein, 8 aa, Dengue virus
ASMVNGVI

SEQ ID NO: 245423 - protein, 8 aa, Dengue virus
VNGVIKIL

SEQ ID NO: 245424 - protein, 8 aa, Dengue virus
NGVVKLLS

SEQ ID NO: 245425 - protein, 8 aa, Dengue virus
GVVKLLSW

SEQ ID NO: 245426 - protein, 8 aa, Dengue virus
VVKLLSWP

SEQ ID NO: 245427 - protein, 8 aa, Dengue virus
VKLLSWPW

SEQ ID NO: 245428 - protein, 8 aa, Dengue virus
KLLSWPWN

SEQ ID NO: 245429 - protein, 8 aa, Dengue virus
ILTYPWDR

SEQ ID NO: 245430 - protein, 8 aa, Dengue virus
RMAMTDTT

SEQ ID NO: 245431 - protein, 8 aa, Dengue virus
EKVDTKAQ

SEQ ID NO: 245432 - protein, 8 aa, Dengue virus
KKLSEFGK

SEQ ID NO: 245433 - protein, 8 aa, Dengue virus
KLSEFGKA

SEQ ID NO: 245434 - protein, 8 aa, Dengue virus
LSEFGKAK

SEQ ID NO: 245435 - protein, 8 aa, Dengue virus
YMWLGSRF

SEQ ID NO: 245436 - protein, 8 aa, Dengue virus
NEDHWASR

SEQ ID NO: 245437 - protein, 8 aa, Dengue virus
SGVEGISL

SEQ ID NO: 245438 - protein, 8 aa, Dengue virus
GVEGIGLQ

SEQ ID NO: 245439 - protein, 8 aa, Dengue virus
TYKNKVVK

SEQ ID NO: 245440 - protein, 8 aa, Dengue virus
YKNKVVKV

SEQ ID NO: 245441 - protein, 8 aa, Dengue virus
AKVVKVAR

SEQ ID NO: 245442 - protein, 8 aa, Dengue virus
KVVKVARP

SEQ ID NO: 245443 - protein, 8 aa, Dengue virus
AYMDVISR

SEQ ID NO: 245444 - protein, 8 aa, Dengue virus
MDVITRRD

SEQ ID NO: 245445 - protein, 8 aa, Dengue virus
DVITRRDQ

SEQ ID NO: 245446 - protein, 8 aa, Dengue virus
VITRRDQR

SEQ ID NO: 245447 - protein, 8 aa, Dengue virus
MGKVRKDV

SEQ ID NO: 245448 - protein, 8 aa, Dengue virus
NWEEVPFC

SEQ ID NO: 245449 - protein, 8 aa, Dengue virus
WENVPFCS

SEQ ID NO: 245450 - protein, 8 aa, Dengue virus
FCSNHFQE

SEQ ID NO: 245451 - protein, 8 aa, Dengue virus
CSNHFQEI

SEQ ID NO: 245452 - protein, 8 aa, Dengue virus
VPCREQDE

SEQ ID NO: 245453 - protein, 8 aa, Dengue virus
PCREQDEL

SEQ ID NO: 245454 - protein, 8 aa, Dengue virus
RARVSPGC

SEQ ID NO: 245455 - protein, 8 aa, Dengue virus
ARVSPGCG

SEQ ID NO: 245456 - protein, 8 aa, Dengue virus
RVSPGCGW

SEQ ID NO: 245457 - protein, 8 aa, Dengue virus
VSPGCGWS

SEQ ID NO: 245458 - protein, 8 aa, Dengue virus
ETACLSKA

SEQ ID NO: 245459 - protein, 8 aa, Dengue virus
TACLSKAY

SEQ ID NO: 245460 - protein, 8 aa, Dengue virus
ACLSKAYG

SEQ ID NO: 245461 - protein, 8 aa, Dengue virus
CLSKAYGQ

SEQ ID NO: 245462 - protein, 8 aa, Dengue virus
LSKAYGQM

SEQ ID NO: 245463 - protein, 8 aa, Dengue virus
KRDMRLLS

SEQ ID NO: 245464 - protein, 8 aa, Dengue virus
GLAICSAV

SEQ ID NO: 245465 - protein, 8 aa, Dengue virus
VWNRVWIT

SEQ ID NO: 245466 - protein, 8 aa, Dengue virus
PYLPKSHD

SEQ ID NO: 245467 - protein, 8 aa, Dengue virus
PKSHDMLC

SEQ ID NO: 245468 - protein, 8 aa, Dengue virus
KSHDMLCS

SEQ ID NO: 245469 - protein, 8 aa, Dengue virus
SHDMLCSS

SEQ ID NO: 245470 - protein, 8 aa, Dengue virus
HDMLCSSL

SEQ ID NO: 245471 - protein, 8 aa, Dengue virus
DKLCGSLI

SEQ ID NO: 245472 - protein, 8 aa, Dengue virus
KLCGSLIG

SEQ ID NO: 245473 - protein, 8 aa, Dengue virus
CGSLIGMT

SEQ ID NO: 245474 - protein, 9 aa, West Nile virus
SQLAKRFSK

SEQ ID NO: 245475 - protein, 9 aa, West Nile virus
QLAKRFSKG

SEQ ID NO: 245476 - protein, 9 aa, West Nile virus
LAKRFSKGL

SEQ ID NO: 245477 - protein, 9 aa, West Nile virus
AKRFSKGLL

SEQ ID NO: 245478 - protein, 9 aa, West Nile virus
EPEDIDCWC

SEQ ID NO: 245479 - protein, 9 aa, West Nile virus
VLEHGSCVT

SEQ ID NO: 245480 - protein, 9 aa, West Nile virus
VDRGWGNGC

SEQ ID NO: 245481 - protein, 9 aa, West Nile virus
DRGWGNGCG

SEQ ID NO: 245482 - protein, 9 aa, West Nile virus
RGWGNGCGL

SEQ ID NO: 245483 - protein, 9 aa, West Nile virus
GWGNGCGLF

SEQ ID NO: 245484 - protein, 9 aa, West Nile virus
WGNGCGLFG

SEQ ID NO: 245485 - protein, 9 aa, West Nile virus
GNGCGLFGK

SEQ ID NO: 245486 - protein, 9 aa, West Nile virus
NGCGLFGKG

SEQ ID NO: 245487 - protein, 9 aa, West Nile virus
GCGLFGKGS

SEQ ID NO: 245488 - protein, 9 aa, West Nile virus
CGLFGKGSL

SEQ ID NO: 245489 - protein, 9 aa, West Nile virus
TGDQHQVGN

SEQ ID NO: 245490 - protein, 9 aa, West Nile virus
VLGSQEGAM

SEQ ID NO: 245491 - protein, 9 aa, West Nile virus
LGSQEGAMH

SEQ ID NO: 245492 - protein, 9 aa, West Nile virus
EPPFGESYI

SEQ ID NO: 245493 - protein, 9 aa, West Nile virus
GARRMAILG

SEQ ID NO: 245494 - protein, 9 aa, West Nile virus
RMAILGDTA

SEQ ID NO: 245495 - protein, 9 aa, West Nile virus
MAILGDTAW

SEQ ID NO: 245496 - protein, 9 aa, West Nile virus
AILGDTAWD

SEQ ID NO: 245497 - protein, 9 aa, West Nile virus
ILGDTAWDF

SEQ ID NO: 245498 - protein, 9 aa, West Nile virus
LGDTAWDFG

SEQ ID NO: 245499 - protein, 9 aa, West Nile virus
GDTAWDFGS

SEQ ID NO: 245500 - protein, 9 aa, West Nile virus
TAWDFGSIG

SEQ ID NO: 245501 - protein, 9 aa, West Nile virus
AWDFGSIGG

SEQ ID NO: 245502 - protein, 9 aa, West Nile virus
ELKCGSGIF

SEQ ID NO: 245503 - protein, 9 aa, West Nile virus
VHTWTEQYK

SEQ ID NO: 245504 - protein, 9 aa, West Nile virus
AVHADMGYW

SEQ ID NO: 245505 - protein, 9 aa, West Nile virus
VHADMGYWI

SEQ ID NO: 245506 - protein, 9 aa, West Nile virus
HADMGYWIE

SEQ ID NO: 245507 - protein, 9 aa, West Nile virus
ADMGYWIES

SEQ ID NO: 245508 - protein, 9 aa, West Nile virus
WPKSHTLWS

SEQ ID NO: 245509 - protein, 9 aa, West Nile virus
PKSHTLWSN

SEQ ID NO: 245510 - protein, 9 aa, West Nile virus
WCCRSCTLP

SEQ ID NO: 245511 - protein, 9 aa, West Nile virus
CCRSCTLPP

SEQ ID NO: 245512 - protein, 9 aa, West Nile virus
CRSCTLPPL

SEQ ID NO: 245513 - protein, 9 aa, West Nile virus
RSCTLPPLR

SEQ ID NO: 245514 - protein, 9 aa, West Nile virus
GEDGCWYGM

SEQ ID NO: 245515 - protein, 9 aa, West Nile virus
EDGCWYGME

SEQ ID NO: 245516 - protein, 9 aa, West Nile virus
DGCWYGMEI

SEQ ID NO: 245517 - protein, 9 aa, West Nile virus
GCWYGMEIR

SEQ ID NO: 245518 - protein, 9 aa, West Nile virus
CWYGMEIRP

SEQ ID NO: 245519 - protein, 9 aa, West Nile virus
VFHTMWHVT

SEQ ID NO: 245520 - protein, 9 aa, West Nile virus
FHTMWHVTR

SEQ ID NO: 245521 - protein, 9 aa, West Nile virus
HTMWHVTRG

SEQ ID NO: 245522 - protein, 9 aa, West Nile virus
TMWHVTRGA

SEQ ID NO: 245523 - protein, 9 aa, West Nile virus
MWHVTRGAV

SEQ ID NO: 245524 - protein, 9 aa, West Nile virus
WHVTRGAVL

SEQ ID NO: 245525 - protein, 9 aa, West Nile virus
GLYGNGVVT

SEQ ID NO: 245526 - protein, 9 aa, West Nile virus
LTIMDLHPG

SEQ ID NO: 245527 - protein, 9 aa, West Nile virus
MDLHPGSGK

SEQ ID NO: 245528 - protein, 9 aa, West Nile virus
DLHPGSGKT

SEQ ID NO: 245529 - protein, 9 aa, West Nile virus
LHPGSGKTR

SEQ ID NO: 245530 - protein, 9 aa, West Nile virus
LRTLILAPT

SEQ ID NO: 245531 - protein, 9 aa, West Nile virus
RTLILAPTR

SEQ ID NO: 245532 - protein, 9 aa, West Nile virus
TLILAPTRV

SEQ ID NO: 245533 - protein, 9 aa, West Nile virus
LILAPTRVV

SEQ ID NO: 245534 - protein, 9 aa, West Nile virus
ILAPTRVVA

SEQ ID NO: 245535 - protein, 9 aa, West Nile virus
LAPTRVVAA

SEQ ID NO: 245536 - protein, 9 aa, West Nile virus
APTRVVAAE

SEQ ID NO: 245537 - protein, 9 aa, West Nile virus
PTRVVAAEM

SEQ ID NO: 245538 - protein, 9 aa, West Nile virus
TRVVAAEME

SEQ ID NO: 245539 - protein, 9 aa, West Nile virus
RVVAAEMEE

SEQ ID NO: 245540 - protein, 9 aa, West Nile virus
VVAAEMEEA

SEQ ID NO: 245541 - protein, 9 aa, West Nile virus
VAAEMEEAL

SEQ ID NO: 245542 - protein, 9 aa, West Nile virus
GREIVDLMC

SEQ ID NO: 245543 - protein, 9 aa, West Nile virus
REIVDLMCH

SEQ ID NO: 245544 - protein, 9 aa, West Nile virus
EIVDLMCHA

SEQ ID NO: 245545 - protein, 9 aa, West Nile virus
IVDLMCHAT

SEQ ID NO: 245546 - protein, 9 aa, West Nile virus
VDLMCHATF

SEQ ID NO: 245547 - protein, 9 aa, West Nile virus
DLMCHATFT

SEQ ID NO: 245548 - protein, 9 aa, West Nile virus
LMCHATFTM

SEQ ID NO: 245549 - protein, 9 aa, West Nile virus
MCHATFTMR

SEQ ID NO: 245550 - protein, 9 aa, West Nile virus
CHATFTMRL

SEQ ID NO: 245551 - protein, 9 aa, West Nile virus
HATFTMRLL

SEQ ID NO: 245552 - protein, 9 aa, West Nile virus
ATFTMRLLS

SEQ ID NO: 245553 - protein, 9 aa, West Nile virus
TFTMRLLSP

SEQ ID NO: 245554 - protein, 9 aa, West Nile virus
IMDEAHFTD

SEQ ID NO: 245555 - protein, 9 aa, West Nile virus
MDEAHFTDP

SEQ ID NO: 245556 - protein, 9 aa, West Nile virus
DEAHFTDPA

SEQ ID NO: 245557 - protein, 9 aa, West Nile virus
EAHFTDPAS

SEQ ID NO: 245558 - protein, 9 aa, West Nile virus
AHFTDPASI

SEQ ID NO: 245559 - protein, 9 aa, West Nile virus
HFTDPASIA

SEQ ID NO: 245560 - protein, 9 aa, West Nile virus
FTDPASIAA

SEQ ID NO: 245561 - protein, 9 aa, West Nile virus
TDPASIAAR

SEQ ID NO: 245562 - protein, 9 aa, West Nile virus
DPASIAARG

SEQ ID NO: 245563 - protein, 9 aa, West Nile virus
PASIAARGY

SEQ ID NO: 245564 - protein, 9 aa, West Nile virus
ASIAARGYI

SEQ ID NO: 245565 - protein, 9 aa, West Nile virus
SIAARGYIS

SEQ ID NO: 245566 - protein, 9 aa, West Nile virus
IAARGYIST

SEQ ID NO: 245567 - protein, 9 aa, West Nile virus
AARGYISTR

SEQ ID NO: 245568 - protein, 9 aa, West Nile virus
ARGYISTRV

SEQ ID NO: 245569 - protein, 9 aa, West Nile virus
RGYISTRVG

SEQ ID NO: 245570 - protein, 9 aa, West Nile virus
TRVGMGEAA

SEQ ID NO: 245571 - protein, 9 aa, West Nile virus
MGEAAAIFM

SEQ ID NO: 245572 - protein, 9 aa, West Nile virus
GEAAAIFMT

SEQ ID NO: 245573 - protein, 9 aa, West Nile virus
EAAAIFMTA

SEQ ID NO: 245574 - protein, 9 aa, West Nile virus
AAAIFMTAT

SEQ ID NO: 245575 - protein, 9 aa, West Nile virus
AAIFMTATP

SEQ ID NO: 245576 - protein, 9 aa, West Nile virus
AIFMTATPP

SEQ ID NO: 245577 - protein, 9 aa, West Nile virus
IFMTATPPG

SEQ ID NO: 245578 - protein, 9 aa, West Nile virus
FMTATPPGS

SEQ ID NO: 245579 - protein, 9 aa, West Nile virus
GKTVWFVPS

SEQ ID NO: 245580 - protein, 9 aa, West Nile virus
KTVWFVPSI

SEQ ID NO: 245581 - protein, 9 aa, West Nile virus
TVWFVPSIK

SEQ ID NO: 245582 - protein, 9 aa, West Nile virus
VIQLSRKTF

SEQ ID NO: 245583 - protein, 9 aa, West Nile virus
DWDFVVTTD

SEQ ID NO: 245584 - protein, 9 aa, West Nile virus
WDFVVTTDI

SEQ ID NO: 245585 - protein, 9 aa, West Nile virus
DFVVTTDIS

SEQ ID NO: 245586 - protein, 9 aa, West Nile virus
FVVTTDISE

SEQ ID NO: 245587 - protein, 9 aa, West Nile virus
VVTTDISEM

SEQ ID NO: 245588 - protein, 9 aa, West Nile virus
VTTDISEMG

SEQ ID NO: 245589 - protein, 9 aa, West Nile virus
TTDISEMGA

SEQ ID NO: 245590 - protein, 9 aa, West Nile virus
TDISEMGAN

SEQ ID NO: 245591 - protein, 9 aa, West Nile virus
DISEMGANF

SEQ ID NO: 245592 - protein, 9 aa, West Nile virus
ISEMGANFK

SEQ ID NO: 245593 - protein, 9 aa, West Nile virus
SEMGANFKA

SEQ ID NO: 245594 - protein, 9 aa, West Nile virus
RVIDPRRCL

SEQ ID NO: 245595 - protein, 9 aa, West Nile virus
VIDPRRCLK

SEQ ID NO: 245596 - protein, 9 aa, West Nile virus
IDPRRCLKP

SEQ ID NO: 245597 - protein, 9 aa, West Nile virus
DPRRCLKPV

SEQ ID NO: 245598 - protein, 9 aa, West Nile virus
PRRCLKPVI

SEQ ID NO: 245599 - protein, 9 aa, West Nile virus
RRCLKPVIL

SEQ ID NO: 245600 - protein, 9 aa, West Nile virus
ASAAQRRGR

SEQ ID NO: 245601 - protein, 9 aa, West Nile virus
SAAQRRGRI

SEQ ID NO: 245602 - protein, 9 aa, West Nile virus
AAQRRGRIG

SEQ ID NO: 245603 - protein, 9 aa, West Nile virus
AQRRGRIGR

SEQ ID NO: 245604 - protein, 9 aa, West Nile virus
QRRGRIGRN

SEQ ID NO: 245605 - protein, 9 aa, West Nile virus
WTEAKMLLD

SEQ ID NO: 245606 - protein, 9 aa, West Nile virus
EAKMLLDNI

SEQ ID NO: 245607 - protein, 9 aa, West Nile virus
DGEYRLRGE

SEQ ID NO: 245608 - protein, 9 aa, West Nile virus
LMRRGDLPV

SEQ ID NO: 245609 - protein, 9 aa, West Nile virus
MRRGDLPVW

SEQ ID NO: 245610 - protein, 9 aa, West Nile virus
RRGDLPVWL

SEQ ID NO: 245611 - protein, 9 aa, West Nile virus
RGDLPVWLA

SEQ ID NO: 245612 - protein, 9 aa, West Nile virus
LLIPEPEKQ

SEQ ID NO: 245613 - protein, 9 aa, West Nile virus
LIPEPEKQR

SEQ ID NO: 245614 - protein, 9 aa, West Nile virus
IPEPEKQRT

SEQ ID NO: 245615 - protein, 9 aa, West Nile virus
PEPEKQRTP

SEQ ID NO: 245616 - protein, 9 aa, West Nile virus
EPEKQRTPQ

SEQ ID NO: 245617 - protein, 9 aa, West Nile virus
PEKQRTPQD

SEQ ID NO: 245618 - protein, 9 aa, West Nile virus
EKQRTPQDN

SEQ ID NO: 245619 - protein, 9 aa, West Nile virus
KQRTPQDNQ

SEQ ID NO: 245620 - protein, 9 aa, West Nile virus
QRTPQDNQL

SEQ ID NO: 245621 - protein, 9 aa, West Nile virus
RTPQDNQLA

SEQ ID NO: 245622 - protein, 9 aa, West Nile virus
PASAWTLYA

SEQ ID NO: 245623 - protein, 9 aa, West Nile virus
ASAWTLYAV

SEQ ID NO: 245624 - protein, 9 aa, West Nile virus
SAWTLYAVA

SEQ ID NO: 245625 - protein, 9 aa, West Nile virus
AWTLYAVAT

SEQ ID NO: 245626 - protein, 9 aa, West Nile virus
WTLYAVATT

SEQ ID NO: 245627 - protein, 9 aa, West Nile virus
HYAIIGPGL

SEQ ID NO: 245628 - protein, 9 aa, West Nile virus
YAIIGPGLQ

SEQ ID NO: 245629 - protein, 9 aa, West Nile virus
AIIGPGLQA

SEQ ID NO: 245630 - protein, 9 aa, West Nile virus
IIGPGLQAK

SEQ ID NO: 245631 - protein, 9 aa, West Nile virus
IGPGLQAKA

SEQ ID NO: 245632 - protein, 9 aa, West Nile virus
GPGLQAKAT

SEQ ID NO: 245633 - protein, 9 aa, West Nile virus
PGLQAKATR

SEQ ID NO: 245634 - protein, 9 aa, West Nile virus
GLQAKATRE

SEQ ID NO: 245635 - protein, 9 aa, West Nile virus
LQAKATREA

SEQ ID NO: 245636 - protein, 9 aa, West Nile virus
QAKATREAQ

SEQ ID NO: 245637 - protein, 9 aa, West Nile virus
AKATREAQK

SEQ ID NO: 245638 - protein, 9 aa, West Nile virus
KATREAQKR

SEQ ID NO: 245639 - protein, 9 aa, West Nile virus
REAQKRTAA

SEQ ID NO: 245640 - protein, 9 aa, West Nile virus
EAQKRTAAG

SEQ ID NO: 245641 - protein, 9 aa, West Nile virus
AQKRTAAGI

SEQ ID NO: 245642 - protein, 9 aa, West Nile virus
QKRTAAGIM

SEQ ID NO: 245643 - protein, 9 aa, West Nile virus
KRTAAGIMK

SEQ ID NO: 245644 - protein, 9 aa, West Nile virus
RTAAGIMKN

SEQ ID NO: 245645 - protein, 9 aa, West Nile virus
TAAGIMKNP

SEQ ID NO: 245646 - protein, 9 aa, West Nile virus
AAGIMKNPT

SEQ ID NO: 245647 - protein, 9 aa, West Nile virus
AGIMKNPTV

SEQ ID NO: 245648 - protein, 9 aa, West Nile virus
GIMKNPTVD

SEQ ID NO: 245649 - protein, 9 aa, West Nile virus
IMKNPTVDG

SEQ ID NO: 245650 - protein, 9 aa, West Nile virus
FEKQLGQVM

SEQ ID NO: 245651 - protein, 9 aa, West Nile virus
GKFWNTTIA

SEQ ID NO: 245652 - protein, 9 aa, West Nile virus
KFWNTTIAV

SEQ ID NO: 245653 - protein, 9 aa, West Nile virus
FWNTTIAVS

SEQ ID NO: 245654 - protein, 9 aa, West Nile virus
ANIFRGSYL

SEQ ID NO: 245655 - protein, 9 aa, West Nile virus
NIFRGSYLA

SEQ ID NO: 245656 - protein, 9 aa, West Nile virus
IFRGSYLAG

SEQ ID NO: 245657 - protein, 9 aa, West Nile virus
FRGSYLAGA

SEQ ID NO: 245658 - protein, 9 aa, West Nile virus
RGSYLAGAG

SEQ ID NO: 245659 - protein, 9 aa, West Nile virus
GSYLAGAGL

SEQ ID NO: 245660 - protein, 9 aa, West Nile virus
GETLGEKWK

SEQ ID NO: 245661 - protein, 9 aa, West Nile virus
AVSRGSAKL

SEQ ID NO: 245662 - protein, 9 aa, West Nile virus
VSRGTAKLR

SEQ ID NO: 245663 - protein, 9 aa, West Nile virus
SRGTAKLRW

SEQ ID NO: 245664 - protein, 9 aa, West Nile virus
GKVIDLGCG

SEQ ID NO: 245665 - protein, 9 aa, West Nile virus
KVIDLGCGR

SEQ ID NO: 245666 - protein, 9 aa, West Nile virus
VIDLGCGRG

SEQ ID NO: 245667 - protein, 9 aa, West Nile virus
IDLGCGRGG

SEQ ID NO: 245668 - protein, 9 aa, West Nile virus
DLGCGRGGW

SEQ ID NO: 245669 - protein, 9 aa, West Nile virus
LGCGRGGWS

SEQ ID NO: 245670 - protein, 9 aa, West Nile virus
GCGRGGWSY

SEQ ID NO: 245671 - protein, 9 aa, West Nile virus
CGRGGWSYY

SEQ ID NO: 245672 - protein, 9 aa, West Nile virus
GRGGWSYYC

SEQ ID NO: 245673 - protein, 9 aa, West Nile virus
EVKGYTKGG

SEQ ID NO: 245674 - protein, 9 aa, West Nile virus
GYTKGGPGH

SEQ ID NO: 245675 - protein, 9 aa, West Nile virus
TKGGPGHEE

SEQ ID NO: 245676 - protein, 9 aa, West Nile virus
KGGPGHEEP

SEQ ID NO: 245677 - protein, 9 aa, West Nile virus
CDTLLCDIG

SEQ ID NO: 245678 - protein, 9 aa, West Nile virus
DTLLCDIGE

SEQ ID NO: 245679 - protein, 9 aa, West Nile virus
TLLCDIGES

SEQ ID NO: 245680 - protein, 9 aa, West Nile virus
LLCDIGESS

SEQ ID NO: 245681 - protein, 9 aa, West Nile virus
LCDIGESSP

SEQ ID NO: 245682 - protein, 9 aa, West Nile virus
CDIGESSPN

SEQ ID NO: 245683 - protein, 9 aa, West Nile virus
LVRNPLSRN

SEQ ID NO: 245684 - protein, 9 aa, West Nile virus
VRNPLSRNS

SEQ ID NO: 245685 - protein, 9 aa, West Nile virus
RNPLSRNST

SEQ ID NO: 245686 - protein, 9 aa, West Nile virus
NPLSRNSTH

SEQ ID NO: 245687 - protein, 9 aa, West Nile virus
PLSRNSTHE

SEQ ID NO: 245688 - protein, 9 aa, West Nile virus
LSRNSTHEM

SEQ ID NO: 245689 - protein, 9 aa, West Nile virus
SRNSTHEMY

SEQ ID NO: 245690 - protein, 9 aa, West Nile virus
RNSTHEMYW

SEQ ID NO: 245691 - protein, 9 aa, West Nile virus
NSTHEMYWV

SEQ ID NO: 245692 - protein, 9 aa, West Nile virus
STHEMYWVS

SEQ ID NO: 245693 - protein, 9 aa, West Nile virus
PYKTWAYHG

SEQ ID NO: 245694 - protein, 9 aa, West Nile virus
YKTWAYHGS

SEQ ID NO: 245695 - protein, 9 aa, West Nile virus
KTWAYHGSY

SEQ ID NO: 245696 - protein, 9 aa, West Nile virus
TWAYHGSYE

SEQ ID NO: 245697 - protein, 9 aa, West Nile virus
GSASSMVNG

SEQ ID NO: 245698 - protein, 9 aa, West Nile virus
SASSMVNGV

SEQ ID NO: 245699 - protein, 9 aa, West Nile virus
ASSMVNGVV

SEQ ID NO: 245700 - protein, 9 aa, West Nile virus
NGVVKLLTK

SEQ ID NO: 245701 - protein, 9 aa, West Nile virus
GVVKLLTKP

SEQ ID NO: 245702 - protein, 9 aa, West Nile virus
VVKLLTKPW

SEQ ID NO: 245703 - protein, 9 aa, West Nile virus
VKLLTKPWD

SEQ ID NO: 245704 - protein, 9 aa, West Nile virus
MAMTDTTPF

SEQ ID NO: 245705 - protein, 9 aa, West Nile virus
AMTDTTPFG

SEQ ID NO: 245706 - protein, 9 aa, West Nile virus
MTDTTPFGQ

SEQ ID NO: 245707 - protein, 9 aa, West Nile virus
TDTTPFGQQ

SEQ ID NO: 245708 - protein, 9 aa, West Nile virus
DTTPFGQQR

SEQ ID NO: 245709 - protein, 9 aa, West Nile virus
TTPFGQQRV

SEQ ID NO: 245710 - protein, 9 aa, West Nile virus
TPFGQQRVF

SEQ ID NO: 245711 - protein, 9 aa, West Nile virus
PFGQQRVFK

SEQ ID NO: 245712 - protein, 9 aa, West Nile virus
FGQQRVFKE

SEQ ID NO: 245713 - protein, 9 aa, West Nile virus
GQQRVFKEK

SEQ ID NO: 245714 - protein, 9 aa, West Nile virus
QQRVFKEKV

SEQ ID NO: 245715 - protein, 9 aa, West Nile virus
QRVFKEKVD

SEQ ID NO: 245716 - protein, 9 aa, West Nile virus
RVFKEKVDT

SEQ ID NO: 245717 - protein, 9 aa, West Nile virus
VFKEKVDTR

SEQ ID NO: 245718 - protein, 9 aa, West Nile virus
FKEKVDTRT

SEQ ID NO: 245719 - protein, 9 aa, West Nile virus
KEKVDTRTP

SEQ ID NO: 245720 - protein, 9 aa, West Nile virus
TCVYNMMGK

SEQ ID NO: 245721 - protein, 9 aa, West Nile virus
CVYNMMGKR

SEQ ID NO: 245722 - protein, 9 aa, West Nile virus
VYNMMGKRE

SEQ ID NO: 245723 - protein, 9 aa, West Nile virus
YNMMGKREK

SEQ ID NO: 245724 - protein, 9 aa, West Nile virus
NMMGKREKK

SEQ ID NO: 245725 - protein, 9 aa, West Nile virus
MMGKREKKL

SEQ ID NO: 245726 - protein, 9 aa, West Nile virus
MGKREKKLG

SEQ ID NO: 245727 - protein, 9 aa, West Nile virus
GKREKKLGE

SEQ ID NO: 245728 - protein, 9 aa, West Nile virus
KREKKLGEF

SEQ ID NO: 245729 - protein, 9 aa, West Nile virus
REKKLGEFG

SEQ ID NO: 245730 - protein, 9 aa, West Nile virus
EKKLGEFGK

SEQ ID NO: 245731 - protein, 9 aa, West Nile virus
KKLGEFGKA

SEQ ID NO: 245732 - protein, 9 aa, West Nile virus
KLGEFGKAK

SEQ ID NO: 245733 - protein, 9 aa, West Nile virus
LGEFGKAKG

SEQ ID NO: 245734 - protein, 9 aa, West Nile virus
GEFGKAKGS

SEQ ID NO: 245735 - protein, 9 aa, West Nile virus
EFGKAKGSR

SEQ ID NO: 245736 - protein, 9 aa, West Nile virus
FGKAKGSRA

SEQ ID NO: 245737 - protein, 9 aa, West Nile virus
GKAKGSRAI

SEQ ID NO: 245738 - protein, 9 aa, West Nile virus
KAKGSRAIW

SEQ ID NO: 245739 - protein, 9 aa, West Nile virus
AKGSRAIWY

SEQ ID NO: 245740 - protein, 9 aa, West Nile virus
KGSRAIWYM

SEQ ID NO: 245741 - protein, 9 aa, West Nile virus
GSRAIWYMW

SEQ ID NO: 245742 - protein, 9 aa, West Nile virus
SRAIWYMWL

SEQ ID NO: 245743 - protein, 9 aa, West Nile virus
RAIWYMWLG

SEQ ID NO: 245744 - protein, 9 aa, West Nile virus
AIWYMWLGA

SEQ ID NO: 245745 - protein, 9 aa, West Nile virus
IWYMWLGAR

SEQ ID NO: 245746 - protein, 9 aa, West Nile virus
WYMWLGARF

SEQ ID NO: 245747 - protein, 9 aa, West Nile virus
YMWLGARFL

SEQ ID NO: 245748 - protein, 9 aa, West Nile virus
MWLGARFLE

SEQ ID NO: 245749 - protein, 9 aa, West Nile virus
WLGARFLEF

SEQ ID NO: 245750 - protein, 9 aa, West Nile virus
LGARFLEFE

SEQ ID NO: 245751 - protein, 9 aa, West Nile virus
GARFLEFEA

SEQ ID NO: 245752 - protein, 9 aa, West Nile virus
ARFLEFEAL

SEQ ID NO: 245753 - protein, 9 aa, West Nile virus
RFLEFEALG

SEQ ID NO: 245754 - protein, 9 aa, West Nile virus
FLEFEALGF

SEQ ID NO: 245755 - protein, 9 aa, West Nile virus
LEFEALGFL

SEQ ID NO: 245756 - protein, 9 aa, West Nile virus
EFEALGFLN

SEQ ID NO: 245757 - protein, 9 aa, West Nile virus
FEALGFLNE

SEQ ID NO: 245758 - protein, 9 aa, West Nile virus
EALGFLNED

SEQ ID NO: 245759 - protein, 9 aa, West Nile virus
ALGFLNEDH

SEQ ID NO: 245760 - protein, 9 aa, West Nile virus
LGFLNEDHW

SEQ ID NO: 245761 - protein, 9 aa, West Nile virus
GFLNEDHWF

SEQ ID NO: 245762 - protein, 9 aa, West Nile virus
MYADDTAGW

SEQ ID NO: 245763 - protein, 9 aa, West Nile virus
YADDTAGWD

SEQ ID NO: 245764 - protein, 9 aa, West Nile virus
ADDTAGWDT

SEQ ID NO: 245765 - protein, 9 aa, West Nile virus
DDTAGWDTR

SEQ ID NO: 245766 - protein, 9 aa, West Nile virus
DTAGWDTRI

SEQ ID NO: 245767 - protein, 9 aa, West Nile virus
TAGWDTRIT

SEQ ID NO: 245768 - protein, 9 aa, West Nile virus
IFKLTYQNK

SEQ ID NO: 245769 - protein, 9 aa, West Nile virus
FKLTYQNKV

SEQ ID NO: 245770 - protein, 9 aa, West Nile virus
KLTYQNKVV

SEQ ID NO: 245771 - protein, 9 aa, West Nile virus
LTYQNKVVR

SEQ ID NO: 245772 - protein, 9 aa, West Nile virus
TYQNKVVRV

SEQ ID NO: 245773 - protein, 9 aa, West Nile virus
NKVVRVQRP

SEQ ID NO: 245774 - protein, 9 aa, West Nile virus
MDVISRRDQ

SEQ ID NO: 245775 - protein, 9 aa, West Nile virus
DVISRRDQR

SEQ ID NO: 245776 - protein, 9 aa, West Nile virus
VISRRDQRG

SEQ ID NO: 245777 - protein, 9 aa, West Nile virus
ISRRDQRGS

SEQ ID NO: 245778 - protein, 9 aa, West Nile virus
SRRDQRGSG

SEQ ID NO: 245779 - protein, 9 aa, West Nile virus
RRDQRGSGQ

SEQ ID NO: 245780 - protein, 9 aa, West Nile virus
RDQRGSGQV

SEQ ID NO: 245781 - protein, 9 aa, West Nile virus
DQRGSGQVG

SEQ ID NO: 245782 - protein, 9 aa, West Nile virus
QRGSGQVGT

SEQ ID NO: 245783 - protein, 9 aa, West Nile virus
RGSGQVGTY

SEQ ID NO: 245784 - protein, 9 aa, West Nile virus
GSGQVGTYG

SEQ ID NO: 245785 - protein, 9 aa, West Nile virus
SGQVGTYGL

SEQ ID NO: 245786 - protein, 9 aa, West Nile virus
GQVGTYGLN

SEQ ID NO: 245787 - protein, 9 aa, West Nile virus
QVGTYGLNT

SEQ ID NO: 245788 - protein, 9 aa, West Nile virus
RMAISGDDC

SEQ ID NO: 245789 - protein, 9 aa, West Nile virus
MAISGDDCV

SEQ ID NO: 245790 - protein, 9 aa, West Nile virus
AISGDDCVV

SEQ ID NO: 245791 - protein, 9 aa, West Nile virus
ISGDDCVVK

SEQ ID NO: 245792 - protein, 9 aa, West Nile virus
SGDDCVVKP

SEQ ID NO: 245793 - protein, 9 aa, West Nile virus
LNDMGKVRK

SEQ ID NO: 245794 - protein, 9 aa, West Nile virus
NDMGKVRKD

SEQ ID NO: 245795 - protein, 9 aa, West Nile virus
DMGKVRKDI

SEQ ID NO: 245796 - protein, 9 aa, West Nile virus
DWQQVPFCS

SEQ ID NO: 245797 - protein, 9 aa, West Nile virus
QVPFCSHHF

SEQ ID NO: 245798 - protein, 9 aa, West Nile virus
VPFCSHHFH

SEQ ID NO: 245799 - protein, 9 aa, West Nile virus
PFCSHHFHE

SEQ ID NO: 245800 - protein, 9 aa, West Nile virus
FCSHHFHEL

SEQ ID NO: 245801 - protein, 9 aa, West Nile virus
VPCRNQDEL

SEQ ID NO: 245802 - protein, 9 aa, West Nile virus
QDELIGRAR

SEQ ID NO: 245803 - protein, 9 aa, West Nile virus
DELIGRARI

SEQ ID NO: 245804 - protein, 9 aa, West Nile virus
ELIGRARIS

SEQ ID NO: 245805 - protein, 9 aa, West Nile virus
GRARISQGA

SEQ ID NO: 245806 - protein, 9 aa, West Nile virus
RARISQGAG

SEQ ID NO: 245807 - protein, 9 aa, West Nile virus
ARISQGAGW

SEQ ID NO: 245808 - protein, 9 aa, West Nile virus
RISQGAGWS

SEQ ID NO: 245809 - protein, 9 aa, West Nile virus
ISQGAGWSL

SEQ ID NO: 245810 - protein, 9 aa, West Nile virus
ETACLGKSY

SEQ ID NO: 245811 - protein, 9 aa, West Nile virus
TACLGKSYA

SEQ ID NO: 245812 - protein, 9 aa, West Nile virus
ACLGKSYAQ

SEQ ID NO: 245813 - protein, 9 aa, West Nile virus
CLGKSYAQM

SEQ ID NO: 245814 - protein, 9 aa, West Nile virus
LMYFHRRDL

SEQ ID NO: 245815 - protein, 9 aa, West Nile virus
MYFHRRDLR

SEQ ID NO: 245816 - protein, 9 aa, West Nile virus
YFHRRDLRL

SEQ ID NO: 245817 - protein, 9 aa, West Nile virus
FHRRDLRLA

SEQ ID NO: 245818 - protein, 9 aa, West Nile virus
HRRDLRLAA

SEQ ID NO: 245819 - protein, 9 aa, West Nile virus
ANAICSAVP

SEQ ID NO: 245820 - protein, 9 aa, West Nile virus
PTSRTTWSI

SEQ ID NO: 245821 - protein, 9 aa, West Nile virus
TSRTTWSIH

SEQ ID NO: 245822 - protein, 9 aa, West Nile virus
SRTTWSIHA

SEQ ID NO: 245823 - protein, 9 aa, West Nile virus
HQWMTTEDM

SEQ ID NO: 245824 - protein, 9 aa, West Nile virus
QWMTTEDML

SEQ ID NO: 245825 - protein, 9 aa, West Nile virus
GKREDQWCG

SEQ ID NO: 245826 - protein, 9 aa, West Nile virus
KREDQWCGS

SEQ ID NO: 245827 - protein, 9 aa, West Nile virus
REDQWCGSL

SEQ ID NO: 245828 - protein, 9 aa, West Nile virus
EDQWCGSLI

SEQ ID NO: 245829 - protein, 9 aa, West Nile virus
DQWCGSLIG

SEQ ID NO: 245830 - protein, 9 aa, West Nile virus
QWCGSLIGL

SEQ ID NO: 245831 - protein, 9 aa, West Nile virus
WCGSLIGLT

SEQ ID NO: 245832 - protein, 9 aa, West Nile virus
QQLTKRFSL

SEQ ID NO: 245833 - protein, 9 aa, West Nile virus
QLTKRFSLG

SEQ ID NO: 245834 - protein, 9 aa, West Nile virus
LTKRFSLGM

SEQ ID NO: 245835 - protein, 9 aa, West Nile virus
TKRFSLGML

SEQ ID NO: 245836 - protein, 9 aa, West Nile virus
EPDDVDCWC

SEQ ID NO: 245837 - protein, 9 aa, West Nile virus
VLEHGGCVT

SEQ ID NO: 245838 - protein, 9 aa, West Nile virus
TDRGWGNGC

SEQ ID NO: 245839 - protein, 9 aa, West Nile virus
DRGWGNHCG

SEQ ID NO: 245840 - protein, 9 aa, West Nile virus
RGWGNHCGL

SEQ ID NO: 245841 - protein, 9 aa, West Nile virus
GWGNHCGLF

SEQ ID NO: 245842 - protein, 9 aa, West Nile virus
WGNHCGLFG

SEQ ID NO: 245843 - protein, 9 aa, West Nile virus
GNHCGLFGK

SEQ ID NO: 245844 - protein, 9 aa, West Nile virus
NHCGLFGKG

SEQ ID NO: 245845 - protein, 9 aa, West Nile virus
GCGLFGKGG

SEQ ID NO: 245846 - protein, 9 aa, West Nile virus
CGLFGKGGI

SEQ ID NO: 245847 - protein, 9 aa, West Nile virus
SGEEHAVGN

SEQ ID NO: 245848 - protein, 9 aa, West Nile virus
ALGSQEGAL

SEQ ID NO: 245849 - protein, 9 aa, West Nile virus
LGSQEGALH

SEQ ID NO: 245850 - protein, 9 aa, West Nile virus
EPPFGDSYI

SEQ ID NO: 245851 - protein, 9 aa, West Nile virus
GAKRMAILG

SEQ ID NO: 245852 - protein, 9 aa, West Nile virus
RLAALGDTA

SEQ ID NO: 245853 - protein, 9 aa, West Nile virus
LAALGDTAW

SEQ ID NO: 245854 - protein, 9 aa, West Nile virus
AALGDTAWD

SEQ ID NO: 245855 - protein, 9 aa, West Nile virus
ALGDTAWDF

SEQ ID NO: 245856 - protein, 9 aa, West Nile virus
LGETAWDFG

SEQ ID NO: 245857 - protein, 9 aa, West Nile virus
GETAWDFGS

SEQ ID NO: 245858 - protein, 9 aa, West Nile virus
TAWDFGSVG

SEQ ID NO: 245859 - protein, 9 aa, West Nile virus
AWDFGSVGG

SEQ ID NO: 245860 - protein, 9 aa, West Nile virus
ELRCGSGVF

SEQ ID NO: 245861 - protein, 9 aa, West Nile virus
VEAWMDRYK

SEQ ID NO: 245862 - protein, 9 aa, West Nile virus
AIHSDLSYW

SEQ ID NO: 245863 - protein, 9 aa, West Nile virus
IHSDLSYWI

SEQ ID NO: 245864 - protein, 9 aa, West Nile virus
HSDLSYWIE

SEQ ID NO: 245865 - protein, 9 aa, West Nile virus
SDLSYWIES

SEQ ID NO: 245866 - protein, 9 aa, West Nile virus
WPETHTLWG

SEQ ID NO: 245867 - protein, 9 aa, West Nile virus
PETHTLWGD

SEQ ID NO: 245868 - protein, 9 aa, West Nile virus
WCCRSCTMP

SEQ ID NO: 245869 - protein, 9 aa, West Nile virus
CCRSCTMPP

SEQ ID NO: 245870 - protein, 9 aa, West Nile virus
CRSCTMPPL

SEQ ID NO: 245871 - protein, 9 aa, West Nile virus
RSCTMPPLR

SEQ ID NO: 245872 - protein, 9 aa, West Nile virus
TDSGCWYGM

SEQ ID NO: 245873 - protein, 9 aa, West Nile virus
DSGCWYGME

SEQ ID NO: 245874 - protein, 9 aa, West Nile virus
SGCWYGMEI

SEQ ID NO: 245875 - protein, 9 aa, West Nile virus
DCWYAMEIR

SEQ ID NO: 245876 - protein, 9 aa, West Nile virus
CWYAMEIRP

SEQ ID NO: 245877 - protein, 9 aa, West Nile virus
TFHTMWHVT

SEQ ID NO: 245878 - protein, 9 aa, West Nile virus
FHTLWHTTK

SEQ ID NO: 245879 - protein, 9 aa, West Nile virus
HTLWHTTKG

SEQ ID NO: 245880 - protein, 9 aa, West Nile virus
TLWHTTKGA

SEQ ID NO: 245881 - protein, 9 aa, West Nile virus
LWHTTKGAA

SEQ ID NO: 245882 - protein, 9 aa, West Nile virus
WHTTKGAAL

SEQ ID NO: 245883 - protein, 9 aa, West Nile virus
GLYGNGVIM

SEQ ID NO: 245884 - protein, 9 aa, West Nile virus
ITVLDLHPG

SEQ ID NO: 245885 - protein, 9 aa, West Nile virus
MDLHPGAGK

SEQ ID NO: 245886 - protein, 9 aa, West Nile virus
DLHPGAGKT

SEQ ID NO: 245887 - protein, 9 aa, West Nile virus
LHPGAGKTK

SEQ ID NO: 245888 - protein, 9 aa, West Nile virus
LRTAVLAPT

SEQ ID NO: 245889 - protein, 9 aa, West Nile virus
RTAVLAPTR

SEQ ID NO: 245890 - protein, 9 aa, West Nile virus
TAVLAPTRV

SEQ ID NO: 245891 - protein, 9 aa, West Nile virus
AVLAPTRVV

SEQ ID NO: 245892 - protein, 9 aa, West Nile virus
VLAPTRVVA

SEQ ID NO: 245893 - protein, 9 aa, West Nile virus
LAPTRVVAS

SEQ ID NO: 245894 - protein, 9 aa, West Nile virus
APTRVVASE

SEQ ID NO: 245895 - protein, 9 aa, West Nile virus
PTRVVASEM

SEQ ID NO: 245896 - protein, 9 aa, West Nile virus
TRVVASEMA

SEQ ID NO: 245897 - protein, 9 aa, West Nile virus
RVVASEMAE

SEQ ID NO: 245898 - protein, 9 aa, West Nile virus
VVASEMAEA

SEQ ID NO: 245899 - protein, 9 aa, West Nile virus
VASEMAEAL

SEQ ID NO: 245900 - protein, 9 aa, West Nile virus
GKEIVDLMC

SEQ ID NO: 245901 - protein, 9 aa, West Nile virus
KEIVDLMCH

SEQ ID NO: 245902 - protein, 9 aa, West Nile virus
EIVDVMCHA

SEQ ID NO: 245903 - protein, 9 aa, West Nile virus
IVDVMCHAT

SEQ ID NO: 245904 - protein, 9 aa, West Nile virus
VDVMCHATL

SEQ ID NO: 245905 - protein, 9 aa, West Nile virus
DVMCHATLT

SEQ ID NO: 245906 - protein, 9 aa, West Nile virus
VMCHATLTH

SEQ ID NO: 245907 - protein, 9 aa, West Nile virus
MCHATLTHR

SEQ ID NO: 245908 - protein, 9 aa, West Nile virus
CHATLTHRL

SEQ ID NO: 245909 - protein, 9 aa, West Nile virus
HATLTHRLM

SEQ ID NO: 245910 - protein, 9 aa, West Nile virus
ATLTHRLMS

SEQ ID NO: 245911 - protein, 9 aa, West Nile virus
TLTHRLMSP

SEQ ID NO: 245912 - protein, 9 aa, West Nile virus
VMDEAHFTD

SEQ ID NO: 245913 - protein, 9 aa, West Nile virus
MDEAHWTDP

SEQ ID NO: 245914 - protein, 9 aa, West Nile virus
DEAHFTDPS

SEQ ID NO: 245915 - protein, 9 aa, West Nile virus
EAHFTDPSS

SEQ ID NO: 245916 - protein, 9 aa, West Nile virus
AHFTDPSSI

SEQ ID NO: 245917 - protein, 9 aa, West Nile virus
HFTDPSSIA

SEQ ID NO: 245918 - protein, 9 aa, West Nile virus
FTDPSSIAA

SEQ ID NO: 245919 - protein, 9 aa, West Nile virus
TDPSSIAAR

SEQ ID NO: 245920 - protein, 9 aa, West Nile virus
DPSSIAARG

SEQ ID NO: 245921 - protein, 9 aa, West Nile virus
PSSIAARGY

SEQ ID NO: 245922 - protein, 9 aa, West Nile virus
SSIAARGYI

SEQ ID NO: 245923 - protein, 9 aa, West Nile virus
SVAARGYIS

SEQ ID NO: 245924 - protein, 9 aa, West Nile virus
VAARGYIST

SEQ ID NO: 245925 - protein, 9 aa, West Nile virus
AARGYISTK

SEQ ID NO: 245926 - protein, 9 aa, West Nile virus
ARGYISTKV

SEQ ID NO: 245927 - protein, 9 aa, West Nile virus
RGYISTRVE

SEQ ID NO: 245928 - protein, 9 aa, West Nile virus
TRVEMGEAA

SEQ ID NO: 245929 - protein, 9 aa, West Nile virus
MGEAAGIFM

SEQ ID NO: 245930 - protein, 9 aa, West Nile virus
GEAAGIFMT

SEQ ID NO: 245931 - protein, 9 aa, West Nile virus
EAAGIFMTA

SEQ ID NO: 245932 - protein, 9 aa, West Nile virus
AAGIFMTAT

SEQ ID NO: 245933 - protein, 9 aa, West Nile virus
AGIFMTATP

SEQ ID NO: 245934 - protein, 9 aa, West Nile virus
GIFMTATPP

SEQ ID NO: 245935 - protein, 9 aa, West Nile virus
VLMTATPPG

SEQ ID NO: 245936 - protein, 9 aa, West Nile virus
FMTATPPGT

SEQ ID NO: 245937 - protein, 9 aa, West Nile virus
GKTVWFVAS

SEQ ID NO: 245938 - protein, 9 aa, West Nile virus
KTVWFVPSV

SEQ ID NO: 245939 - protein, 9 aa, West Nile virus
TVWFVPSVK

SEQ ID NO: 245940 - protein, 9 aa, West Nile virus
VVQLNRKSY

SEQ ID NO: 245941 - protein, 9 aa, West Nile virus
DWDYVVTTD

SEQ ID NO: 245942 - protein, 9 aa, West Nile virus
WDYVVTTDI

SEQ ID NO: 245943 - protein, 9 aa, West Nile virus
DYVVTTDIS

SEQ ID NO: 245944 - protein, 9 aa, West Nile virus
YVVTTDISE

SEQ ID NO: 245945 - protein, 9 aa, West Nile virus
VITTDISEM

SEQ ID NO: 245946 - protein, 9 aa, West Nile virus
ITTDISEMG

SEQ ID NO: 245947 - protein, 9 aa, West Nile virus
DISEMGANL

SEQ ID NO: 245948 - protein, 9 aa, West Nile virus
ISEMGANFR

SEQ ID NO: 245949 - protein, 9 aa, West Nile virus
SEMGANFRA

SEQ ID NO: 245950 - protein, 9 aa, West Nile virus
RVIDPRRCM

SEQ ID NO: 245951 - protein, 9 aa, West Nile virus
VIDPRRCMK

SEQ ID NO: 245952 - protein, 9 aa, West Nile virus
IDPRRCMKP

SEQ ID NO: 245953 - protein, 9 aa, West Nile virus
DPRRCMKPV

SEQ ID NO: 245954 - protein, 9 aa, West Nile virus
PRRCMKPVI

SEQ ID NO: 245955 - protein, 9 aa, West Nile virus
RRCMKPVIL

SEQ ID NO: 245956 - protein, 9 aa, West Nile virus
SSAAQRRGR

SEQ ID NO: 245957 - protein, 9 aa, West Nile virus
SAAQRRGRV

SEQ ID NO: 245958 - protein, 9 aa, West Nile virus
AAQRRGRVG

SEQ ID NO: 245959 - protein, 9 aa, West Nile virus
AQRRGRVGR

SEQ ID NO: 245960 - protein, 9 aa, West Nile virus
QRRGRVGRN

SEQ ID NO: 245961 - protein, 9 aa, West Nile virus
WKEAKMLLD

SEQ ID NO: 245962 - protein, 9 aa, West Nile virus
EARIMLDNI

SEQ ID NO: 245963 - protein, 9 aa, West Nile virus
DGEYRLKGE

SEQ ID NO: 245964 - protein, 9 aa, West Nile virus
LLRTADLPV

SEQ ID NO: 245965 - protein, 9 aa, West Nile virus
LRTADLPVW

SEQ ID NO: 245966 - protein, 9 aa, West Nile virus
RTADLPVWL

SEQ ID NO: 245967 - protein, 9 aa, West Nile virus
RGDLPVWLS

SEQ ID NO: 245968 - protein, 9 aa, West Nile virus
LLIPEPDRQ

SEQ ID NO: 245969 - protein, 9 aa, West Nile virus
LIPEPDRQR

SEQ ID NO: 245970 - protein, 9 aa, West Nile virus
IPEPDRQRT

SEQ ID NO: 245971 - protein, 9 aa, West Nile virus
PEPDRQRTP

SEQ ID NO: 245972 - protein, 9 aa, West Nile virus
EPDRQRTPQ

SEQ ID NO: 245973 - protein, 9 aa, West Nile virus
PDRQRTPQD

SEQ ID NO: 245974 - protein, 9 aa, West Nile virus
DRQRTPQDN

SEQ ID NO: 245975 - protein, 9 aa, West Nile virus
RQRTPQDNQ

SEQ ID NO: 245976 - protein, 9 aa, West Nile virus
QRSQTDNQL

SEQ ID NO: 245977 - protein, 9 aa, West Nile virus
RTPQDNQLT

SEQ ID NO: 245978 - protein, 9 aa, West Nile virus
PATAWSLYA

SEQ ID NO: 245979 - protein, 9 aa, West Nile virus
ATAWSLYAV

SEQ ID NO: 245980 - protein, 9 aa, West Nile virus
TAWSLYAVT

SEQ ID NO: 245981 - protein, 9 aa, West Nile virus
AWSLYAVTT

SEQ ID NO: 245982 - protein, 9 aa, West Nile virus
WSLYAVTTA

SEQ ID NO: 245983 - protein, 9 aa, West Nile virus
HYAYMVPGW

SEQ ID NO: 245984 - protein, 9 aa, West Nile virus
YAYMVPGWQ

SEQ ID NO: 245985 - protein, 9 aa, West Nile virus
AYMVPGWQA

SEQ ID NO: 245986 - protein, 9 aa, West Nile virus
YMVPGWQAE

SEQ ID NO: 245987 - protein, 9 aa, West Nile virus
MVPGWQAEA

SEQ ID NO: 245988 - protein, 9 aa, West Nile virus
VPGWQAEAM

SEQ ID NO: 245989 - protein, 9 aa, West Nile virus
PGWQAEAMR

SEQ ID NO: 245990 - protein, 9 aa, West Nile virus
GWQAEAMRS

SEQ ID NO: 245991 - protein, 9 aa, West Nile virus
WQAEAMRSA

SEQ ID NO: 245992 - protein, 9 aa, West Nile virus
QAEAMRSAQ

SEQ ID NO: 245993 - protein, 9 aa, West Nile virus
AEAMRSAQR

SEQ ID NO: 245994 - protein, 9 aa, West Nile virus
EAMRSAQRR

SEQ ID NO: 245995 - protein, 9 aa, West Nile virus
REAQKRAAA

SEQ ID NO: 245996 - protein, 9 aa, West Nile virus
EAQKRAAAG

SEQ ID NO: 245997 - protein, 9 aa, West Nile virus
AQKRAAAGI

SEQ ID NO: 245998 - protein, 9 aa, West Nile virus
QKRAAAGIM

SEQ ID NO: 245999 - protein, 9 aa, West Nile virus
KRAAAGIMK

SEQ ID NO: 246000 - protein, 9 aa, West Nile virus
RAAAGIMKN

SEQ ID NO: 246001 - protein, 9 aa, West Nile virus
AAAGIMKNP

SEQ ID NO: 246002 - protein, 9 aa, West Nile virus
AAGIMKNAV

SEQ ID NO: 246003 - protein, 9 aa, West Nile virus
AGIMKNAVV

SEQ ID NO: 246004 - protein, 9 aa, West Nile virus
GIMKNAVVD

SEQ ID NO: 246005 - protein, 9 aa, West Nile virus
IMKNAVVDG

SEQ ID NO: 246006 - protein, 9 aa, West Nile virus
FEKQLGQIM

SEQ ID NO: 246007 - protein, 9 aa, West Nile virus
GRFWNTTIA

SEQ ID NO: 246008 - protein, 9 aa, West Nile virus
RFWNTTIAV

SEQ ID NO: 246009 - protein, 9 aa, West Nile virus
VWNATTAIG

SEQ ID NO: 246010 - protein, 9 aa, West Nile virus
CHIMRGGWL

SEQ ID NO: 246011 - protein, 9 aa, West Nile virus
HIMRGGWLS

SEQ ID NO: 246012 - protein, 9 aa, West Nile virus
IMRGGWLSC

SEQ ID NO: 246013 - protein, 9 aa, West Nile virus
MRGGWLSCL

SEQ ID NO: 246014 - protein, 9 aa, West Nile virus
RGGWLSCLS

SEQ ID NO: 246015 - protein, 9 aa, West Nile virus
GGWLSCLSI

SEQ ID NO: 246016 - protein, 9 aa, West Nile virus
GRTLGEVWK

SEQ ID NO: 246017 - protein, 9 aa, West Nile virus
AVSRGTAKL

SEQ ID NO: 246018 - protein, 9 aa, West Nile virus
VSRGSAKLR

SEQ ID NO: 246019 - protein, 9 aa, West Nile virus
SRGSAKLRW

SEQ ID NO: 246020 - protein, 9 aa, West Nile virus
GKVVDLGCG

SEQ ID NO: 246021 - protein, 9 aa, West Nile virus
KVVDLGCGR

SEQ ID NO: 246022 - protein, 9 aa, West Nile virus
VVDLGCGRG

SEQ ID NO: 246023 - protein, 9 aa, West Nile virus
VDLGCGRGG

SEQ ID NO: 246024 - protein, 9 aa, West Nile virus
LGCGRGGWC

SEQ ID NO: 246025 - protein, 9 aa, West Nile virus
GCGRGGWCY

SEQ ID NO: 246026 - protein, 9 aa, West Nile virus
CGRGGWCYY

SEQ ID NO: 246027 - protein, 9 aa, West Nile virus
GRGGWCYYM

SEQ ID NO: 246028 - protein, 9 aa, West Nile virus
EVKGLTKGG

SEQ ID NO: 246029 - protein, 9 aa, West Nile virus
GLTKGGPGH

SEQ ID NO: 246030 - protein, 9 aa, West Nile virus
TKGGAGHEE

SEQ ID NO: 246031 - protein, 9 aa, West Nile virus
KGGAGHEEP

SEQ ID NO: 246032 - protein, 9 aa, West Nile virus
VDTLLCDIG

SEQ ID NO: 246033 - protein, 9 aa, West Nile virus
DTLFCDIGE

SEQ ID NO: 246034 - protein, 9 aa, West Nile virus
TLFCDIGES

SEQ ID NO: 246035 - protein, 9 aa, West Nile virus
LFCDIGESS

SEQ ID NO: 246036 - protein, 9 aa, West Nile virus
LCDIGESSS

SEQ ID NO: 246037 - protein, 9 aa, West Nile virus
CDIGESSPS

SEQ ID NO: 246038 - protein, 9 aa, West Nile virus
LVRCPLSRN

SEQ ID NO: 246039 - protein, 9 aa, West Nile virus
VRCPLSRNS

SEQ ID NO: 246040 - protein, 9 aa, West Nile virus
RCPLSRNST

SEQ ID NO: 246041 - protein, 9 aa, West Nile virus
CPLSRNSTH

SEQ ID NO: 246042 - protein, 9 aa, West Nile virus
PLSRNSNHE

SEQ ID NO: 246043 - protein, 9 aa, West Nile virus
LSRNSNHEM

SEQ ID NO: 246044 - protein, 9 aa, West Nile virus
SRNSNHEMY

SEQ ID NO: 246045 - protein, 9 aa, West Nile virus
RNSNHEMYW

SEQ ID NO: 246046 - protein, 9 aa, West Nile virus
NSTHEMYWI

SEQ ID NO: 246047 - protein, 9 aa, West Nile virus
STHEMYWIS

SEQ ID NO: 246048 - protein, 9 aa, West Nile virus
PYRTWNYHG

SEQ ID NO: 246049 - protein, 9 aa, West Nile virus
YRTWNYHGS

SEQ ID NO: 246050 - protein, 9 aa, West Nile virus
RTWNYHGSY

SEQ ID NO: 246051 - protein, 9 aa, West Nile virus
TWNYHGSYD

SEQ ID NO: 246052 - protein, 9 aa, West Nile virus
GSASSMING

SEQ ID NO: 246053 - protein, 9 aa, West Nile virus
SASSMINGV

SEQ ID NO: 246054 - protein, 9 aa, West Nile virus
ASSMINGVV

SEQ ID NO: 246055 - protein, 9 aa, West Nile virus
NGVVRLLTK

SEQ ID NO: 246056 - protein, 9 aa, West Nile virus
GVVRLLTKP

SEQ ID NO: 246057 - protein, 9 aa, West Nile virus
VVRLLTKPW

SEQ ID NO: 246058 - protein, 9 aa, West Nile virus
VRLLTKPWD

SEQ ID NO: 246059 - protein, 9 aa, West Nile virus
IAMTDTTPF

SEQ ID NO: 246060 - protein, 9 aa, West Nile virus
AMTDTTAFG

SEQ ID NO: 246061 - protein, 9 aa, West Nile virus
MTDTTAFGQ

SEQ ID NO: 246062 - protein, 9 aa, West Nile virus
TDTTAFGQQ

SEQ ID NO: 246063 - protein, 9 aa, West Nile virus
DTTAFGQQR

SEQ ID NO: 246064 - protein, 9 aa, West Nile virus
TTAFGQQRV

SEQ ID NO: 246065 - protein, 9 aa, West Nile virus
TAFGQQRVF

SEQ ID NO: 246066 - protein, 9 aa, West Nile virus
AFGQQRVFK

SEQ ID NO: 246067 - protein, 9 aa, West Nile virus
VFKEKVDTK

SEQ ID NO: 246068 - protein, 9 aa, West Nile virus
FKEKVDTKA

SEQ ID NO: 246069 - protein, 9 aa, West Nile virus
KEKVDTRTQ

SEQ ID NO: 246070 - protein, 9 aa, West Nile virus
SCVYNMMGK

SEQ ID NO: 246071 - protein, 9 aa, West Nile virus
CIYNMMGKR

SEQ ID NO: 246072 - protein, 9 aa, West Nile virus
IYNMMGKRE

SEQ ID NO: 246073 - protein, 9 aa, West Nile virus
MMGKREKKP

SEQ ID NO: 246074 - protein, 9 aa, West Nile virus
MGKREKKPG

SEQ ID NO: 246075 - protein, 9 aa, West Nile virus
GKREKKPGE

SEQ ID NO: 246076 - protein, 9 aa, West Nile virus
KREKKPGEF

SEQ ID NO: 246077 - protein, 9 aa, West Nile virus
REKKPGEFG

SEQ ID NO: 246078 - protein, 9 aa, West Nile virus
EKKPGEFGK

SEQ ID NO: 246079 - protein, 9 aa, West Nile virus
KKPGEFGKA

SEQ ID NO: 246080 - protein, 9 aa, West Nile virus
KPGEFGKAK

SEQ ID NO: 246081 - protein, 9 aa, West Nile virus
PGEFGKAKG

SEQ ID NO: 246082 - protein, 9 aa, West Nile virus
GEFGRAKGS

SEQ ID NO: 246083 - protein, 9 aa, West Nile virus
EFGRAKGSR

SEQ ID NO: 246084 - protein, 9 aa, West Nile virus
FGRAKGSRA

SEQ ID NO: 246085 - protein, 9 aa, West Nile virus
GRAKGSRAI

SEQ ID NO: 246086 - protein, 9 aa, West Nile virus
RAKGSRAIW

SEQ ID NO: 246087 - protein, 9 aa, West Nile virus
AKGSRAIWF

SEQ ID NO: 246088 - protein, 9 aa, West Nile virus
KGSRAIWFM

SEQ ID NO: 246089 - protein, 9 aa, West Nile virus
GSRAIWFMW

SEQ ID NO: 246090 - protein, 9 aa, West Nile virus
SRAIWFMWL

SEQ ID NO: 246091 - protein, 9 aa, West Nile virus
RAIWFMWLG

SEQ ID NO: 246092 - protein, 9 aa, West Nile virus
AIWFMWLGA

SEQ ID NO: 246093 - protein, 9 aa, West Nile virus
IWFMWLGAR

SEQ ID NO: 246094 - protein, 9 aa, West Nile virus
WYMWLGARY

SEQ ID NO: 246095 - protein, 9 aa, West Nile virus
YMWLGARYL

SEQ ID NO: 246096 - protein, 9 aa, West Nile virus
MWLGARYLE

SEQ ID NO: 246097 - protein, 9 aa, West Nile virus
WLGARYLEF

SEQ ID NO: 246098 - protein, 9 aa, West Nile virus
LGARYLEFE

SEQ ID NO: 246099 - protein, 9 aa, West Nile virus
GARYLEFEA

SEQ ID NO: 246100 - protein, 9 aa, West Nile virus
ARYLEFEAL

SEQ ID NO: 246101 - protein, 9 aa, West Nile virus
RYLEFEALG

SEQ ID NO: 246102 - protein, 9 aa, West Nile virus
YLEFEALGF

SEQ ID NO: 246103 - protein, 9 aa, West Nile virus
LEFEALGFM

SEQ ID NO: 246104 - protein, 9 aa, West Nile virus
EFEALGFMN

SEQ ID NO: 246105 - protein, 9 aa, West Nile virus
FEALGFMNE

SEQ ID NO: 246106 - protein, 9 aa, West Nile virus
EALGFMNED

SEQ ID NO: 246107 - protein, 9 aa, West Nile virus
ALGFMNEDH

SEQ ID NO: 246108 - protein, 9 aa, West Nile virus
LGFMNEDHW

SEQ ID NO: 246109 - protein, 9 aa, West Nile virus
GFMNEDHWF

SEQ ID NO: 246110 - protein, 9 aa, West Nile virus
IYADDTAGW

SEQ ID NO: 246111 - protein, 9 aa, West Nile virus
DDTAGWDTK

SEQ ID NO: 246112 - protein, 9 aa, West Nile virus
DTAGWDTKV

SEQ ID NO: 246113 - protein, 9 aa, West Nile virus
TAGWDTKVT

SEQ ID NO: 246114 - protein, 9 aa, West Nile virus
IIELTYRHK

SEQ ID NO: 246115 - protein, 9 aa, West Nile virus
IELTYRHKV

SEQ ID NO: 246116 - protein, 9 aa, West Nile virus
ELTYRHKVV

SEQ ID NO: 246117 - protein, 9 aa, West Nile virus
LTYQNKVVK

SEQ ID NO: 246118 - protein, 9 aa, West Nile virus
TYQNKVVKV

SEQ ID NO: 246119 - protein, 9 aa, West Nile virus
NKVVKVQRP

SEQ ID NO: 246120 - protein, 9 aa, West Nile virus
MDIISRKDQ

SEQ ID NO: 246121 - protein, 9 aa, West Nile virus
DIISRKDQR

SEQ ID NO: 246122 - protein, 9 aa, West Nile virus
IISRKDQRG

SEQ ID NO: 246123 - protein, 9 aa, West Nile virus
ISRKDQRGS

SEQ ID NO: 246124 - protein, 9 aa, West Nile virus
SRKDQRGSG

SEQ ID NO: 246125 - protein, 9 aa, West Nile virus
RKDQRGSGQ

SEQ ID NO: 246126 - protein, 9 aa, West Nile virus
KDQRGSGQV

SEQ ID NO: 246127 - protein, 9 aa, West Nile virus
DQRGSGQVV

SEQ ID NO: 246128 - protein, 9 aa, West Nile virus
QRGSGQVVT

SEQ ID NO: 246129 - protein, 9 aa, West Nile virus
RGSGQVVTY

SEQ ID NO: 246130 - protein, 9 aa, West Nile virus
GSGQVVTYA

SEQ ID NO: 246131 - protein, 9 aa, West Nile virus
SGQVVTYAL

SEQ ID NO: 246132 - protein, 9 aa, West Nile virus
GQVVTYALN

SEQ ID NO: 246133 - protein, 9 aa, West Nile virus
QVVTYALNT

SEQ ID NO: 246134 - protein, 9 aa, West Nile virus
RMAVSGDDC

SEQ ID NO: 246135 - protein, 9 aa, West Nile virus
MAVSGDDCV

SEQ ID NO: 246136 - protein, 9 aa, West Nile virus
AVSGDDCVV

SEQ ID NO: 246137 - protein, 9 aa, West Nile virus
VSGDDCVVK

SEQ ID NO: 246138 - protein, 9 aa, West Nile virus
SGDDCVVRP

SEQ ID NO: 246139 - protein, 9 aa, West Nile virus
LNDMGKIRK

SEQ ID NO: 246140 - protein, 9 aa, West Nile virus
NDMGKIRKD

SEQ ID NO: 246141 - protein, 9 aa, West Nile virus
DMGKIRKDI

SEQ ID NO: 246142 - protein, 9 aa, West Nile virus
DWTQVPFCS

SEQ ID NO: 246143 - protein, 9 aa, West Nile virus
QVPFCSNHF

SEQ ID NO: 246144 - protein, 9 aa, West Nile virus
VPFCSNHFT

SEQ ID NO: 246145 - protein, 9 aa, West Nile virus
PFCSHHFHQ

SEQ ID NO: 246146 - protein, 9 aa, West Nile virus
FCSHHFHQL

SEQ ID NO: 246147 - protein, 9 aa, West Nile virus
VPCRPQDEL

SEQ ID NO: 246148 - protein, 9 aa, West Nile virus
QDELVGRAR

SEQ ID NO: 246149 - protein, 9 aa, West Nile virus
DELVGRARV

SEQ ID NO: 246150 - protein, 9 aa, West Nile virus
ELVGRARVS

SEQ ID NO: 246151 - protein, 9 aa, West Nile virus
GRARVSQGA

SEQ ID NO: 246152 - protein, 9 aa, West Nile virus
RARVSQGAG

SEQ ID NO: 246153 - protein, 9 aa, West Nile virus
ARVSQGAGW

SEQ ID NO: 246154 - protein, 9 aa, West Nile virus
RVSQGAGWS

SEQ ID NO: 246155 - protein, 9 aa, West Nile virus
VSQGAGWSL

SEQ ID NO: 246156 - protein, 9 aa, West Nile virus
ETACLGKAY

SEQ ID NO: 246157 - protein, 9 aa, West Nile virus
TACLGKAYA

SEQ ID NO: 246158 - protein, 9 aa, West Nile virus
ACLGKAYAQ

SEQ ID NO: 246159 - protein, 9 aa, West Nile virus
CLGKAYAQM

SEQ ID NO: 246160 - protein, 9 aa, West Nile virus
LLYFHRRDL

SEQ ID NO: 246161 - protein, 9 aa, West Nile virus
LYFHRRDLR

SEQ ID NO: 246162 - protein, 9 aa, West Nile virus
YFHRRDLRT

SEQ ID NO: 246163 - protein, 9 aa, West Nile virus
FHRRDLRLM

SEQ ID NO: 246164 - protein, 9 aa, West Nile virus
HRRDLRLAS

SEQ ID NO: 246165 - protein, 9 aa, West Nile virus
SNAICSAVP

SEQ ID NO: 246166 - protein, 9 aa, West Nile virus
PTGRTTWSI

SEQ ID NO: 246167 - protein, 9 aa, West Nile virus
TGRTTWSIH

SEQ ID NO: 246168 - protein, 9 aa, West Nile virus
GRTTWSIHA

SEQ ID NO: 246169 - protein, 9 aa, West Nile virus
HEWMTTEDM

SEQ ID NO: 246170 - protein, 9 aa, West Nile virus
EWMTTEDML

SEQ ID NO: 246171 - protein, 9 aa, West Nile virus
GKREDIWCG

SEQ ID NO: 246172 - protein, 9 aa, West Nile virus
KREDIWCGS

SEQ ID NO: 246173 - protein, 9 aa, West Nile virus
REDIWCGSL

SEQ ID NO: 246174 - protein, 9 aa, West Nile virus
EDIWCGSLI

SEQ ID NO: 246175 - protein, 9 aa, West Nile virus
DIWCGSLIG

SEQ ID NO: 246176 - protein, 9 aa, West Nile virus
IWCGSLIGT

SEQ ID NO: 246177 - protein, 9 aa, West Nile virus
WCGSLIGTR

SEQ ID NO: 246178 - protein, 9 aa, West Nile virus
SQLAKRFSR

SEQ ID NO: 246179 - protein, 9 aa, West Nile virus
QLAKRFSRG

SEQ ID NO: 246180 - protein, 9 aa, West Nile virus
LAKRFSRGL

SEQ ID NO: 246181 - protein, 9 aa, West Nile virus
AKRFSRGLL

SEQ ID NO: 246182 - protein, 9 aa, West Nile virus
DPEDIDCWC

SEQ ID NO: 246183 - protein, 9 aa, West Nile virus
VLEGDSCVT

SEQ ID NO: 246184 - protein, 9 aa, West Nile virus
SDRGWGNHC

SEQ ID NO: 246185 - protein, 9 aa, West Nile virus
HCGLFGKGS

SEQ ID NO: 246186 - protein, 9 aa, West Nile virus
CGLFGKGSI

SEQ ID NO: 246187 - protein, 9 aa, West Nile virus
NGDTHAVGN

SEQ ID NO: 246188 - protein, 9 aa, West Nile virus
ALGSQEGGL

SEQ ID NO: 246189 - protein, 9 aa, West Nile virus
LGSQEGGLH

SEQ ID NO: 246190 - protein, 9 aa, West Nile virus
EPPFGESNI

SEQ ID NO: 246191 - protein, 9 aa, West Nile virus
GAQRLAALG

SEQ ID NO: 246192 - protein, 9 aa, West Nile virus
RMAILGETA

SEQ ID NO: 246193 - protein, 9 aa, West Nile virus
MAILGETAW

SEQ ID NO: 246194 - protein, 9 aa, West Nile virus
AILGETAWD

SEQ ID NO: 246195 - protein, 9 aa, West Nile virus
ILGETAWDF

SEQ ID NO: 246196 - protein, 9 aa, West Nile virus
IGEHAWDFG

SEQ ID NO: 246197 - protein, 9 aa, West Nile virus
GEHAWDFGS

SEQ ID NO: 246198 - protein, 9 aa, West Nile virus
TAWDFGSLG

SEQ ID NO: 246199 - protein, 9 aa, West Nile virus
AWDFGSLGG

SEQ ID NO: 246200 - protein, 9 aa, West Nile virus
EMRCGSGIF

SEQ ID NO: 246201 - protein, 9 aa, West Nile virus
VEAWVDRYK

SEQ ID NO: 246202 - protein, 9 aa, West Nile virus
AVHSDLSYW

SEQ ID NO: 246203 - protein, 9 aa, West Nile virus
VHSDLSYWI

SEQ ID NO: 246204 - protein, 9 aa, West Nile virus
HTDQSLWMK

SEQ ID NO: 246205 - protein, 9 aa, West Nile virus
GSPTFWMGS

SEQ ID NO: 246206 - protein, 9 aa, West Nile virus
WPKTHTLWS

SEQ ID NO: 246207 - protein, 9 aa, West Nile virus
PKTHTLWSN

SEQ ID NO: 246208 - protein, 9 aa, West Nile virus
WCCRSCSLP

SEQ ID NO: 246209 - protein, 9 aa, West Nile virus
CCRSCSLPP

SEQ ID NO: 246210 - protein, 9 aa, West Nile virus
CRSCSLPPL

SEQ ID NO: 246211 - protein, 9 aa, West Nile virus
RSCSLPPLR

SEQ ID NO: 246212 - protein, 9 aa, West Nile virus
TENGCWYGM

SEQ ID NO: 246213 - protein, 9 aa, West Nile virus
ENGCWYGME

SEQ ID NO: 246214 - protein, 9 aa, West Nile virus
NGCWYGMEI

SEQ ID NO: 246215 - protein, 9 aa, West Nile virus
VFHTLWHTT

SEQ ID NO: 246216 - protein, 9 aa, West Nile virus
FHTLWHTTR

SEQ ID NO: 246217 - protein, 9 aa, West Nile virus
HTLWHTTRG

SEQ ID NO: 246218 - protein, 9 aa, West Nile virus
TMWHVTRGS

SEQ ID NO: 246219 - protein, 9 aa, West Nile virus
MWHVTRGSV

SEQ ID NO: 246220 - protein, 9 aa, West Nile virus
WHVTRGSVI

SEQ ID NO: 246221 - protein, 9 aa, West Nile virus
GLYGNGVEL

SEQ ID NO: 246222 - protein, 9 aa, West Nile virus
MTVLDLHPG

SEQ ID NO: 246223 - protein, 9 aa, West Nile virus
LDLHPGAGK

SEQ ID NO: 246224 - protein, 9 aa, West Nile virus
DMHPGSGKT

SEQ ID NO: 246225 - protein, 9 aa, West Nile virus
LHPGAGKTR

SEQ ID NO: 246226 - protein, 9 aa, West Nile virus
LRTLVLAPT

SEQ ID NO: 246227 - protein, 9 aa, West Nile virus
RTLVLAPTR

SEQ ID NO: 246228 - protein, 9 aa, West Nile virus
TLVLAPTRV

SEQ ID NO: 246229 - protein, 9 aa, West Nile virus
LVLAPTRVV

SEQ ID NO: 246230 - protein, 9 aa, West Nile virus
VLAPTRVVL

SEQ ID NO: 246231 - protein, 9 aa, West Nile virus
LAPTRVVLK

SEQ ID NO: 246232 - protein, 9 aa, West Nile virus
APTRVVLKE

SEQ ID NO: 246233 - protein, 9 aa, West Nile virus
PTRVVLKEM

SEQ ID NO: 246234 - protein, 9 aa, West Nile virus
TRVVAAEMA

SEQ ID NO: 246235 - protein, 9 aa, West Nile virus
RVVAAEMAE

SEQ ID NO: 246236 - protein, 9 aa, West Nile virus
VVAAEMAEA

SEQ ID NO: 246237 - protein, 9 aa, West Nile virus
VAAEMAEAL

SEQ ID NO: 246238 - protein, 9 aa, West Nile virus
GNEIVDVMC

SEQ ID NO: 246239 - protein, 9 aa, West Nile virus
NEIVDVMCH

SEQ ID NO: 246240 - protein, 9 aa, West Nile virus
AIVDVMCHA

SEQ ID NO: 246241 - protein, 9 aa, West Nile virus
VIDAMCHAT

SEQ ID NO: 246242 - protein, 9 aa, West Nile virus
VDVMCHATY

SEQ ID NO: 246243 - protein, 9 aa, West Nile virus
DVMCHATYV

SEQ ID NO: 246244 - protein, 9 aa, West Nile virus
LMCHATFTT

SEQ ID NO: 246245 - protein, 9 aa, West Nile virus
MCHATFTTR

SEQ ID NO: 246246 - protein, 9 aa, West Nile virus
CHATFTTRL

SEQ ID NO: 246247 - protein, 9 aa, West Nile virus
HATFTTRLL

SEQ ID NO: 246248 - protein, 9 aa, West Nile virus
ATFTTRLLS

SEQ ID NO: 246249 - protein, 9 aa, West Nile virus
TFTTRLLSS

SEQ ID NO: 246250 - protein, 9 aa, West Nile virus
IMDEAHWTD

SEQ ID NO: 246251 - protein, 9 aa, West Nile virus
DEAHWTDPH

SEQ ID NO: 246252 - protein, 9 aa, West Nile virus
EAHWTDPHS

SEQ ID NO: 246253 - protein, 9 aa, West Nile virus
AHFTDPSSV

SEQ ID NO: 246254 - protein, 9 aa, West Nile virus
HFTDPSSVA

SEQ ID NO: 246255 - protein, 9 aa, West Nile virus
FTDPSSVAA

SEQ ID NO: 246256 - protein, 9 aa, West Nile virus
TDPSSVAAR

SEQ ID NO: 246257 - protein, 9 aa, West Nile virus
DPSSVAARG

SEQ ID NO: 246258 - protein, 9 aa, West Nile virus
PSSVAARGY

SEQ ID NO: 246259 - protein, 9 aa, West Nile virus
SSVAARGYI

SEQ ID NO: 246260 - protein, 9 aa, West Nile virus
SIAARGYIA

SEQ ID NO: 246261 - protein, 9 aa, West Nile virus
IAARGYIAT

SEQ ID NO: 246262 - protein, 9 aa, West Nile virus
AARGYIATK

SEQ ID NO: 246263 - protein, 9 aa, West Nile virus
ARGYIATKV

SEQ ID NO: 246264 - protein, 9 aa, West Nile virus
RGYISTKVE

SEQ ID NO: 246265 - protein, 9 aa, West Nile virus
TKVELGEAA

SEQ ID NO: 246266 - protein, 9 aa, West Nile virus
LGEAAAIFM

SEQ ID NO: 246267 - protein, 9 aa, West Nile virus
NKCALVLMT

SEQ ID NO: 246268 - protein, 9 aa, West Nile virus
KCALVLMTA

SEQ ID NO: 246269 - protein, 9 aa, West Nile virus
CALVLMTAT

SEQ ID NO: 246270 - protein, 9 aa, West Nile virus
ALVLMTATP

SEQ ID NO: 246271 - protein, 9 aa, West Nile virus
LVLMTATPP

SEQ ID NO: 246272 - protein, 9 aa, West Nile virus
FMTATPPGA

SEQ ID NO: 246273 - protein, 9 aa, West Nile virus
GRTAWFVPS

SEQ ID NO: 246274 - protein, 9 aa, West Nile virus
KTVWFVASV

SEQ ID NO: 246275 - protein, 9 aa, West Nile virus
TVWFVASVK

SEQ ID NO: 246276 - protein, 9 aa, West Nile virus
VIQLNRKSY

SEQ ID NO: 246277 - protein, 9 aa, West Nile virus
DWDFVITTD

SEQ ID NO: 246278 - protein, 9 aa, West Nile virus
WDFVITTDI

SEQ ID NO: 246279 - protein, 9 aa, West Nile virus
DFVITTDIS

SEQ ID NO: 246280 - protein, 9 aa, West Nile virus
FVITTDISE

SEQ ID NO: 246281 - protein, 9 aa, West Nile virus
ISEMGANFG

SEQ ID NO: 246282 - protein, 9 aa, West Nile virus
SEMGANFGA

SEQ ID NO: 246283 - protein, 9 aa, West Nile virus
RVIDSRKSV

SEQ ID NO: 246284 - protein, 9 aa, West Nile virus
VIDSRKSVK

SEQ ID NO: 246285 - protein, 9 aa, West Nile virus
IDSRKSVKP

SEQ ID NO: 246286 - protein, 9 aa, West Nile virus
DSRKSVKPT

SEQ ID NO: 246287 - protein, 9 aa, West Nile virus
SRKSVKPTI

SEQ ID NO: 246288 - protein, 9 aa, West Nile virus
RKSVKPTII

SEQ ID NO: 246289 - protein, 9 aa, West Nile virus
QRRGRVGRQ

SEQ ID NO: 246290 - protein, 9 aa, West Nile virus
WTEARIMLD

SEQ ID NO: 246291 - protein, 9 aa, West Nile virus
EAKIMLDNI

SEQ ID NO: 246292 - protein, 9 aa, West Nile virus
DGEFRLRGE

SEQ ID NO: 246293 - protein, 9 aa, West Nile virus
LLTHCDFTP

SEQ ID NO: 246294 - protein, 9 aa, West Nile virus
LTHCDFTPW

SEQ ID NO: 246295 - protein, 9 aa, West Nile virus
THCDFTPWL

SEQ ID NO: 246296 - protein, 9 aa, West Nile virus
TADLPVWLA

SEQ ID NO: 246297 - protein, 9 aa, West Nile virus
VLIPEPEKQ

SEQ ID NO: 246298 - protein, 9 aa, West Nile virus
LQPEAGKQR

SEQ ID NO: 246299 - protein, 9 aa, West Nile virus
IPEPEKQRS

SEQ ID NO: 246300 - protein, 9 aa, West Nile virus
PEPEKQRSQ

SEQ ID NO: 246301 - protein, 9 aa, West Nile virus
EPEKQRSQT

SEQ ID NO: 246302 - protein, 9 aa, West Nile virus
PEKQRSQTD

SEQ ID NO: 246303 - protein, 9 aa, West Nile virus
EKQRSQTDN

SEQ ID NO: 246304 - protein, 9 aa, West Nile virus
KQRSQTDNQ

SEQ ID NO: 246305 - protein, 9 aa, West Nile virus
QRSSDDNKL

SEQ ID NO: 246306 - protein, 9 aa, West Nile virus
RSQTDNQLA

SEQ ID NO: 246307 - protein, 9 aa, West Nile virus
PATAWALYG

SEQ ID NO: 246308 - protein, 9 aa, West Nile virus
ATAWALYGG

SEQ ID NO: 246309 - protein, 9 aa, West Nile virus
TAWALYGGS

SEQ ID NO: 246310 - protein, 9 aa, West Nile virus
AWALYGGST

SEQ ID NO: 246311 - protein, 9 aa, West Nile virus
WALYGGSTV

SEQ ID NO: 246312 - protein, 9 aa, West Nile virus
HYGYMLPGW

SEQ ID NO: 246313 - protein, 9 aa, West Nile virus
YGYMLPGWQ

SEQ ID NO: 246314 - protein, 9 aa, West Nile virus
GYMLPGWQA

SEQ ID NO: 246315 - protein, 9 aa, West Nile virus
YMLPGWQAE

SEQ ID NO: 246316 - protein, 9 aa, West Nile virus
MLPGWQAEA

SEQ ID NO: 246317 - protein, 9 aa, West Nile virus
LPGWQAEAL

SEQ ID NO: 246318 - protein, 9 aa, West Nile virus
PGWQAEALR

SEQ ID NO: 246319 - protein, 9 aa, West Nile virus
GWQAEALRA

SEQ ID NO: 246320 - protein, 9 aa, West Nile virus
WQAEALRAA

SEQ ID NO: 246321 - protein, 9 aa, West Nile virus
QAEALRAAQ

SEQ ID NO: 246322 - protein, 9 aa, West Nile virus
AEALRAAQR

SEQ ID NO: 246323 - protein, 9 aa, West Nile virus
EALRAAQRR

SEQ ID NO: 246324 - protein, 9 aa, West Nile virus
RSAQRRTAA

SEQ ID NO: 246325 - protein, 9 aa, West Nile virus
SAQRRTAAG

SEQ ID NO: 246326 - protein, 9 aa, West Nile virus
AQRRTAAGI

SEQ ID NO: 246327 - protein, 9 aa, West Nile virus
QRRTAAGIM

SEQ ID NO: 246328 - protein, 9 aa, West Nile virus
RRTAAGIMK

SEQ ID NO: 246329 - protein, 9 aa, West Nile virus
VFFSAMVRN

SEQ ID NO: 246330 - protein, 9 aa, West Nile virus
TAAGIMKNA

SEQ ID NO: 246331 - protein, 9 aa, West Nile virus
FSAMVRNPM

SEQ ID NO: 246332 - protein, 9 aa, West Nile virus
SAMVRNPMV

SEQ ID NO: 246333 - protein, 9 aa, West Nile virus
AMVRNPMVD

SEQ ID NO: 246334 - protein, 9 aa, West Nile virus
MVRNPMVDG

SEQ ID NO: 246335 - protein, 9 aa, West Nile virus
MQKKVGQIM

SEQ ID NO: 246336 - protein, 9 aa, West Nile virus
SSVWNATTA

SEQ ID NO: 246337 - protein, 9 aa, West Nile virus
SVWNATTAI

SEQ ID NO: 246338 - protein, 9 aa, West Nile virus
VWNSTTATG

SEQ ID NO: 246339 - protein, 9 aa, West Nile virus
CHVMRGSYL

SEQ ID NO: 246340 - protein, 9 aa, West Nile virus
HVMRGSYLA

SEQ ID NO: 246341 - protein, 9 aa, West Nile virus
VMRGSYLAG

SEQ ID NO: 246342 - protein, 9 aa, West Nile virus
MRGSYLAGG

SEQ ID NO: 246343 - protein, 9 aa, West Nile virus
RGSYLAGGS

SEQ ID NO: 246344 - protein, 9 aa, West Nile virus
GSYLAGGSI

SEQ ID NO: 246345 - protein, 9 aa, West Nile virus
GRTLGEQWK

SEQ ID NO: 246346 - protein, 9 aa, West Nile virus
PVSRGTAKL

SEQ ID NO: 246347 - protein, 9 aa, West Nile virus
VSRGSAKLQ

SEQ ID NO: 246348 - protein, 9 aa, West Nile virus
SRGSAKLQW

SEQ ID NO: 246349 - protein, 9 aa, West Nile virus
GRVIDLGCG

SEQ ID NO: 246350 - protein, 9 aa, West Nile virus
RVIDLGCGR

SEQ ID NO: 246351 - protein, 9 aa, West Nile virus
VMDLGCGRG

SEQ ID NO: 246352 - protein, 9 aa, West Nile virus
MDLGCGRGG

SEQ ID NO: 246353 - protein, 9 aa, West Nile virus
GRGGWSYYM

SEQ ID NO: 246354 - protein, 9 aa, West Nile virus
EVRGYTKGG

SEQ ID NO: 246355 - protein, 9 aa, West Nile virus
GYTKGGAGH

SEQ ID NO: 246356 - protein, 9 aa, West Nile virus
TLGRDGHEK

SEQ ID NO: 246357 - protein, 9 aa, West Nile virus
LGRDGHEKP

SEQ ID NO: 246358 - protein, 9 aa, West Nile virus
SDTLFCDIG

SEQ ID NO: 246359 - protein, 9 aa, West Nile virus
DTIMCDIGE

SEQ ID NO: 246360 - protein, 9 aa, West Nile virus
TIMCDIGES

SEQ ID NO: 246361 - protein, 9 aa, West Nile virus
IMCDIGESN

SEQ ID NO: 246362 - protein, 9 aa, West Nile virus
FCDIGESSP

SEQ ID NO: 246363 - protein, 9 aa, West Nile virus
CDIGESSSS

SEQ ID NO: 246364 - protein, 9 aa, West Nile virus
LVRLPLSRN

SEQ ID NO: 246365 - protein, 9 aa, West Nile virus
VRLPLSRNS

SEQ ID NO: 246366 - protein, 9 aa, West Nile virus
RLPLSRNSN

SEQ ID NO: 246367 - protein, 9 aa, West Nile virus
LPLSRNSNH

SEQ ID NO: 246368 - protein, 9 aa, West Nile virus
PFSRNSTHE

SEQ ID NO: 246369 - protein, 9 aa, West Nile virus
FSRNSTHEM

SEQ ID NO: 246370 - protein, 9 aa, West Nile virus
RNSTHEMYY

SEQ ID NO: 246371 - protein, 9 aa, West Nile virus
NSNHEMYWV

SEQ ID NO: 246372 - protein, 9 aa, West Nile virus
SNHEMYWVS

SEQ ID NO: 246373 - protein, 9 aa, West Nile virus
PYRTWAYHG

SEQ ID NO: 246374 - protein, 9 aa, West Nile virus
YRTWAYHGS

SEQ ID NO: 246375 - protein, 9 aa, West Nile virus
RTWAYHGSY

SEQ ID NO: 246376 - protein, 9 aa, West Nile virus
TWTYHGSYE

SEQ ID NO: 246377 - protein, 9 aa, West Nile virus
GSASSLVNG

SEQ ID NO: 246378 - protein, 9 aa, West Nile virus
SASSLVNGV

SEQ ID NO: 246379 - protein, 9 aa, West Nile virus
ASSLVNGVV

SEQ ID NO: 246380 - protein, 9 aa, West Nile virus
NGVVRLLSK

SEQ ID NO: 246381 - protein, 9 aa, West Nile virus
GVVRLLSKP

SEQ ID NO: 246382 - protein, 9 aa, West Nile virus
VVRLLSKPW

SEQ ID NO: 246383 - protein, 9 aa, West Nile virus
VRLLSKPWD

SEQ ID NO: 246384 - protein, 9 aa, West Nile virus
LAMTDTTPF

SEQ ID NO: 246385 - protein, 9 aa, West Nile virus
FKEKVDTRA

SEQ ID NO: 246386 - protein, 9 aa, West Nile virus
KEKVDTKAP

SEQ ID NO: 246387 - protein, 9 aa, West Nile virus
TCIYNMMGK

SEQ ID NO: 246388 - protein, 9 aa, West Nile virus
MGKREKKLS

SEQ ID NO: 246389 - protein, 9 aa, West Nile virus
GKREKKLSE

SEQ ID NO: 246390 - protein, 9 aa, West Nile virus
KREKKLSEF

SEQ ID NO: 246391 - protein, 9 aa, West Nile virus
REKKLSEFG

SEQ ID NO: 246392 - protein, 9 aa, West Nile virus
EKKLGEFGR

SEQ ID NO: 246393 - protein, 9 aa, West Nile virus
KKLGEFGRA

SEQ ID NO: 246394 - protein, 9 aa, West Nile virus
KLGEFGRAK

SEQ ID NO: 246395 - protein, 9 aa, West Nile virus
LGEFGRAKG

SEQ ID NO: 246396 - protein, 9 aa, West Nile virus
GEFGVAKGS

SEQ ID NO: 246397 - protein, 9 aa, West Nile virus
EFGVAKGSR

SEQ ID NO: 246398 - protein, 9 aa, West Nile virus
FGVAKGSRA

SEQ ID NO: 246399 - protein, 9 aa, West Nile virus
GVAKGSRAI

SEQ ID NO: 246400 - protein, 9 aa, West Nile virus
VAKGSRAIW

SEQ ID NO: 246401 - protein, 9 aa, West Nile virus
AIWYMWLGS

SEQ ID NO: 246402 - protein, 9 aa, West Nile virus
IWYMWLGSR

SEQ ID NO: 246403 - protein, 9 aa, West Nile virus
WFMWLGARF

SEQ ID NO: 246404 - protein, 9 aa, West Nile virus
FMWLGARFL

SEQ ID NO: 246405 - protein, 9 aa, West Nile virus
MWLGSRFLE

SEQ ID NO: 246406 - protein, 9 aa, West Nile virus
WLGSRFLEF

SEQ ID NO: 246407 - protein, 9 aa, West Nile virus
LGSRFLEFE

SEQ ID NO: 246408 - protein, 9 aa, West Nile virus
GSRFLEFEA

SEQ ID NO: 246409 - protein, 9 aa, West Nile virus
SRFLEFEAL

SEQ ID NO: 246410 - protein, 9 aa, West Nile virus
GFLNEDHWL

SEQ ID NO: 246411 - protein, 9 aa, West Nile virus
FYADDTAGW

SEQ ID NO: 246412 - protein, 9 aa, West Nile virus
IMQKAYHAK

SEQ ID NO: 246413 - protein, 9 aa, West Nile virus
MQKAYHAKV

SEQ ID NO: 246414 - protein, 9 aa, West Nile virus
QKAYHAKVV

SEQ ID NO: 246415 - protein, 9 aa, West Nile virus
LTYRHKVVK

SEQ ID NO: 246416 - protein, 9 aa, West Nile virus
TYRHKVVKV

SEQ ID NO: 246417 - protein, 9 aa, West Nile virus
HKVVKVMRP

SEQ ID NO: 246418 - protein, 9 aa, West Nile virus
MDIISRRDQ

SEQ ID NO: 246419 - protein, 9 aa, West Nile virus
DIISRRDQR

SEQ ID NO: 246420 - protein, 9 aa, West Nile virus
IISRRDQRG

SEQ ID NO: 246421 - protein, 9 aa, West Nile virus
ISREDQRGS

SEQ ID NO: 246422 - protein, 9 aa, West Nile virus
SREDQRGSG

SEQ ID NO: 246423 - protein, 9 aa, West Nile virus
REDQRGSGQ

SEQ ID NO: 246424 - protein, 9 aa, West Nile virus
EDQRGSGQV

SEQ ID NO: 246425 - protein, 9 aa, West Nile virus
GSGQVVTYG

SEQ ID NO: 246426 - protein, 9 aa, West Nile virus
SGQVVTYGL

SEQ ID NO: 246427 - protein, 9 aa, West Nile virus
GQVVTYGLN

SEQ ID NO: 246428 - protein, 9 aa, West Nile virus
QVVTYGLNT

SEQ ID NO: 246429 - protein, 9 aa, West Nile virus
RMLVSGDDC

SEQ ID NO: 246430 - protein, 9 aa, West Nile virus
MLVSGDDCV

SEQ ID NO: 246431 - protein, 9 aa, West Nile virus
LVSGDDCVV

SEQ ID NO: 246432 - protein, 9 aa, West Nile virus
VSGDDCVVR

SEQ ID NO: 246433 - protein, 9 aa, West Nile virus
LNAMSKVRK

SEQ ID NO: 246434 - protein, 9 aa, West Nile virus
NAMSKVRKD

SEQ ID NO: 246435 - protein, 9 aa, West Nile virus
AMSKVRKDI

SEQ ID NO: 246436 - protein, 9 aa, West Nile virus
NWQEVPFCS

SEQ ID NO: 246437 - protein, 9 aa, West Nile virus
EVPFCSHHF

SEQ ID NO: 246438 - protein, 9 aa, West Nile virus
VPFCSNHFQ

SEQ ID NO: 246439 - protein, 9 aa, West Nile virus
PFCSNHFTE

SEQ ID NO: 246440 - protein, 9 aa, West Nile virus
FCSNHFTEL

SEQ ID NO: 246441 - protein, 9 aa, West Nile virus
VPCRGQDEL

SEQ ID NO: 246442 - protein, 9 aa, West Nile virus
QDELIGRGR

SEQ ID NO: 246443 - protein, 9 aa, West Nile virus
DELVGRARI

SEQ ID NO: 246444 - protein, 9 aa, West Nile virus
ELVGRARIS

SEQ ID NO: 246445 - protein, 9 aa, West Nile virus
GRARISPGA

SEQ ID NO: 246446 - protein, 9 aa, West Nile virus
RARISPGAG

SEQ ID NO: 246447 - protein, 9 aa, West Nile virus
ARISPGAGW

SEQ ID NO: 246448 - protein, 9 aa, West Nile virus
RISPGAGWN

SEQ ID NO: 246449 - protein, 9 aa, West Nile virus
ISPGAGWNV

SEQ ID NO: 246450 - protein, 9 aa, West Nile virus
DTACLAKSY

SEQ ID NO: 246451 - protein, 9 aa, West Nile virus
TACLAKSYA

SEQ ID NO: 246452 - protein, 9 aa, West Nile virus
ACLAKSYAQ

SEQ ID NO: 246453 - protein, 9 aa, West Nile virus
CLAKSYAQM

SEQ ID NO: 246454 - protein, 9 aa, West Nile virus
LSYFHRRDL

SEQ ID NO: 246455 - protein, 9 aa, West Nile virus
SYFHRRDLR

SEQ ID NO: 246456 - protein, 9 aa, West Nile virus
YFHKRDMRL

SEQ ID NO: 246457 - protein, 9 aa, West Nile virus
FHRRDLRTL

SEQ ID NO: 246458 - protein, 9 aa, West Nile virus
HRRDLRLMA

SEQ ID NO: 246459 - protein, 9 aa, West Nile virus
SMAICSAVP

SEQ ID NO: 246460 - protein, 9 aa, West Nile virus
PTGRTSWSI

SEQ ID NO: 246461 - protein, 9 aa, West Nile virus
TGRTSWSIH

SEQ ID NO: 246462 - protein, 9 aa, West Nile virus
GRTSWSIHS

SEQ ID NO: 246463 - protein, 9 aa, West Nile virus
GEWMTTEDM

SEQ ID NO: 246464 - protein, 9 aa, West Nile virus
AWMTTEDML

SEQ ID NO: 246465 - protein, 9 aa, West Nile virus
GKREDLWCG

SEQ ID NO: 246466 - protein, 9 aa, West Nile virus
KREDLWCGS

SEQ ID NO: 246467 - protein, 9 aa, West Nile virus
REDLWCGSL

SEQ ID NO: 246468 - protein, 9 aa, West Nile virus
EDLWCGSLI

SEQ ID NO: 246469 - protein, 9 aa, West Nile virus
DLWCGSLIG

SEQ ID NO: 246470 - protein, 9 aa, West Nile virus
LWCGSLIGL

SEQ ID NO: 246471 - protein, 9 aa, West Nile virus
WCGSLIGLS

SEQ ID NO: 246472 - protein, 9 aa, West Nile virus
QGLVKRFST

SEQ ID NO: 246473 - protein, 9 aa, West Nile virus
GLVKRFSTG

SEQ ID NO: 246474 - protein, 9 aa, West Nile virus
LVKRFSTGL

SEQ ID NO: 246475 - protein, 9 aa, West Nile virus
VKRFSTGLF

SEQ ID NO: 246476 - protein, 9 aa, West Nile virus
DPEDVDCWC

SEQ ID NO: 246477 - protein, 9 aa, West Nile virus
VLEGDSCLT

SEQ ID NO: 246478 - protein, 9 aa, West Nile virus
CGLFGKGGV

SEQ ID NO: 246479 - protein, 9 aa, West Nile virus
SGEENAVGN

SEQ ID NO: 246480 - protein, 9 aa, West Nile virus
NLGDQTGVL

SEQ ID NO: 246481 - protein, 9 aa, West Nile virus
LGDQTGVLL

SEQ ID NO: 246482 - protein, 9 aa, West Nile virus
QLPPGDNII

SEQ ID NO: 246483 - protein, 9 aa, West Nile virus
GIERLTVIG

SEQ ID NO: 246484 - protein, 9 aa, West Nile virus
RLTVIGEHA

SEQ ID NO: 246485 - protein, 9 aa, West Nile virus
LTVIGEHAW

SEQ ID NO: 246486 - protein, 9 aa, West Nile virus
TVIGEHAWD

SEQ ID NO: 246487 - protein, 9 aa, West Nile virus
VIGEHAWDF

SEQ ID NO: 246488 - protein, 9 aa, West Nile virus
MGDTAWDFS

SEQ ID NO: 246489 - protein, 9 aa, West Nile virus
GDTAWDFSS

SEQ ID NO: 246490 - protein, 9 aa, West Nile virus
HAWDFGSTG

SEQ ID NO: 246491 - protein, 9 aa, West Nile virus
AWDFGSTGG

SEQ ID NO: 246492 - protein, 9 aa, West Nile virus
ELRCGEGLV

SEQ ID NO: 246493 - protein, 9 aa, West Nile virus
VSEWYDNYA

SEQ ID NO: 246494 - protein, 9 aa, West Nile virus
SAHGSPTFW

SEQ ID NO: 246495 - protein, 9 aa, West Nile virus
AHGSPTFWM

SEQ ID NO: 246496 - protein, 9 aa, West Nile virus
HGSPTFWMG

SEQ ID NO: 246497 - protein, 9 aa, West Nile virus
TDQSLWMKS

SEQ ID NO: 246498 - protein, 9 aa, West Nile virus
WPASHTIDN

SEQ ID NO: 246499 - protein, 9 aa, West Nile virus
PASHTIDNA

SEQ ID NO: 246500 - protein, 9 aa, West Nile virus
WCCRTCTLP

SEQ ID NO: 246501 - protein, 9 aa, West Nile virus
CCRTCTLPP

SEQ ID NO: 246502 - protein, 9 aa, West Nile virus
CRSCTMPPV

SEQ ID NO: 246503 - protein, 9 aa, West Nile virus
RSCTMPPVS

SEQ ID NO: 246504 - protein, 9 aa, West Nile virus
TGTDCWYAM

SEQ ID NO: 246505 - protein, 9 aa, West Nile virus
GTDCWYAME

SEQ ID NO: 246506 - protein, 9 aa, West Nile virus
TDCWYAMEI

SEQ ID NO: 246507 - protein, 9 aa, West Nile virus
VLHTMWHVT

SEQ ID NO: 246508 - protein, 9 aa, West Nile virus
LHTMWHVTR

SEQ ID NO: 246509 - protein, 9 aa, West Nile virus
TLWHTTRGA

SEQ ID NO: 246510 - protein, 9 aa, West Nile virus
LWHTTRGAA

SEQ ID NO: 246511 - protein, 9 aa, West Nile virus
WHTTRGAAI

SEQ ID NO: 246512 - protein, 9 aa, West Nile virus
GLYGNGLKT

SEQ ID NO: 246513 - protein, 9 aa, West Nile virus
ITVLDMHPG

SEQ ID NO: 246514 - protein, 9 aa, West Nile virus
LDLHPGSGK

SEQ ID NO: 246515 - protein, 9 aa, West Nile virus
MHPGSGKTH

SEQ ID NO: 246516 - protein, 9 aa, West Nile virus
TRVVLKEME

SEQ ID NO: 246517 - protein, 9 aa, West Nile virus
RVVLKEMER

SEQ ID NO: 246518 - protein, 9 aa, West Nile virus
VVLKEMERA

SEQ ID NO: 246519 - protein, 9 aa, West Nile virus
VLKEMERAL

SEQ ID NO: 246520 - protein, 9 aa, West Nile virus
GGAIVDVMC

SEQ ID NO: 246521 - protein, 9 aa, West Nile virus
GAIVDVMCH

SEQ ID NO: 246522 - protein, 9 aa, West Nile virus
EVIDAMCHA

SEQ ID NO: 246523 - protein, 9 aa, West Nile virus
IDAMCHATL

SEQ ID NO: 246524 - protein, 9 aa, West Nile virus
VMCHATYVN

SEQ ID NO: 246525 - protein, 9 aa, West Nile virus
MCHATYVNR

SEQ ID NO: 246526 - protein, 9 aa, West Nile virus
CHATYVNRR

SEQ ID NO: 246527 - protein, 9 aa, West Nile virus
HATYVNRRL

SEQ ID NO: 246528 - protein, 9 aa, West Nile virus
ATYVNRRLL

SEQ ID NO: 246529 - protein, 9 aa, West Nile virus
TYVNRRLLP

SEQ ID NO: 246530 - protein, 9 aa, West Nile virus
DEAHFLDPA

SEQ ID NO: 246531 - protein, 9 aa, West Nile virus
EAHFLDPAS

SEQ ID NO: 246532 - protein, 9 aa, West Nile virus
AHWTDPHSI

SEQ ID NO: 246533 - protein, 9 aa, West Nile virus
HWTDPHSIA

SEQ ID NO: 246534 - protein, 9 aa, West Nile virus
WTDPHSIAA

SEQ ID NO: 246535 - protein, 9 aa, West Nile virus
TDPHSIAAR

SEQ ID NO: 246536 - protein, 9 aa, West Nile virus
DPHSIAARG

SEQ ID NO: 246537 - protein, 9 aa, West Nile virus
PHSIAARGH

SEQ ID NO: 246538 - protein, 9 aa, West Nile virus
HSIAARGHL

SEQ ID NO: 246539 - protein, 9 aa, West Nile virus
SIAARGHLY

SEQ ID NO: 246540 - protein, 9 aa, West Nile virus
IAARGHLYT

SEQ ID NO: 246541 - protein, 9 aa, West Nile virus
AARGHLYTL

SEQ ID NO: 246542 - protein, 9 aa, West Nile virus
ARGHLYTLA

SEQ ID NO: 246543 - protein, 9 aa, West Nile virus
RGYIATKVE

SEQ ID NO: 246544 - protein, 9 aa, West Nile virus
TLAKENKCA

SEQ ID NO: 246545 - protein, 9 aa, West Nile virus
ENKCALVLM

SEQ ID NO: 246546 - protein, 9 aa, West Nile virus
NESATILMT

SEQ ID NO: 246547 - protein, 9 aa, West Nile virus
ESATILMTA

SEQ ID NO: 246548 - protein, 9 aa, West Nile virus
SATILMTAT

SEQ ID NO: 246549 - protein, 9 aa, West Nile virus
ATILMTATP

SEQ ID NO: 246550 - protein, 9 aa, West Nile virus
LMTATPPGK

SEQ ID NO: 246551 - protein, 9 aa, West Nile virus
RPTAWFLPS

SEQ ID NO: 246552 - protein, 9 aa, West Nile virus
RTAWFVPSI

SEQ ID NO: 246553 - protein, 9 aa, West Nile virus
TAWFVPSIA

SEQ ID NO: 246554 - protein, 9 aa, West Nile virus
VICLNSKTF

SEQ ID NO: 246555 - protein, 9 aa, West Nile virus
KPDFVVTTD

SEQ ID NO: 246556 - protein, 9 aa, West Nile virus
PDFVVTTDI

SEQ ID NO: 246557 - protein, 9 aa, West Nile virus
ISEMGANLD

SEQ ID NO: 246558 - protein, 9 aa, West Nile virus
SEMGANLDV

SEQ ID NO: 246559 - protein, 9 aa, West Nile virus
RVIDCRKSV

SEQ ID NO: 246560 - protein, 9 aa, West Nile virus
VIDCRKSVK

SEQ ID NO: 246561 - protein, 9 aa, West Nile virus
IDCRKSVKP

SEQ ID NO: 246562 - protein, 9 aa, West Nile virus
DCRKSVKPT

SEQ ID NO: 246563 - protein, 9 aa, West Nile virus
CRKSVKPTI

SEQ ID NO: 246564 - protein, 9 aa, West Nile virus
RKSVKPTIL

SEQ ID NO: 246565 - protein, 9 aa, West Nile virus
WTEAKIMLD

SEQ ID NO: 246566 - protein, 9 aa, West Nile virus
EAQILLDNI

SEQ ID NO: 246567 - protein, 9 aa, West Nile virus
AGHFRLTEE

SEQ ID NO: 246568 - protein, 9 aa, West Nile virus
LVRNCDLPV

SEQ ID NO: 246569 - protein, 9 aa, West Nile virus
VRNCDLPVW

SEQ ID NO: 246570 - protein, 9 aa, West Nile virus
RNCDLPVWL

SEQ ID NO: 246571 - protein, 9 aa, West Nile virus
HCDFTPWLA

SEQ ID NO: 246572 - protein, 9 aa, West Nile virus
VLQPEAGKQ

SEQ ID NO: 246573 - protein, 9 aa, West Nile virus
VIPEPGQQR

SEQ ID NO: 246574 - protein, 9 aa, West Nile virus
QPEAGKQRS

SEQ ID NO: 246575 - protein, 9 aa, West Nile virus
PEAGKQRSS

SEQ ID NO: 246576 - protein, 9 aa, West Nile virus
EAGKQRSSD

SEQ ID NO: 246577 - protein, 9 aa, West Nile virus
AGKQRSSDD

SEQ ID NO: 246578 - protein, 9 aa, West Nile virus
GKQRSSDDN

SEQ ID NO: 246579 - protein, 9 aa, West Nile virus
KQRSSDDNK

SEQ ID NO: 246580 - protein, 9 aa, West Nile virus
RTPQDNQLI

SEQ ID NO: 246581 - protein, 9 aa, West Nile virus
PARSWGTYV

SEQ ID NO: 246582 - protein, 9 aa, West Nile virus
ARSWGTYVL

SEQ ID NO: 246583 - protein, 9 aa, West Nile virus
RSWGTYVLV

SEQ ID NO: 246584 - protein, 9 aa, West Nile virus
SWGTYVLVV

SEQ ID NO: 246585 - protein, 9 aa, West Nile virus
WGTYVLVVS

SEQ ID NO: 246586 - protein, 9 aa, West Nile virus
HLAIVVSGL

SEQ ID NO: 246587 - protein, 9 aa, West Nile virus
LAIVVSGLE

SEQ ID NO: 246588 - protein, 9 aa, West Nile virus
AIVVSGLEA

SEQ ID NO: 246589 - protein, 9 aa, West Nile virus
IVVSGLEAE

SEQ ID NO: 246590 - protein, 9 aa, West Nile virus
VVSGLEAEL

SEQ ID NO: 246591 - protein, 9 aa, West Nile virus
VSGLEAELT

SEQ ID NO: 246592 - protein, 9 aa, West Nile virus
SGLEAELTQ

SEQ ID NO: 246593 - protein, 9 aa, West Nile virus
GLEAELTQR

SEQ ID NO: 246594 - protein, 9 aa, West Nile virus
LEAELTQRA

SEQ ID NO: 246595 - protein, 9 aa, West Nile virus
EAELTQRAH

SEQ ID NO: 246596 - protein, 9 aa, West Nile virus
AELTQRAHK

SEQ ID NO: 246597 - protein, 9 aa, West Nile virus
ELTQRAHKV

SEQ ID NO: 246598 - protein, 9 aa, West Nile virus
RAAQRRTAA

SEQ ID NO: 246599 - protein, 9 aa, West Nile virus
AAQRRTAAG

SEQ ID NO: 246600 - protein, 9 aa, West Nile virus
AHKVFFSAM

SEQ ID NO: 246601 - protein, 9 aa, West Nile virus
HKVFFSAMV

SEQ ID NO: 246602 - protein, 9 aa, West Nile virus
KVFFSAMVR

SEQ ID NO: 246603 - protein, 9 aa, West Nile virus
FFSAMVRNP

SEQ ID NO: 246604 - protein, 9 aa, West Nile virus
FHGVAKNPV

SEQ ID NO: 246605 - protein, 9 aa, West Nile virus
AGIMKNPTI

SEQ ID NO: 246606 - protein, 9 aa, West Nile virus
GIMKNPTID

SEQ ID NO: 246607 - protein, 9 aa, West Nile virus
IMKNPTIDG

SEQ ID NO: 246608 - protein, 9 aa, West Nile virus
MQKKVGQVL

SEQ ID NO: 246609 - protein, 9 aa, West Nile virus
SAVWNSTTA

SEQ ID NO: 246610 - protein, 9 aa, West Nile virus
AVWNSTTAT

SEQ ID NO: 246611 - protein, 9 aa, West Nile virus
LWTMPVACG

SEQ ID NO: 246612 - protein, 9 aa, West Nile virus
SGVVRGSLW

SEQ ID NO: 246613 - protein, 9 aa, West Nile virus
GVVRGSLWG

SEQ ID NO: 246614 - protein, 9 aa, West Nile virus
VVRGSLWGF

SEQ ID NO: 246615 - protein, 9 aa, West Nile virus
VRGSLWGFL

SEQ ID NO: 246616 - protein, 9 aa, West Nile virus
RGSLWGFLP

SEQ ID NO: 246617 - protein, 9 aa, West Nile virus
GSLWGFLPL

SEQ ID NO: 246618 - protein, 9 aa, West Nile virus
GDTLGDLWK

SEQ ID NO: 246619 - protein, 9 aa, West Nile virus
AVSRGSSKI

SEQ ID NO: 246620 - protein, 9 aa, West Nile virus
VSRGSSKIR

SEQ ID NO: 246621 - protein, 9 aa, West Nile virus
SRGSSKIRW

SEQ ID NO: 246622 - protein, 9 aa, West Nile virus
GEVVDLGCG

SEQ ID NO: 246623 - protein, 9 aa, West Nile virus
EVVDLGCGR

SEQ ID NO: 246624 - protein, 9 aa, West Nile virus
GRGGWSYYA

SEQ ID NO: 246625 - protein, 9 aa, West Nile virus
GVKGFTLGR

SEQ ID NO: 246626 - protein, 9 aa, West Nile virus
AYTIGGKGH

SEQ ID NO: 246627 - protein, 9 aa, West Nile virus
TIGGKGHET

SEQ ID NO: 246628 - protein, 9 aa, West Nile virus
IGGKGHETP

SEQ ID NO: 246629 - protein, 9 aa, West Nile virus
ADTIMCDIG

SEQ ID NO: 246630 - protein, 9 aa, West Nile virus
MCDIGESNP

SEQ ID NO: 246631 - protein, 9 aa, West Nile virus
CDIGESSSN

SEQ ID NO: 246632 - protein, 9 aa, West Nile virus
LVRTPFSRN

SEQ ID NO: 246633 - protein, 9 aa, West Nile virus
VRTPFSRNS

SEQ ID NO: 246634 - protein, 9 aa, West Nile virus
RTPFSRNST

SEQ ID NO: 246635 - protein, 9 aa, West Nile virus
TPFSRNSTH

SEQ ID NO: 246636 - protein, 9 aa, West Nile virus
NSTHEMYYS

SEQ ID NO: 246637 - protein, 9 aa, West Nile virus
STHEMYYST

SEQ ID NO: 246638 - protein, 9 aa, West Nile virus
PYRTWTYHG

SEQ ID NO: 246639 - protein, 9 aa, West Nile virus
YRTWTYHGS

SEQ ID NO: 246640 - protein, 9 aa, West Nile virus
RTWTYHGSY

SEQ ID NO: 246641 - protein, 9 aa, West Nile virus
TWQYWGSYR

SEQ ID NO: 246642 - protein, 9 aa, West Nile virus
GSAASLING

SEQ ID NO: 246643 - protein, 9 aa, West Nile virus
SAASLINGV

SEQ ID NO: 246644 - protein, 9 aa, West Nile virus
AASLINGVV

SEQ ID NO: 246645 - protein, 9 aa, West Nile virus
NGVVKLMSK

SEQ ID NO: 246646 - protein, 9 aa, West Nile virus
GVVKLMSKP

SEQ ID NO: 246647 - protein, 9 aa, West Nile virus
VVKLMSKPW

SEQ ID NO: 246648 - protein, 9 aa, West Nile virus
VKLMSKPWD

SEQ ID NO: 246649 - protein, 9 aa, West Nile virus
MAMTDTTAF

SEQ ID NO: 246650 - protein, 9 aa, West Nile virus
KEKVDTRAK

SEQ ID NO: 246651 - protein, 9 aa, West Nile virus
HCVYNMMGK

SEQ ID NO: 246652 - protein, 9 aa, West Nile virus
EKKLGEFGV

SEQ ID NO: 246653 - protein, 9 aa, West Nile virus
KKLGEFGVA

SEQ ID NO: 246654 - protein, 9 aa, West Nile virus
KLGEFGVAK

SEQ ID NO: 246655 - protein, 9 aa, West Nile virus
LGEFGVAKG

SEQ ID NO: 246656 - protein, 9 aa, West Nile virus
SEFGKAKGS

SEQ ID NO: 246657 - protein, 9 aa, West Nile virus
WFMWLGARY

SEQ ID NO: 246658 - protein, 9 aa, West Nile virus
FMWLGARYL

SEQ ID NO: 246659 - protein, 9 aa, West Nile virus
GFLNEDHWA

SEQ ID NO: 246660 - protein, 9 aa, West Nile virus
VMEMTYKNK

SEQ ID NO: 246661 - protein, 9 aa, West Nile virus
MEMTYKNKV

SEQ ID NO: 246662 - protein, 9 aa, West Nile virus
EMTYKNKVV

SEQ ID NO: 246663 - protein, 9 aa, West Nile virus
KAYHAKVVK

SEQ ID NO: 246664 - protein, 9 aa, West Nile virus
AYHAKVVKV

SEQ ID NO: 246665 - protein, 9 aa, West Nile virus
NKVVKVLRP

SEQ ID NO: 246666 - protein, 9 aa, West Nile virus
MDVISREDQ

SEQ ID NO: 246667 - protein, 9 aa, West Nile virus
DVISREDQR

SEQ ID NO: 246668 - protein, 9 aa, West Nile virus
VISREDQRG

SEQ ID NO: 246669 - protein, 9 aa, West Nile virus
ITRRDQRGS

SEQ ID NO: 246670 - protein, 9 aa, West Nile virus
TRRDQRGSG

SEQ ID NO: 246671 - protein, 9 aa, West Nile virus
LNDMAKTRK

SEQ ID NO: 246672 - protein, 9 aa, West Nile virus
NDMAKTRKD

SEQ ID NO: 246673 - protein, 9 aa, West Nile virus
DMAKTRKDI

SEQ ID NO: 246674 - protein, 9 aa, West Nile virus
DWENVPFCS

SEQ ID NO: 246675 - protein, 9 aa, West Nile virus
NVPFCSHHF

SEQ ID NO: 246676 - protein, 9 aa, West Nile virus
PFCSHHFHK

SEQ ID NO: 246677 - protein, 9 aa, West Nile virus
FCSHHFHKI

SEQ ID NO: 246678 - protein, 9 aa, West Nile virus
VPCRDQDEL

SEQ ID NO: 246679 - protein, 9 aa, West Nile virus
DELIGRGRV

SEQ ID NO: 246680 - protein, 9 aa, West Nile virus
ELIGRGRVS

SEQ ID NO: 246681 - protein, 9 aa, West Nile virus
GRGRVSPGN

SEQ ID NO: 246682 - protein, 9 aa, West Nile virus
RGRVSPGNG

SEQ ID NO: 246683 - protein, 9 aa, West Nile virus
GRVSPGNGW

SEQ ID NO: 246684 - protein, 9 aa, West Nile virus
RVSPGNGWM

SEQ ID NO: 246685 - protein, 9 aa, West Nile virus
VSPGNGWMI

SEQ ID NO: 246686 - protein, 9 aa, West Nile virus
DTACLAKAY

SEQ ID NO: 246687 - protein, 9 aa, West Nile virus
TACLAKAYA

SEQ ID NO: 246688 - protein, 9 aa, West Nile virus
ACLAKAYAQ

SEQ ID NO: 246689 - protein, 9 aa, West Nile virus
CLAKAYAQM

SEQ ID NO: 246690 - protein, 9 aa, West Nile virus
LMYFHKRDM

SEQ ID NO: 246691 - protein, 9 aa, West Nile virus
MYFHKRDMR

SEQ ID NO: 246692 - protein, 9 aa, West Nile virus
FHKRDMRLL

SEQ ID NO: 246693 - protein, 9 aa, West Nile virus
HRRDLRTLG

SEQ ID NO: 246694 - protein, 9 aa, West Nile virus
SLAVSSAVP

SEQ ID NO: 246695 - protein, 9 aa, West Nile virus
PQGRTTWSI

SEQ ID NO: 246696 - protein, 9 aa, West Nile virus
QGRTTWSIH

SEQ ID NO: 246697 - protein, 9 aa, West Nile virus
GRTTWSIHG

SEQ ID NO: 246698 - protein, 9 aa, West Nile virus
GAWMTTEDM

SEQ ID NO: 246699 - protein, 9 aa, West Nile virus
TKRQDKLCG

SEQ ID NO: 246700 - protein, 9 aa, West Nile virus
KRQDKLCGS

SEQ ID NO: 246701 - protein, 9 aa, West Nile virus
RQDKLCGSL

SEQ ID NO: 246702 - protein, 9 aa, West Nile virus
QDKLCGSLI

SEQ ID NO: 246703 - protein, 9 aa, West Nile virus
DMLCSSLVG

SEQ ID NO: 246704 - protein, 9 aa, West Nile virus
MLCSSLVGR

SEQ ID NO: 246705 - protein, 9 aa, West Nile virus
LCSSLVGRK

SEQ ID NO: 246706 - protein, 9 aa, West Nile virus
SNKIKQKTK

SEQ ID NO: 246707 - protein, 9 aa, West Nile virus
NKIKQKTKQ

SEQ ID NO: 246708 - protein, 9 aa, West Nile virus
KIKQKTKQI

SEQ ID NO: 246709 - protein, 9 aa, West Nile virus
IKQKTKQIG

SEQ ID NO: 246710 - protein, 9 aa, West Nile virus
EPVDVDCFC

SEQ ID NO: 246711 - protein, 9 aa, West Nile virus
VLELGGCVT

SEQ ID NO: 246712 - protein, 9 aa, West Nile virus
VGAKQENWN

SEQ ID NO: 246713 - protein, 9 aa, West Nile virus
ALGNQEGSL

SEQ ID NO: 246714 - protein, 9 aa, West Nile virus
LGNQEGSLK

SEQ ID NO: 246715 - protein, 9 aa, West Nile virus
NPPFGDSYI

SEQ ID NO: 246716 - protein, 9 aa, West Nile virus
GVERLAVMG

SEQ ID NO: 246717 - protein, 9 aa, West Nile virus
RLAVMGDTA

SEQ ID NO: 246718 - protein, 9 aa, West Nile virus
LAVMGDTAW

SEQ ID NO: 246719 - protein, 9 aa, West Nile virus
AVMGDTAWD

SEQ ID NO: 246720 - protein, 9 aa, West Nile virus
VMGDTAWDF

SEQ ID NO: 246721 - protein, 9 aa, West Nile virus
TAWDFSSAG

SEQ ID NO: 246722 - protein, 9 aa, West Nile virus
AWDFSSAGG

SEQ ID NO: 246723 - protein, 9 aa, West Nile virus
ELKCGDGIF

SEQ ID NO: 246724 - protein, 9 aa, West Nile virus
SDDWLNKYS

SEQ ID NO: 246725 - protein, 9 aa, West Nile virus
AVHTDQSLW

SEQ ID NO: 246726 - protein, 9 aa, West Nile virus
VHTDQSLWM

SEQ ID NO: 246727 - protein, 9 aa, West Nile virus
WPRSHTLWS

SEQ ID NO: 246728 - protein, 9 aa, West Nile virus
PRSHTLWSN

SEQ ID NO: 246729 - protein, 9 aa, West Nile virus
CRTCTLPPV

SEQ ID NO: 246730 - protein, 9 aa, West Nile virus
RTCTLPPVT

SEQ ID NO: 246731 - protein, 9 aa, West Nile virus
GSDGCWYPM

SEQ ID NO: 246732 - protein, 9 aa, West Nile virus
SDGCWYPME

SEQ ID NO: 246733 - protein, 9 aa, West Nile virus
MWHVTRGAA

SEQ ID NO: 246734 - protein, 9 aa, West Nile virus
WHVTRGAAL

SEQ ID NO: 246735 - protein, 9 aa, West Nile virus
GLYGNGILV

SEQ ID NO: 246736 - protein, 9 aa, West Nile virus
TTILDFHPG

SEQ ID NO: 246737 - protein, 9 aa, West Nile virus
LDMHPGSGK

SEQ ID NO: 246738 - protein, 9 aa, West Nile virus
FHPGAGKTR

SEQ ID NO: 246739 - protein, 9 aa, West Nile virus
TRVVLSEMK

SEQ ID NO: 246740 - protein, 9 aa, West Nile virus
RVVLSEMKE

SEQ ID NO: 246741 - protein, 9 aa, West Nile virus
VVLSEMKEA

SEQ ID NO: 246742 - protein, 9 aa, West Nile virus
VLSEMKEAF

SEQ ID NO: 246743 - protein, 9 aa, West Nile virus
GREVIDAMC

SEQ ID NO: 246744 - protein, 9 aa, West Nile virus
REVIDAMCH

SEQ ID NO: 246745 - protein, 9 aa, West Nile virus
AMCHATLTY

SEQ ID NO: 246746 - protein, 9 aa, West Nile virus
MCHATLTYR

SEQ ID NO: 246747 - protein, 9 aa, West Nile virus
CHATLTYRM

SEQ ID NO: 246748 - protein, 9 aa, West Nile virus
HATLTYRML

SEQ ID NO: 246749 - protein, 9 aa, West Nile virus
ATLTYRMLE

SEQ ID NO: 246750 - protein, 9 aa, West Nile virus
TLTYRMLEP

SEQ ID NO: 246751 - protein, 9 aa, West Nile virus
AHFLDPASI

SEQ ID NO: 246752 - protein, 9 aa, West Nile virus
HFLDPASIA

SEQ ID NO: 246753 - protein, 9 aa, West Nile virus
FLDPASIAA

SEQ ID NO: 246754 - protein, 9 aa, West Nile virus
LDPASIAAR

SEQ ID NO: 246755 - protein, 9 aa, West Nile virus
PASIAARGW

SEQ ID NO: 246756 - protein, 9 aa, West Nile virus
ASIAARGWA

SEQ ID NO: 246757 - protein, 9 aa, West Nile virus
SIAARGWAA

SEQ ID NO: 246758 - protein, 9 aa, West Nile virus
IAARGWAAH

SEQ ID NO: 246759 - protein, 9 aa, West Nile virus
AARGWAAHR

SEQ ID NO: 246760 - protein, 9 aa, West Nile virus
ARGWAAHRA

SEQ ID NO: 246761 - protein, 9 aa, West Nile virus
RGHLYTLAK

SEQ ID NO: 246762 - protein, 9 aa, West Nile virus
HRARANESA

SEQ ID NO: 246763 - protein, 9 aa, West Nile virus
ANESATILM

SEQ ID NO: 246764 - protein, 9 aa, West Nile virus
LMTATPPGT

SEQ ID NO: 246765 - protein, 9 aa, West Nile virus
PTAWFLPSI

SEQ ID NO: 246766 - protein, 9 aa, West Nile virus
TAWFLPSIR

SEQ ID NO: 246767 - protein, 9 aa, West Nile virus
VVVLNRKTF

SEQ ID NO: 246768 - protein, 9 aa, West Nile virus
RVIDGRTNI

SEQ ID NO: 246769 - protein, 9 aa, West Nile virus
VIDGRTNIK

SEQ ID NO: 246770 - protein, 9 aa, West Nile virus
IDGRTNIKP

SEQ ID NO: 246771 - protein, 9 aa, West Nile virus
DCRTAFKPV

SEQ ID NO: 246772 - protein, 9 aa, West Nile virus
CRTAFKPVL

SEQ ID NO: 246773 - protein, 9 aa, West Nile virus
RTAFKPVLV

SEQ ID NO: 246774 - protein, 9 aa, West Nile virus
WKEAQILLD

SEQ ID NO: 246775 - protein, 9 aa, West Nile virus
EASMLLDNM

SEQ ID NO: 246776 - protein, 9 aa, West Nile virus
PGEMRLRDD

SEQ ID NO: 246777 - protein, 9 aa, West Nile virus
LMKRGDLPV

SEQ ID NO: 246778 - protein, 9 aa, West Nile virus
VVIPEPGQQ

SEQ ID NO: 246779 - protein, 9 aa, West Nile virus
IPEPGQQRS

SEQ ID NO: 246780 - protein, 9 aa, West Nile virus
PEPGQQRSI

SEQ ID NO: 246781 - protein, 9 aa, West Nile virus
EPGQQRSIQ

SEQ ID NO: 246782 - protein, 9 aa, West Nile virus
PGQQRSIQD

SEQ ID NO: 246783 - protein, 9 aa, West Nile virus
GQQRSIQDN

SEQ ID NO: 246784 - protein, 9 aa, West Nile virus
RSSDDNKLA

SEQ ID NO: 246785 - protein, 9 aa, West Nile virus
AAWTVYVGI

SEQ ID NO: 246786 - protein, 9 aa, West Nile virus
AWTVYVGIV

SEQ ID NO: 246787 - protein, 9 aa, West Nile virus
WTVYVGIVT

SEQ ID NO: 246788 - protein, 9 aa, West Nile virus
HWSLILPGI

SEQ ID NO: 246789 - protein, 9 aa, West Nile virus
WSLILPGIK

SEQ ID NO: 246790 - protein, 9 aa, West Nile virus
SLILPGIKA

SEQ ID NO: 246791 - protein, 9 aa, West Nile virus
LILPGIKAQ

SEQ ID NO: 246792 - protein, 9 aa, West Nile virus
ILPGIKAQQ

SEQ ID NO: 246793 - protein, 9 aa, West Nile virus
LPGIKAQQS

SEQ ID NO: 246794 - protein, 9 aa, West Nile virus
PGIKAQQSK

SEQ ID NO: 246795 - protein, 9 aa, West Nile virus
GIKAQQSKL

SEQ ID NO: 246796 - protein, 9 aa, West Nile virus
IKAQQSKLA

SEQ ID NO: 246797 - protein, 9 aa, West Nile virus
KAQQSKLAQ

SEQ ID NO: 246798 - protein, 9 aa, West Nile virus
AQQSKLAQR

SEQ ID NO: 246799 - protein, 9 aa, West Nile virus
QQSKLAQRR

SEQ ID NO: 246800 - protein, 9 aa, West Nile virus
QRAHKVFFS

SEQ ID NO: 246801 - protein, 9 aa, West Nile virus
RAHKVFFSA

SEQ ID NO: 246802 - protein, 9 aa, West Nile virus
QRRVFHGVA

SEQ ID NO: 246803 - protein, 9 aa, West Nile virus
VFHGVAKNP

SEQ ID NO: 246804 - protein, 9 aa, West Nile virus
HGVAKNPVV

SEQ ID NO: 246805 - protein, 9 aa, West Nile virus
GVAKNPVVD

SEQ ID NO: 246806 - protein, 9 aa, West Nile virus
VAKNPVVDG

SEQ ID NO: 246807 - protein, 9 aa, West Nile virus
DTLWTMPVA

SEQ ID NO: 246808 - protein, 9 aa, West Nile virus
TLWTMPVAC

SEQ ID NO: 246809 - protein, 9 aa, West Nile virus
TGVMRGNHY

SEQ ID NO: 246810 - protein, 9 aa, West Nile virus
GVMRGNHYA

SEQ ID NO: 246811 - protein, 9 aa, West Nile virus
VMRGNHYAF

SEQ ID NO: 246812 - protein, 9 aa, West Nile virus
MRGNHYAFV

SEQ ID NO: 246813 - protein, 9 aa, West Nile virus
RGNHYAFVG

SEQ ID NO: 246814 - protein, 9 aa, West Nile virus
GNHYAFVGV

SEQ ID NO: 246815 - protein, 9 aa, West Nile virus
GKTLGEVWK

SEQ ID NO: 246816 - protein, 9 aa, West Nile virus
PVSRGSAKL

SEQ ID NO: 246817 - protein, 9 aa, West Nile virus
VSRGTAKLA

SEQ ID NO: 246818 - protein, 9 aa, West Nile virus
SRGTAKLAW

SEQ ID NO: 246819 - protein, 9 aa, West Nile virus
GKVMDLGCG

SEQ ID NO: 246820 - protein, 9 aa, West Nile virus
KVMDLGCGR

SEQ ID NO: 246821 - protein, 9 aa, West Nile virus
GRGGWCYYA

SEQ ID NO: 246822 - protein, 9 aa, West Nile virus
SVKAYTIGG

SEQ ID NO: 246823 - protein, 9 aa, West Nile virus
GFTLGRDGH

SEQ ID NO: 246824 - protein, 9 aa, West Nile virus
SDTLLCDIG

SEQ ID NO: 246825 - protein, 9 aa, West Nile virus
CDIGESNPD

SEQ ID NO: 246826 - protein, 9 aa, West Nile virus
VIRNPLSRN

SEQ ID NO: 246827 - protein, 9 aa, West Nile virus
IRNPLSRNS

SEQ ID NO: 246828 - protein, 9 aa, West Nile virus
NSTHEMYYV

SEQ ID NO: 246829 - protein, 9 aa, West Nile virus
STHEMYYVS

SEQ ID NO: 246830 - protein, 9 aa, West Nile virus
PYRTWQYWG

SEQ ID NO: 246831 - protein, 9 aa, West Nile virus
YRTWQYWGS

SEQ ID NO: 246832 - protein, 9 aa, West Nile virus
RTWQYWGSY

SEQ ID NO: 246833 - protein, 9 aa, West Nile virus
TWHYCGSYV

SEQ ID NO: 246834 - protein, 9 aa, West Nile virus
GSAASMVNG

SEQ ID NO: 246835 - protein, 9 aa, West Nile virus
SAASMVNGV

SEQ ID NO: 246836 - protein, 9 aa, West Nile virus
AASMVNGVI

SEQ ID NO: 246837 - protein, 9 aa, West Nile virus
NGVVKLLSW

SEQ ID NO: 246838 - protein, 9 aa, West Nile virus
GVVKLLSWP

SEQ ID NO: 246839 - protein, 9 aa, West Nile virus
VVKLLSWPW

SEQ ID NO: 246840 - protein, 9 aa, West Nile virus
VKLLSWPWN

SEQ ID NO: 246841 - protein, 9 aa, West Nile virus
KEKVDTKAQ

SEQ ID NO: 246842 - protein, 9 aa, West Nile virus
EKKLSEFGK

SEQ ID NO: 246843 - protein, 9 aa, West Nile virus
KKLSEFGKA

SEQ ID NO: 246844 - protein, 9 aa, West Nile virus
KLSEFGKAK

SEQ ID NO: 246845 - protein, 9 aa, West Nile virus
LSEFGKAKG

SEQ ID NO: 246846 - protein, 9 aa, West Nile virus
WYMWLGSRF

SEQ ID NO: 246847 - protein, 9 aa, West Nile virus
YMWLGSRFL

SEQ ID NO: 246848 - protein, 9 aa, West Nile virus
MTYKNKVVK

SEQ ID NO: 246849 - protein, 9 aa, West Nile virus
TYKNKVVKV

SEQ ID NO: 246850 - protein, 9 aa, West Nile virus
AKVVKVARP

SEQ ID NO: 246851 - protein, 9 aa, West Nile virus
MDVITRRDQ

SEQ ID NO: 246852 - protein, 9 aa, West Nile virus
DVITRRDQR

SEQ ID NO: 246853 - protein, 9 aa, West Nile virus
VITRRDQRG

SEQ ID NO: 246854 - protein, 9 aa, West Nile virus
DMGKVRKDV

SEQ ID NO: 246855 - protein, 9 aa, West Nile virus
NWEEVPFCS

SEQ ID NO: 246856 - protein, 9 aa, West Nile virus
PFCSNHFQE

SEQ ID NO: 246857 - protein, 9 aa, West Nile virus
FCSNHFQEI

SEQ ID NO: 246858 - protein, 9 aa, West Nile virus
VPCREQDEL

SEQ ID NO: 246859 - protein, 9 aa, West Nile virus
GRARVSPGC

SEQ ID NO: 246860 - protein, 9 aa, West Nile virus
RARVSPGCG

SEQ ID NO: 246861 - protein, 9 aa, West Nile virus
ARVSPGCGW

SEQ ID NO: 246862 - protein, 9 aa, West Nile virus
RVSPGCGWS

SEQ ID NO: 246863 - protein, 9 aa, West Nile virus
VSPGCGWSV

SEQ ID NO: 246864 - protein, 9 aa, West Nile virus
ETACLSKAY

SEQ ID NO: 246865 - protein, 9 aa, West Nile virus
TACLSKAYG

SEQ ID NO: 246866 - protein, 9 aa, West Nile virus
ACLSKAYGQ

SEQ ID NO: 246867 - protein, 9 aa, West Nile virus
CLSKAYGQM

SEQ ID NO: 246868 - protein, 9 aa, West Nile virus
HKRDMRLLS

SEQ ID NO: 246869 - protein, 9 aa, West Nile virus
GLAICSAVP

SEQ ID NO: 246870 - protein, 9 aa, West Nile virus
PKSHDMLCS

SEQ ID NO: 246871 - protein, 9 aa, West Nile virus
KSHDMLCSS

SEQ ID NO: 246872 - protein, 9 aa, West Nile virus
SHDMLCSSL

SEQ ID NO: 246873 - protein, 9 aa, West Nile virus
HDMLCSSLV

SEQ ID NO: 246874 - protein, 9 aa, West Nile virus
DKLCGSLIG

SEQ ID NO: 246875 - protein, 9 aa, West Nile virus
KLCGSLIGM

SEQ ID NO: 246876 - protein, 9 aa, West Nile virus
LCGSLIGMT

SEQ ID NO: 246877 - protein, 10 aa, Yellow fever virus
SQLAKRFSKG

SEQ ID NO: 246878 - protein, 10 aa, Yellow fever virus
QLAKRFSKGL

SEQ ID NO: 246879 - protein, 10 aa, Yellow fever virus
LAKRFSKGLL

SEQ ID NO: 246880 - protein, 10 aa, Yellow fever virus
VDRGWGNGCG

SEQ ID NO: 246881 - protein, 10 aa, Yellow fever virus
DRGWGNGCGL

SEQ ID NO: 246882 - protein, 10 aa, Yellow fever virus
RGWGNGCGLF

SEQ ID NO: 246883 - protein, 10 aa, Yellow fever virus
GWGNGCGLFG

SEQ ID NO: 246884 - protein, 10 aa, Yellow fever virus
WGNGCGLFGK

SEQ ID NO: 246885 - protein, 10 aa, Yellow fever virus
GNGCGLFGKG

SEQ ID NO: 246886 - protein, 10 aa, Yellow fever virus
NGCGLFGKGS

SEQ ID NO: 246887 - protein, 10 aa, Yellow fever virus
GCGLFGKGSL

SEQ ID NO: 246888 - protein, 10 aa, Yellow fever virus
VLGSQEGAMH

SEQ ID NO: 246889 - protein, 10 aa, Yellow fever virus
RMAILGDTAW

SEQ ID NO: 246890 - protein, 10 aa, Yellow fever virus
MAILGDTAWD

SEQ ID NO: 246891 - protein, 10 aa, Yellow fever virus
AILGDTAWDF

SEQ ID NO: 246892 - protein, 10 aa, Yellow fever virus
ILGDTAWDFG

SEQ ID NO: 246893 - protein, 10 aa, Yellow fever virus
LGDTAWDFGS

SEQ ID NO: 246894 - protein, 10 aa, Yellow fever virus
TAWDFGSIGG

SEQ ID NO: 246895 - protein, 10 aa, Yellow fever virus
AVHADMGYWI

SEQ ID NO: 246896 - protein, 10 aa, Yellow fever virus
VHADMGYWIE

SEQ ID NO: 246897 - protein, 10 aa, Yellow fever virus
HADMGYWIES

SEQ ID NO: 246898 - protein, 10 aa, Yellow fever virus
WPKSHTLWSN

SEQ ID NO: 246899 - protein, 10 aa, Yellow fever virus
WCCRSCTLPP

SEQ ID NO: 246900 - protein, 10 aa, Yellow fever virus
CCRSCTLPPL

SEQ ID NO: 246901 - protein, 10 aa, Yellow fever virus
CRSCTLPPLR

SEQ ID NO: 246902 - protein, 10 aa, Yellow fever virus
GEDGCWYGME

SEQ ID NO: 246903 - protein, 10 aa, Yellow fever virus
EDGCWYGMEI

SEQ ID NO: 246904 - protein, 10 aa, Yellow fever virus
DGCWYGMEIR

SEQ ID NO: 246905 - protein, 10 aa, Yellow fever virus
GCWYGMEIRP

SEQ ID NO: 246906 - protein, 10 aa, Yellow fever virus
VFHTMWHVTR

SEQ ID NO: 246907 - protein, 10 aa, Yellow fever virus
FHTMWHVTRG

SEQ ID NO: 246908 - protein, 10 aa, Yellow fever virus
HTMWHVTRGA

SEQ ID NO: 246909 - protein, 10 aa, Yellow fever virus
TMWHVTRGAV

SEQ ID NO: 246910 - protein, 10 aa, Yellow fever virus
MWHVTRGAVL

SEQ ID NO: 246911 - protein, 10 aa, Yellow fever virus
MDLHPGSGKT

SEQ ID NO: 246912 - protein, 10 aa, Yellow fever virus
DLHPGSGKTR

SEQ ID NO: 246913 - protein, 10 aa, Yellow fever virus
LRTLILAPTR

SEQ ID NO: 246914 - protein, 10 aa, Yellow fever virus
RTLILAPTRV

SEQ ID NO: 246915 - protein, 10 aa, Yellow fever virus
TLILAPTRVV

SEQ ID NO: 246916 - protein, 10 aa, Yellow fever virus
LILAPTRVVA

SEQ ID NO: 246917 - protein, 10 aa, Yellow fever virus
ILAPTRVVAA

SEQ ID NO: 246918 - protein, 10 aa, Yellow fever virus
LAPTRVVAAE

SEQ ID NO: 246919 - protein, 10 aa, Yellow fever virus
APTRVVAAEM

SEQ ID NO: 246920 - protein, 10 aa, Yellow fever virus
PTRVVAAEME

SEQ ID NO: 246921 - protein, 10 aa, Yellow fever virus
TRVVAAEMEE

SEQ ID NO: 246922 - protein, 10 aa, Yellow fever virus
RVVAAEMEEA

SEQ ID NO: 246923 - protein, 10 aa, Yellow fever virus
VVAAEMEEAL

SEQ ID NO: 246924 - protein, 10 aa, Yellow fever virus
GREIVDLMCH

SEQ ID NO: 246925 - protein, 10 aa, Yellow fever virus
REIVDLMCHA

SEQ ID NO: 246926 - protein, 10 aa, Yellow fever virus
EIVDLMCHAT

SEQ ID NO: 246927 - protein, 10 aa, Yellow fever virus
IVDLMCHATF

SEQ ID NO: 246928 - protein, 10 aa, Yellow fever virus
VDLMCHATFT

SEQ ID NO: 246929 - protein, 10 aa, Yellow fever virus
DLMCHATFTM

SEQ ID NO: 246930 - protein, 10 aa, Yellow fever virus
LMCHATFTMR

SEQ ID NO: 246931 - protein, 10 aa, Yellow fever virus
MCHATFTMRL

SEQ ID NO: 246932 - protein, 10 aa, Yellow fever virus
CHATFTMRLL

SEQ ID NO: 246933 - protein, 10 aa, Yellow fever virus
HATFTMRLLS

SEQ ID NO: 246934 - protein, 10 aa, Yellow fever virus
ATFTMRLLSP

SEQ ID NO: 246935 - protein, 10 aa, Yellow fever virus
IMDEAHFTDP

SEQ ID NO: 246936 - protein, 10 aa, Yellow fever virus
MDEAHFTDPA

SEQ ID NO: 246937 - protein, 10 aa, Yellow fever virus
DEAHFTDPAS

SEQ ID NO: 246938 - protein, 10 aa, Yellow fever virus
EAHFTDPASI

SEQ ID NO: 246939 - protein, 10 aa, Yellow fever virus
AHFTDPASIA

SEQ ID NO: 246940 - protein, 10 aa, Yellow fever virus
HFTDPASIAA

SEQ ID NO: 246941 - protein, 10 aa, Yellow fever virus
FTDPASIAAR

SEQ ID NO: 246942 - protein, 10 aa, Yellow fever virus
TDPASIAARG

SEQ ID NO: 246943 - protein, 10 aa, Yellow fever virus
DPASIAARGY

SEQ ID NO: 246944 - protein, 10 aa, Yellow fever virus
PASIAARGYI

SEQ ID NO: 246945 - protein, 10 aa, Yellow fever virus
SIAARGYIST

SEQ ID NO: 246946 - protein, 10 aa, Yellow fever virus
AARGYISTRV

SEQ ID NO: 246947 - protein, 10 aa, Yellow fever virus
MGEAAAIFMT

SEQ ID NO: 246948 - protein, 10 aa, Yellow fever virus
GEAAAIFMTA

SEQ ID NO: 246949 - protein, 10 aa, Yellow fever virus
EAAAIFMTAT

SEQ ID NO: 246950 - protein, 10 aa, Yellow fever virus
AAAIFMTATP

SEQ ID NO: 246951 - protein, 10 aa, Yellow fever virus
AAIFMTATPP

SEQ ID NO: 246952 - protein, 10 aa, Yellow fever virus
AIFMTATPPG

SEQ ID NO: 246953 - protein, 10 aa, Yellow fever virus
IFMTATPPGS

SEQ ID NO: 246954 - protein, 10 aa, Yellow fever virus
GKTVWFVPSI

SEQ ID NO: 246955 - protein, 10 aa, Yellow fever virus
DWDFVVTTDI

SEQ ID NO: 246956 - protein, 10 aa, Yellow fever virus
WDFVVTTDIS

SEQ ID NO: 246957 - protein, 10 aa, Yellow fever virus
DFVVTTDISE

SEQ ID NO: 246958 - protein, 10 aa, Yellow fever virus
FVVTTDISEM

SEQ ID NO: 246959 - protein, 10 aa, Yellow fever virus
VVTTDISEMG

SEQ ID NO: 246960 - protein, 10 aa, Yellow fever virus
VTTDISEMGA

SEQ ID NO: 246961 - protein, 10 aa, Yellow fever virus
TTDISEMGAN

SEQ ID NO: 246962 - protein, 10 aa, Yellow fever virus
TDISEMGANF

SEQ ID NO: 246963 - protein, 10 aa, Yellow fever virus
DISEMGANFK

SEQ ID NO: 246964 - protein, 10 aa, Yellow fever virus
ISEMGANFKA

SEQ ID NO: 246965 - protein, 10 aa, Yellow fever virus
RVIDPRRCLK

SEQ ID NO: 246966 - protein, 10 aa, Yellow fever virus
VIDPRRCLKP

SEQ ID NO: 246967 - protein, 10 aa, Yellow fever virus
IDPRRCLKPV

SEQ ID NO: 246968 - protein, 10 aa, Yellow fever virus
DPRRCLKPVI

SEQ ID NO: 246969 - protein, 10 aa, Yellow fever virus
PRRCLKPVIL

SEQ ID NO: 246970 - protein, 10 aa, Yellow fever virus
ASAAQRRGRI

SEQ ID NO: 246971 - protein, 10 aa, Yellow fever virus
SAAQRRGRIG

SEQ ID NO: 246972 - protein, 10 aa, Yellow fever virus
AAQRRGRIGR

SEQ ID NO: 246973 - protein, 10 aa, Yellow fever virus
AQRRGRIGRN

SEQ ID NO: 246974 - protein, 10 aa, Yellow fever virus
LMRRGDLPVW

SEQ ID NO: 246975 - protein, 10 aa, Yellow fever virus
MRRGDLPVWL

SEQ ID NO: 246976 - protein, 10 aa, Yellow fever virus
RRGDLPVWLA

SEQ ID NO: 246977 - protein, 10 aa, Yellow fever virus
LLIPEPEKQR

SEQ ID NO: 246978 - protein, 10 aa, Yellow fever virus
LIPEPEKQRT

SEQ ID NO: 246979 - protein, 10 aa, Yellow fever virus
IPEPEKQRTP

SEQ ID NO: 246980 - protein, 10 aa, Yellow fever virus
PEPEKQRTPQ

SEQ ID NO: 246981 - protein, 10 aa, Yellow fever virus
EPEKQRTPQD

SEQ ID NO: 246982 - protein, 10 aa, Yellow fever virus
PEKQRTPQDN

SEQ ID NO: 246983 - protein, 10 aa, Yellow fever virus
EKQRTPQDNQ

SEQ ID NO: 246984 - protein, 10 aa, Yellow fever virus
KQRTPQDNQL

SEQ ID NO: 246985 - protein, 10 aa, Yellow fever virus
QRTPQDNQLA

SEQ ID NO: 246986 - protein, 10 aa, Yellow fever virus
PASAWTLYAV

SEQ ID NO: 246987 - protein, 10 aa, Yellow fever virus
ASAWTLYAVA

SEQ ID NO: 246988 - protein, 10 aa, Yellow fever virus
SAWTLYAVAT

SEQ ID NO: 246989 - protein, 10 aa, Yellow fever virus
AWTLYAVATT

SEQ ID NO: 246990 - protein, 10 aa, Yellow fever virus
HYAIIGPGLQ

SEQ ID NO: 246991 - protein, 10 aa, Yellow fever virus
YAIIGPGLQA

SEQ ID NO: 246992 - protein, 10 aa, Yellow fever virus
AIIGPGLQAK

SEQ ID NO: 246993 - protein, 10 aa, Yellow fever virus
IIGPGLQAKA

SEQ ID NO: 246994 - protein, 10 aa, Yellow fever virus
IGPGLQAKAT

SEQ ID NO: 246995 - protein, 10 aa, Yellow fever virus
GPGLQAKATR

SEQ ID NO: 246996 - protein, 10 aa, Yellow fever virus
PGLQAKATRE

SEQ ID NO: 246997 - protein, 10 aa, Yellow fever virus
GLQAKATREA

SEQ ID NO: 246998 - protein, 10 aa, Yellow fever virus
LQAKATREAQ

SEQ ID NO: 246999 - protein, 10 aa, Yellow fever virus
QAKATREAQK

SEQ ID NO: 247000 - protein, 10 aa, Yellow fever virus
AKATREAQKR

SEQ ID NO: 247001 - protein, 10 aa, Yellow fever virus
REAQKRTAAG

SEQ ID NO: 247002 - protein, 10 aa, Yellow fever virus
EAQKRTAAGI

SEQ ID NO: 247003 - protein, 10 aa, Yellow fever virus
AQKRTAAGIM

SEQ ID NO: 247004 - protein, 10 aa, Yellow fever virus
QKRTAAGIMK

SEQ ID NO: 247005 - protein, 10 aa, Yellow fever virus
KRTAAGIMKN

SEQ ID NO: 247006 - protein, 10 aa, Yellow fever virus
RTAAGIMKNP

SEQ ID NO: 247007 - protein, 10 aa, Yellow fever virus
TAAGIMKNPT

SEQ ID NO: 247008 - protein, 10 aa, Yellow fever virus
AAGIMKNPTV

SEQ ID NO: 247009 - protein, 10 aa, Yellow fever virus
AGIMKNPTVD

SEQ ID NO: 247010 - protein, 10 aa, Yellow fever virus
GIMKNPTVDG

SEQ ID NO: 247011 - protein, 10 aa, Yellow fever virus
FEKQLGQVML

SEQ ID NO: 247012 - protein, 10 aa, Yellow fever virus
GKFWNTTIAV

SEQ ID NO: 247013 - protein, 10 aa, Yellow fever virus
KFWNTTIAVS

SEQ ID NO: 247014 - protein, 10 aa, Yellow fever virus
ANIFRGSYLA

SEQ ID NO: 247015 - protein, 10 aa, Yellow fever virus
NIFRGSYLAG

SEQ ID NO: 247016 - protein, 10 aa, Yellow fever virus
IFRGSYLAGA

SEQ ID NO: 247017 - protein, 10 aa, Yellow fever virus
FRGSYLAGAG

SEQ ID NO: 247018 - protein, 10 aa, Yellow fever virus
RGSYLAGAGL

SEQ ID NO: 247019 - protein, 10 aa, Yellow fever virus
VSRGTAKLRW

SEQ ID NO: 247020 - protein, 10 aa, Yellow fever virus
GKVIDLGCGR

SEQ ID NO: 247021 - protein, 10 aa, Yellow fever virus
KVIDLGCGRG

SEQ ID NO: 247022 - protein, 10 aa, Yellow fever virus
VIDLGCGRGG

SEQ ID NO: 247023 - protein, 10 aa, Yellow fever virus
IDLGCGRGGW

SEQ ID NO: 247024 - protein, 10 aa, Yellow fever virus
DLGCGRGGWS

SEQ ID NO: 247025 - protein, 10 aa, Yellow fever virus
LGCGRGGWSY

SEQ ID NO: 247026 - protein, 10 aa, Yellow fever virus
GCGRGGWSYY

SEQ ID NO: 247027 - protein, 10 aa, Yellow fever virus
CGRGGWSYYC

SEQ ID NO: 247028 - protein, 10 aa, Yellow fever virus
GYTKGGPGHE

SEQ ID NO: 247029 - protein, 10 aa, Yellow fever virus
TKGGPGHEEP

SEQ ID NO: 247030 - protein, 10 aa, Yellow fever virus
CDTLLCDIGE

SEQ ID NO: 247031 - protein, 10 aa, Yellow fever virus
DTLLCDIGES

SEQ ID NO: 247032 - protein, 10 aa, Yellow fever virus
TLLCDIGESS

SEQ ID NO: 247033 - protein, 10 aa, Yellow fever virus
LLCDIGESSP

SEQ ID NO: 247034 - protein, 10 aa, Yellow fever virus
LVRNPLSRNS

SEQ ID NO: 247035 - protein, 10 aa, Yellow fever virus
VRNPLSRNST

SEQ ID NO: 247036 - protein, 10 aa, Yellow fever virus
RNPLSRNSTH

SEQ ID NO: 247037 - protein, 10 aa, Yellow fever virus
NPLSRNSTHE

SEQ ID NO: 247038 - protein, 10 aa, Yellow fever virus
PLSRNSTHEM

SEQ ID NO: 247039 - protein, 10 aa, Yellow fever virus
LSRNSTHEMY

SEQ ID NO: 247040 - protein, 10 aa, Yellow fever virus
SRNSTHEMYW

SEQ ID NO: 247041 - protein, 10 aa, Yellow fever virus
RNSTHEMYWV

SEQ ID NO: 247042 - protein, 10 aa, Yellow fever virus
NSTHEMYWVS

SEQ ID NO: 247043 - protein, 10 aa, Yellow fever virus
PYKTWAYHGS

SEQ ID NO: 247044 - protein, 10 aa, Yellow fever virus
YKTWAYHGSY

SEQ ID NO: 247045 - protein, 10 aa, Yellow fever virus
GSASSMVNGV

SEQ ID NO: 247046 - protein, 10 aa, Yellow fever virus
SASSMVNGVV

SEQ ID NO: 247047 - protein, 10 aa, Yellow fever virus
NGVVKLLTKP

SEQ ID NO: 247048 - protein, 10 aa, Yellow fever virus
GVVKLLTKPW

SEQ ID NO: 247049 - protein, 10 aa, Yellow fever virus
VVKLLTKPWD

SEQ ID NO: 247050 - protein, 10 aa, Yellow fever virus
MAMTDTTPFG

SEQ ID NO: 247051 - protein, 10 aa, Yellow fever virus
AMTDTTPFGQ

SEQ ID NO: 247052 - protein, 10 aa, Yellow fever virus
MTDTTPFGQQ

SEQ ID NO: 247053 - protein, 10 aa, Yellow fever virus
TDTTPFGQQR

SEQ ID NO: 247054 - protein, 10 aa, Yellow fever virus
DTTPFGQQRV

SEQ ID NO: 247055 - protein, 10 aa, Yellow fever virus
TTPFGQQRVF

SEQ ID NO: 247056 - protein, 10 aa, Yellow fever virus
TPFGQQRVFK

SEQ ID NO: 247057 - protein, 10 aa, Yellow fever virus
PFGQQRVFKE

SEQ ID NO: 247058 - protein, 10 aa, Yellow fever virus
FGQQRVFKEK

SEQ ID NO: 247059 - protein, 10 aa, Yellow fever virus
GQQRVFKEKV

SEQ ID NO: 247060 - protein, 10 aa, Yellow fever virus
QQRVFKEKVD

SEQ ID NO: 247061 - protein, 10 aa, Yellow fever virus
QRVFKEKVDT

SEQ ID NO: 247062 - protein, 10 aa, Yellow fever virus
RVFKEKVDTR

SEQ ID NO: 247063 - protein, 10 aa, Yellow fever virus
VFKEKVDTRT

SEQ ID NO: 247064 - protein, 10 aa, Yellow fever virus
FKEKVDTRTP

SEQ ID NO: 247065 - protein, 10 aa, Yellow fever virus
TCVYNMMGKR

SEQ ID NO: 247066 - protein, 10 aa, Yellow fever virus
CVYNMMGKRE

SEQ ID NO: 247067 - protein, 10 aa, Yellow fever virus
VYNMMGKREK

SEQ ID NO: 247068 - protein, 10 aa, Yellow fever virus
YNMMGKREKK

SEQ ID NO: 247069 - protein, 10 aa, Yellow fever virus
NMMGKREKKL

SEQ ID NO: 247070 - protein, 10 aa, Yellow fever virus
MMGKREKKLG

SEQ ID NO: 247071 - protein, 10 aa, Yellow fever virus
MGKREKKLGE

SEQ ID NO: 247072 - protein, 10 aa, Yellow fever virus
GKREKKLGEF

SEQ ID NO: 247073 - protein, 10 aa, Yellow fever virus
KREKKLGEFG

SEQ ID NO: 247074 - protein, 10 aa, Yellow fever virus
REKKLGEFGK

SEQ ID NO: 247075 - protein, 10 aa, Yellow fever virus
EKKLGEFGKA

SEQ ID NO: 247076 - protein, 10 aa, Yellow fever virus
KKLGEFGKAK

SEQ ID NO: 247077 - protein, 10 aa, Yellow fever virus
KLGEFGKAKG

SEQ ID NO: 247078 - protein, 10 aa, Yellow fever virus
LGEFGKAKGS

SEQ ID NO: 247079 - protein, 10 aa, Yellow fever virus
GEFGKAKGSR

SEQ ID NO: 247080 - protein, 10 aa, Yellow fever virus
EFGKAKGSRA

SEQ ID NO: 247081 - protein, 10 aa, Yellow fever virus
FGKAKGSRAI

SEQ ID NO: 247082 - protein, 10 aa, Yellow fever virus
GKAKGSRAIW

SEQ ID NO: 247083 - protein, 10 aa, Yellow fever virus
KAKGSRAIWY

SEQ ID NO: 247084 - protein, 10 aa, Yellow fever virus
AKGSRAIWYM

SEQ ID NO: 247085 - protein, 10 aa, Yellow fever virus
KGSRAIWYMW

SEQ ID NO: 247086 - protein, 10 aa, Yellow fever virus
GSRAIWYMWL

SEQ ID NO: 247087 - protein, 10 aa, Yellow fever virus
SRAIWYMWLG

SEQ ID NO: 247088 - protein, 10 aa, Yellow fever virus
RAIWYMWLGA

SEQ ID NO: 247089 - protein, 10 aa, Yellow fever virus
AIWYMWLGAR

SEQ ID NO: 247090 - protein, 10 aa, Yellow fever virus
IWYMWLGARF

SEQ ID NO: 247091 - protein, 10 aa, Yellow fever virus
WYMWLGARFL

SEQ ID NO: 247092 - protein, 10 aa, Yellow fever virus
YMWLGARFLE

SEQ ID NO: 247093 - protein, 10 aa, Yellow fever virus
MWLGARFLEF

SEQ ID NO: 247094 - protein, 10 aa, Yellow fever virus
WLGARFLEFE

SEQ ID NO: 247095 - protein, 10 aa, Yellow fever virus
LGARFLEFEA

SEQ ID NO: 247096 - protein, 10 aa, Yellow fever virus
GARFLEFEAL

SEQ ID NO: 247097 - protein, 10 aa, Yellow fever virus
ARFLEFEALG

SEQ ID NO: 247098 - protein, 10 aa, Yellow fever virus
RFLEFEALGF

SEQ ID NO: 247099 - protein, 10 aa, Yellow fever virus
FLEFEALGFM

SEQ ID NO: 247100 - protein, 10 aa, Yellow fever virus
LEFEALGFLN

SEQ ID NO: 247101 - protein, 10 aa, Yellow fever virus
EFEALGFLNE

SEQ ID NO: 247102 - protein, 10 aa, Yellow fever virus
FEALGFLNED

SEQ ID NO: 247103 - protein, 10 aa, Yellow fever virus
EALGFLNEDH

SEQ ID NO: 247104 - protein, 10 aa, Yellow fever virus
ALGFLNEDHW

SEQ ID NO: 247105 - protein, 10 aa, Yellow fever virus
LGFLNEDHWF

SEQ ID NO: 247106 - protein, 10 aa, Yellow fever virus
MYADDTAGWD

SEQ ID NO: 247107 - protein, 10 aa, Yellow fever virus
YADDTAGWDT

SEQ ID NO: 247108 - protein, 10 aa, Yellow fever virus
ADDTAGWDTR

SEQ ID NO: 247109 - protein, 10 aa, Yellow fever virus
DDTAGWDTRI

SEQ ID NO: 247110 - protein, 10 aa, Yellow fever virus
DTAGWDTRIT

SEQ ID NO: 247111 - protein, 10 aa, Yellow fever virus
IFKLTYQNKV

SEQ ID NO: 247112 - protein, 10 aa, Yellow fever virus
FKLTYQNKVV

SEQ ID NO: 247113 - protein, 10 aa, Yellow fever virus
KLTYQNKVVR

SEQ ID NO: 247114 - protein, 10 aa, Yellow fever virus
LTYQNKVVRV

SEQ ID NO: 247115 - protein, 10 aa, Yellow fever virus
MDVISRRDQR

SEQ ID NO: 247116 - protein, 10 aa, Yellow fever virus
DVISRRDQRG

SEQ ID NO: 247117 - protein, 10 aa, Yellow fever virus
VISRRDQRGS

SEQ ID NO: 247118 - protein, 10 aa, Yellow fever virus
ISRRDQRGSG

SEQ ID NO: 247119 - protein, 10 aa, Yellow fever virus
SRRDQRGSGQ

SEQ ID NO: 247120 - protein, 10 aa, Yellow fever virus
RRDQRGSGQV

SEQ ID NO: 247121 - protein, 10 aa, Yellow fever virus
RDQRGSGQVG

SEQ ID NO: 247122 - protein, 10 aa, Yellow fever virus
DQRGSGQVGT

SEQ ID NO: 247123 - protein, 10 aa, Yellow fever virus
QRGSGQVGTY

SEQ ID NO: 247124 - protein, 10 aa, Yellow fever virus
RGSGQVGTYG

SEQ ID NO: 247125 - protein, 10 aa, Yellow fever virus
GSGQVGTYGL

SEQ ID NO: 247126 - protein, 10 aa, Yellow fever virus
SGQVGTYGLN

SEQ ID NO: 247127 - protein, 10 aa, Yellow fever virus
GQVGTYGLNT

SEQ ID NO: 247128 - protein, 10 aa, Yellow fever virus
RMAISGDDCV

SEQ ID NO: 247129 - protein, 10 aa, Yellow fever virus
MAISGDDCVV

SEQ ID NO: 247130 - protein, 10 aa, Yellow fever virus
AISGDDCVVK

SEQ ID NO: 247131 - protein, 10 aa, Yellow fever virus
ISGDDCVVKP

SEQ ID NO: 247132 - protein, 10 aa, Yellow fever virus
LNDMGKVRKD

SEQ ID NO: 247133 - protein, 10 aa, Yellow fever virus
NDMGKVRKDI

SEQ ID NO: 247134 - protein, 10 aa, Yellow fever virus
QVPFCSHHFH

SEQ ID NO: 247135 - protein, 10 aa, Yellow fever virus
VPFCSHHFHE

SEQ ID NO: 247136 - protein, 10 aa, Yellow fever virus
PFCSHHFHEL

SEQ ID NO: 247137 - protein, 10 aa, Yellow fever virus
QDELIGRARI

SEQ ID NO: 247138 - protein, 10 aa, Yellow fever virus
DELIGRARIS

SEQ ID NO: 247139 - protein, 10 aa, Yellow fever virus
GRARISQGAG

SEQ ID NO: 247140 - protein, 10 aa, Yellow fever virus
RARISQGAGW

SEQ ID NO: 247141 - protein, 10 aa, Yellow fever virus
ARISQGAGWS

SEQ ID NO: 247142 - protein, 10 aa, Yellow fever virus
RISQGAGWSL

SEQ ID NO: 247143 - protein, 10 aa, Yellow fever virus
TACLGKSYAQ

SEQ ID NO: 247144 - protein, 10 aa, Yellow fever virus
ACLGKSYAQM

SEQ ID NO: 247145 - protein, 10 aa, Yellow fever virus
LMYFHRRDLR

SEQ ID NO: 247146 - protein, 10 aa, Yellow fever virus
MYFHRRDLRL

SEQ ID NO: 247147 - protein, 10 aa, Yellow fever virus
YFHRRDLRLA

SEQ ID NO: 247148 - protein, 10 aa, Yellow fever virus
FHRRDLRLAA

SEQ ID NO: 247149 - protein, 10 aa, Yellow fever virus
PTSRTTWSIH

SEQ ID NO: 247150 - protein, 10 aa, Yellow fever virus
TSRTTWSIHA

SEQ ID NO: 247151 - protein, 10 aa, Yellow fever virus
HQWMTTEDML

SEQ ID NO: 247152 - protein, 10 aa, Yellow fever virus
GKREDQWCGS

SEQ ID NO: 247153 - protein, 10 aa, Yellow fever virus
KREDQWCGSL

SEQ ID NO: 247154 - protein, 10 aa, Yellow fever virus
REDQWCGSLI

SEQ ID NO: 247155 - protein, 10 aa, Yellow fever virus
EDQWCGSLIG

SEQ ID NO: 247156 - protein, 10 aa, Yellow fever virus
DQWCGSLIGL

SEQ ID NO: 247157 - protein, 10 aa, Yellow fever virus
QWCGSLIGLT

SEQ ID NO: 247158 - protein, 10 aa, Yellow fever virus
QQLTKRFSLG

SEQ ID NO: 247159 - protein, 10 aa, Yellow fever virus
QLTKRFSLGM

SEQ ID NO: 247160 - protein, 10 aa, Yellow fever virus
LTKRFSLGML

SEQ ID NO: 247161 - protein, 10 aa, Yellow fever virus
TDRGWGNGCG

SEQ ID NO: 247162 - protein, 10 aa, Yellow fever virus
DRGWGNHCGL

SEQ ID NO: 247163 - protein, 10 aa, Yellow fever virus
RGWGNHCGLF

SEQ ID NO: 247164 - protein, 10 aa, Yellow fever virus
GWGNHCGLFG

SEQ ID NO: 247165 - protein, 10 aa, Yellow fever virus
WGNHCGLFGK

SEQ ID NO: 247166 - protein, 10 aa, Yellow fever virus
GNHCGLFGKG

SEQ ID NO: 247167 - protein, 10 aa, Yellow fever virus
NGCGLFGKGG

SEQ ID NO: 247168 - protein, 10 aa, Yellow fever virus
GCGLFGKGGI

SEQ ID NO: 247169 - protein, 10 aa, Yellow fever virus
ALGSQEGALH

SEQ ID NO: 247170 - protein, 10 aa, Yellow fever virus
RLAALGDTAW

SEQ ID NO: 247171 - protein, 10 aa, Yellow fever virus
LAALGDTAWD

SEQ ID NO: 247172 - protein, 10 aa, Yellow fever virus
AALGDTAWDF

SEQ ID NO: 247173 - protein, 10 aa, Yellow fever virus
ALGDTAWDFG

SEQ ID NO: 247174 - protein, 10 aa, Yellow fever virus
LGETAWDFGS

SEQ ID NO: 247175 - protein, 10 aa, Yellow fever virus
TAWDFGSVGG

SEQ ID NO: 247176 - protein, 10 aa, Yellow fever virus
AIHSDLSYWI

SEQ ID NO: 247177 - protein, 10 aa, Yellow fever virus
IHSDLSYWIE

SEQ ID NO: 247178 - protein, 10 aa, Yellow fever virus
HSDLSYWIES

SEQ ID NO: 247179 - protein, 10 aa, Yellow fever virus
WPETHTLWGD

SEQ ID NO: 247180 - protein, 10 aa, Yellow fever virus
WCCRSCTMPP

SEQ ID NO: 247181 - protein, 10 aa, Yellow fever virus
CCRSCTMPPL

SEQ ID NO: 247182 - protein, 10 aa, Yellow fever virus
CRSCTMPPLR

SEQ ID NO: 247183 - protein, 10 aa, Yellow fever virus
TDSGCWYGME

SEQ ID NO: 247184 - protein, 10 aa, Yellow fever virus
DSGCWYGMEI

SEQ ID NO: 247185 - protein, 10 aa, Yellow fever virus
SGCWYGMEIR

SEQ ID NO: 247186 - protein, 10 aa, Yellow fever virus
DCWYAMEIRP

SEQ ID NO: 247187 - protein, 10 aa, Yellow fever virus
TFHTMWHVTR

SEQ ID NO: 247188 - protein, 10 aa, Yellow fever virus
FHTLWHTTKG

SEQ ID NO: 247189 - protein, 10 aa, Yellow fever virus
HTLWHTTKGA

SEQ ID NO: 247190 - protein, 10 aa, Yellow fever virus
TLWHTTKGAA

SEQ ID NO: 247191 - protein, 10 aa, Yellow fever virus
LWHTTKGAAL

SEQ ID NO: 247192 - protein, 10 aa, Yellow fever virus
MDLHPGAGKT

SEQ ID NO: 247193 - protein, 10 aa, Yellow fever virus
DLHPGAGKTK

SEQ ID NO: 247194 - protein, 10 aa, Yellow fever virus
LRTAVLAPTR

SEQ ID NO: 247195 - protein, 10 aa, Yellow fever virus
RTAVLAPTRV

SEQ ID NO: 247196 - protein, 10 aa, Yellow fever virus
TAVLAPTRVV

SEQ ID NO: 247197 - protein, 10 aa, Yellow fever virus
AVLAPTRVVA

SEQ ID NO: 247198 - protein, 10 aa, Yellow fever virus
ILAPTRVVAS

SEQ ID NO: 247199 - protein, 10 aa, Yellow fever virus
LAPTRVVASE

SEQ ID NO: 247200 - protein, 10 aa, Yellow fever virus
APTRVVASEM

SEQ ID NO: 247201 - protein, 10 aa, Yellow fever virus
PTRVVASEMA

SEQ ID NO: 247202 - protein, 10 aa, Yellow fever virus
TRVVASEMAE

SEQ ID NO: 247203 - protein, 10 aa, Yellow fever virus
RVVASEMAEA

SEQ ID NO: 247204 - protein, 10 aa, Yellow fever virus
VVASEMAEAL

SEQ ID NO: 247205 - protein, 10 aa, Yellow fever virus
GKEIVDLMCH

SEQ ID NO: 247206 - protein, 10 aa, Yellow fever virus
KEIVDLMCHA

SEQ ID NO: 247207 - protein, 10 aa, Yellow fever virus
EIVDVMCHAT

SEQ ID NO: 247208 - protein, 10 aa, Yellow fever virus
IVDVMCHATL

SEQ ID NO: 247209 - protein, 10 aa, Yellow fever virus
VDVMCHATLT

SEQ ID NO: 247210 - protein, 10 aa, Yellow fever virus
DVMCHATLTH

SEQ ID NO: 247211 - protein, 10 aa, Yellow fever virus
VMCHATLTHR

SEQ ID NO: 247212 - protein, 10 aa, Yellow fever virus
MCHATLTHRL

SEQ ID NO: 247213 - protein, 10 aa, Yellow fever virus
CHATLTHRLM

SEQ ID NO: 247214 - protein, 10 aa, Yellow fever virus
HATLTHRLMS

SEQ ID NO: 247215 - protein, 10 aa, Yellow fever virus
ATLTHRLMSP

SEQ ID NO: 247216 - protein, 10 aa, Yellow fever virus
VMDEAHFTDP

SEQ ID NO: 247217 - protein, 10 aa, Yellow fever virus
MDEAHFTDPS

SEQ ID NO: 247218 - protein, 10 aa, Yellow fever virus
DEAHFTDPSS

SEQ ID NO: 247219 - protein, 10 aa, Yellow fever virus
EAHFTDPSSI

SEQ ID NO: 247220 - protein, 10 aa, Yellow fever virus
AHFTDPSSIA

SEQ ID NO: 247221 - protein, 10 aa, Yellow fever virus
HFTDPSSIAA

SEQ ID NO: 247222 - protein, 10 aa, Yellow fever virus
FTDPSSIAAR

SEQ ID NO: 247223 - protein, 10 aa, Yellow fever virus
TDPSSIAARG

SEQ ID NO: 247224 - protein, 10 aa, Yellow fever virus
DPSSIAARGY

SEQ ID NO: 247225 - protein, 10 aa, Yellow fever virus
PSSIAARGYI

SEQ ID NO: 247226 - protein, 10 aa, Yellow fever virus
SVAARGYIST

SEQ ID NO: 247227 - protein, 10 aa, Yellow fever virus
AARGYISTKV

SEQ ID NO: 247228 - protein, 10 aa, Yellow fever virus
MGEAAGIFMT

SEQ ID NO: 247229 - protein, 10 aa, Yellow fever virus
GEAAGIFMTA

SEQ ID NO: 247230 - protein, 10 aa, Yellow fever virus
EAAGIFMTAT

SEQ ID NO: 247231 - protein, 10 aa, Yellow fever virus
AAGIFMTATP

SEQ ID NO: 247232 - protein, 10 aa, Yellow fever virus
AGIFMTATPP

SEQ ID NO: 247233 - protein, 10 aa, Yellow fever virus
GIFMTATPPG

SEQ ID NO: 247234 - protein, 10 aa, Yellow fever virus
IFMTATPPGT

SEQ ID NO: 247235 - protein, 10 aa, Yellow fever virus
GKTVWFVPSV

SEQ ID NO: 247236 - protein, 10 aa, Yellow fever virus
DWDYVVTTDI

SEQ ID NO: 247237 - protein, 10 aa, Yellow fever virus
WDYVVTTDIS

SEQ ID NO: 247238 - protein, 10 aa, Yellow fever virus
DYVVTTDISE

SEQ ID NO: 247239 - protein, 10 aa, Yellow fever virus
YVVTTDISEM

SEQ ID NO: 247240 - protein, 10 aa, Yellow fever virus
VITTDISEMG

SEQ ID NO: 247241 - protein, 10 aa, Yellow fever virus
ITTDISEMGA

SEQ ID NO: 247242 - protein, 10 aa, Yellow fever virus
TDISEMGANL

SEQ ID NO: 247243 - protein, 10 aa, Yellow fever virus
DISEMGANFR

SEQ ID NO: 247244 - protein, 10 aa, Yellow fever virus
ISEMGANFRA

SEQ ID NO: 247245 - protein, 10 aa, Yellow fever virus
RVIDPRRCMK

SEQ ID NO: 247246 - protein, 10 aa, Yellow fever virus
VIDPRRCMKP

SEQ ID NO: 247247 - protein, 10 aa, Yellow fever virus
IDPRRCMKPV

SEQ ID NO: 247248 - protein, 10 aa, Yellow fever virus
DPRRCMKPVI

SEQ ID NO: 247249 - protein, 10 aa, Yellow fever virus
PRRCMKPVIL

SEQ ID NO: 247250 - protein, 10 aa, Yellow fever virus
SSAAQRRGRI

SEQ ID NO: 247251 - protein, 10 aa, Yellow fever virus
SAAQRRGRVG

SEQ ID NO: 247252 - protein, 10 aa, Yellow fever virus
AAQRRGRVGR

SEQ ID NO: 247253 - protein, 10 aa, Yellow fever virus
AQRRGRVGRN

SEQ ID NO: 247254 - protein, 10 aa, Yellow fever virus
LLRTADLPVW

SEQ ID NO: 247255 - protein, 10 aa, Yellow fever virus
LRTADLPVWL

SEQ ID NO: 247256 - protein, 10 aa, Yellow fever virus
RRGDLPVWLS

SEQ ID NO: 247257 - protein, 10 aa, Yellow fever virus
LLIPEPDRQR

SEQ ID NO: 247258 - protein, 10 aa, Yellow fever virus
LIPEPDRQRT

SEQ ID NO: 247259 - protein, 10 aa, Yellow fever virus
IPEPDRQRTP

SEQ ID NO: 247260 - protein, 10 aa, Yellow fever virus
PEPDRQRTPQ

SEQ ID NO: 247261 - protein, 10 aa, Yellow fever virus
EPDRQRTPQD

SEQ ID NO: 247262 - protein, 10 aa, Yellow fever virus
PDRQRTPQDN

SEQ ID NO: 247263 - protein, 10 aa, Yellow fever virus
DRQRTPQDNQ

SEQ ID NO: 247264 - protein, 10 aa, Yellow fever virus
RQRTPQDNQL

SEQ ID NO: 247265 - protein, 10 aa, Yellow fever virus
QRTPQDNQLT

SEQ ID NO: 247266 - protein, 10 aa, Yellow fever virus
PATAWSLYAV

SEQ ID NO: 247267 - protein, 10 aa, Yellow fever virus
ATAWSLYAVT

SEQ ID NO: 247268 - protein, 10 aa, Yellow fever virus
TAWSLYAVTT

SEQ ID NO: 247269 - protein, 10 aa, Yellow fever virus
AWSLYAVTTA

SEQ ID NO: 247270 - protein, 10 aa, Yellow fever virus
HYAYMVPGWQ

SEQ ID NO: 247271 - protein, 10 aa, Yellow fever virus
YAYMVPGWQA

SEQ ID NO: 247272 - protein, 10 aa, Yellow fever virus
AYMVPGWQAE

SEQ ID NO: 247273 - protein, 10 aa, Yellow fever virus
YMVPGWQAEA

SEQ ID NO: 247274 - protein, 10 aa, Yellow fever virus
MVPGWQAEAM

SEQ ID NO: 247275 - protein, 10 aa, Yellow fever virus
VPGWQAEAMR

SEQ ID NO: 247276 - protein, 10 aa, Yellow fever virus
PGWQAEAMRS

SEQ ID NO: 247277 - protein, 10 aa, Yellow fever virus
GWQAEAMRSA

SEQ ID NO: 247278 - protein, 10 aa, Yellow fever virus
WQAEAMRSAQ

SEQ ID NO: 247279 - protein, 10 aa, Yellow fever virus
QAEAMRSAQR

SEQ ID NO: 247280 - protein, 10 aa, Yellow fever virus
AEAMRSAQRR

SEQ ID NO: 247281 - protein, 10 aa, Yellow fever virus
REAQKRAAAG

SEQ ID NO: 247282 - protein, 10 aa, Yellow fever virus
EAQKRAAAGI

SEQ ID NO: 247283 - protein, 10 aa, Yellow fever virus
AQKRAAAGIM

SEQ ID NO: 247284 - protein, 10 aa, Yellow fever virus
QKRAAAGIMK

SEQ ID NO: 247285 - protein, 10 aa, Yellow fever virus
KRAAAGIMKN

SEQ ID NO: 247286 - protein, 10 aa, Yellow fever virus
RAAAGIMKNP

SEQ ID NO: 247287 - protein, 10 aa, Yellow fever virus
AAAGIMKNPT

SEQ ID NO: 247288 - protein, 10 aa, Yellow fever virus
AAGIMKNAVV

SEQ ID NO: 247289 - protein, 10 aa, Yellow fever virus
AGIMKNAVVD

SEQ ID NO: 247290 - protein, 10 aa, Yellow fever virus
GIMKNAVVDG

SEQ ID NO: 247291 - protein, 10 aa, Yellow fever virus
FEKQLGQIML

SEQ ID NO: 247292 - protein, 10 aa, Yellow fever virus
GRFWNTTIAV

SEQ ID NO: 247293 - protein, 10 aa, Yellow fever virus
RFWNTTIAVS

SEQ ID NO: 247294 - protein, 10 aa, Yellow fever virus
CHIMRGGWLS

SEQ ID NO: 247295 - protein, 10 aa, Yellow fever virus
HIMRGGWLSC

SEQ ID NO: 247296 - protein, 10 aa, Yellow fever virus
IMRGGWLSCL

SEQ ID NO: 247297 - protein, 10 aa, Yellow fever virus
MRGGWLSCLS

SEQ ID NO: 247298 - protein, 10 aa, Yellow fever virus
RGGWLSCLSI

SEQ ID NO: 247299 - protein, 10 aa, Yellow fever virus
VSRGSAKLRW

SEQ ID NO: 247300 - protein, 10 aa, Yellow fever virus
GKVVDLGCGR

SEQ ID NO: 247301 - protein, 10 aa, Yellow fever virus
KVVDLGCGRG

SEQ ID NO: 247302 - protein, 10 aa, Yellow fever virus
VVDLGCGRGG

SEQ ID NO: 247303 - protein, 10 aa, Yellow fever virus
VDLGCGRGGW

SEQ ID NO: 247304 - protein, 10 aa, Yellow fever virus
DLGCGRGGWC

SEQ ID NO: 247305 - protein, 10 aa, Yellow fever virus
LGCGRGGWCY

SEQ ID NO: 247306 - protein, 10 aa, Yellow fever virus
GCGRGGWCYY

SEQ ID NO: 247307 - protein, 10 aa, Yellow fever virus
CGRGGWCYYM

SEQ ID NO: 247308 - protein, 10 aa, Yellow fever virus
GLTKGGPGHE

SEQ ID NO: 247309 - protein, 10 aa, Yellow fever virus
TKGGAGHEEP

SEQ ID NO: 247310 - protein, 10 aa, Yellow fever virus
VDTLLCDIGE

SEQ ID NO: 247311 - protein, 10 aa, Yellow fever virus
DTLFCDIGES

SEQ ID NO: 247312 - protein, 10 aa, Yellow fever virus
TLFCDIGESS

SEQ ID NO: 247313 - protein, 10 aa, Yellow fever virus
LLCDIGESSS

SEQ ID NO: 247314 - protein, 10 aa, Yellow fever virus
LVRCPLSRNS

SEQ ID NO: 247315 - protein, 10 aa, Yellow fever virus
VRCPLSRNST

SEQ ID NO: 247316 - protein, 10 aa, Yellow fever virus
RCPLSRNSTH

SEQ ID NO: 247317 - protein, 10 aa, Yellow fever virus
CPLSRNSTHE

SEQ ID NO: 247318 - protein, 10 aa, Yellow fever virus
PLSRNSNHEM

SEQ ID NO: 247319 - protein, 10 aa, Yellow fever virus
LSRNSNHEMY

SEQ ID NO: 247320 - protein, 10 aa, Yellow fever virus
SRNSNHEMYW

SEQ ID NO: 247321 - protein, 10 aa, Yellow fever virus
RNSTHEMYWI

SEQ ID NO: 247322 - protein, 10 aa, Yellow fever virus
NSTHEMYWIS

SEQ ID NO: 247323 - protein, 10 aa, Yellow fever virus
PYRTWNYHGS

SEQ ID NO: 247324 - protein, 10 aa, Yellow fever virus
YRTWNYHGSY

SEQ ID NO: 247325 - protein, 10 aa, Yellow fever virus
GSASSMINGV

SEQ ID NO: 247326 - protein, 10 aa, Yellow fever virus
SASSMINGVV

SEQ ID NO: 247327 - protein, 10 aa, Yellow fever virus
NGVVRLLTKP

SEQ ID NO: 247328 - protein, 10 aa, Yellow fever virus
GVVRLLTKPW

SEQ ID NO: 247329 - protein, 10 aa, Yellow fever virus
VVRLLTKPWD

SEQ ID NO: 247330 - protein, 10 aa, Yellow fever virus
IAMTDTTPFG

SEQ ID NO: 247331 - protein, 10 aa, Yellow fever virus
AMTDTTAFGQ

SEQ ID NO: 247332 - protein, 10 aa, Yellow fever virus
MTDTTAFGQQ

SEQ ID NO: 247333 - protein, 10 aa, Yellow fever virus
TDTTAFGQQR

SEQ ID NO: 247334 - protein, 10 aa, Yellow fever virus
DTTAFGQQRV

SEQ ID NO: 247335 - protein, 10 aa, Yellow fever virus
TTAFGQQRVF

SEQ ID NO: 247336 - protein, 10 aa, Yellow fever virus
TAFGQQRVFK

SEQ ID NO: 247337 - protein, 10 aa, Yellow fever virus
AFGQQRVFKE

SEQ ID NO: 247338 - protein, 10 aa, Yellow fever virus
RVFKEKVDTK

SEQ ID NO: 247339 - protein, 10 aa, Yellow fever virus
VFKEKVDTKA

SEQ ID NO: 247340 - protein, 10 aa, Yellow fever virus
FKEKVDTRTQ

SEQ ID NO: 247341 - protein, 10 aa, Yellow fever virus
SCVYNMMGKR

SEQ ID NO: 247342 - protein, 10 aa, Yellow fever virus
CIYNMMGKRE

SEQ ID NO: 247343 - protein, 10 aa, Yellow fever virus
IYNMMGKREK

SEQ ID NO: 247344 - protein, 10 aa, Yellow fever virus
NMMGKREKKP

SEQ ID NO: 247345 - protein, 10 aa, Yellow fever virus
MMGKREKKPG

SEQ ID NO: 247346 - protein, 10 aa, Yellow fever virus
MGKREKKPGE

SEQ ID NO: 247347 - protein, 10 aa, Yellow fever virus
GKREKKPGEF

SEQ ID NO: 247348 - protein, 10 aa, Yellow fever virus
KREKKPGEFG

SEQ ID NO: 247349 - protein, 10 aa, Yellow fever virus
REKKPGEFGK

SEQ ID NO: 247350 - protein, 10 aa, Yellow fever virus
EKKPGEFGKA

SEQ ID NO: 247351 - protein, 10 aa, Yellow fever virus
KKPGEFGKAK

SEQ ID NO: 247352 - protein, 10 aa, Yellow fever virus
KPGEFGKAKG

SEQ ID NO: 247353 - protein, 10 aa, Yellow fever virus
PGEFGKAKGS

SEQ ID NO: 247354 - protein, 10 aa, Yellow fever virus
GEFGRAKGSR

SEQ ID NO: 247355 - protein, 10 aa, Yellow fever virus
EFGRAKGSRA

SEQ ID NO: 247356 - protein, 10 aa, Yellow fever virus
FGRAKGSRAI

SEQ ID NO: 247357 - protein, 10 aa, Yellow fever virus
GRAKGSRAIW

SEQ ID NO: 247358 - protein, 10 aa, Yellow fever virus
KAKGSRAIWF

SEQ ID NO: 247359 - protein, 10 aa, Yellow fever virus
AKGSRAIWFM

SEQ ID NO: 247360 - protein, 10 aa, Yellow fever virus
KGSRAIWFMW

SEQ ID NO: 247361 - protein, 10 aa, Yellow fever virus
GSRAIWFMWL

SEQ ID NO: 247362 - protein, 10 aa, Yellow fever virus
SRAIWFMWLG

SEQ ID NO: 247363 - protein, 10 aa, Yellow fever virus
RAIWFMWLGA

SEQ ID NO: 247364 - protein, 10 aa, Yellow fever virus
AIWFMWLGAR

SEQ ID NO: 247365 - protein, 10 aa, Yellow fever virus
IWYMWLGARY

SEQ ID NO: 247366 - protein, 10 aa, Yellow fever virus
WYMWLGARYL

SEQ ID NO: 247367 - protein, 10 aa, Yellow fever virus
YMWLGARYLE

SEQ ID NO: 247368 - protein, 10 aa, Yellow fever virus
MWLGARYLEF

SEQ ID NO: 247369 - protein, 10 aa, Yellow fever virus
WLGARYLEFE

SEQ ID NO: 247370 - protein, 10 aa, Yellow fever virus
LGARYLEFEA

SEQ ID NO: 247371 - protein, 10 aa, Yellow fever virus
GARYLEFEAL

SEQ ID NO: 247372 - protein, 10 aa, Yellow fever virus
ARYLEFEALG

SEQ ID NO: 247373 - protein, 10 aa, Yellow fever virus
RYLEFEALGF

SEQ ID NO: 247374 - protein, 10 aa, Yellow fever virus
FLEFEALGFL

SEQ ID NO: 247375 - protein, 10 aa, Yellow fever virus
LEFEALGFMN

SEQ ID NO: 247376 - protein, 10 aa, Yellow fever virus
EFEALGFMNE

SEQ ID NO: 247377 - protein, 10 aa, Yellow fever virus
FEALGFMNED

SEQ ID NO: 247378 - protein, 10 aa, Yellow fever virus
EALGFMNEDH

SEQ ID NO: 247379 - protein, 10 aa, Yellow fever virus
ALGFMNEDHW

SEQ ID NO: 247380 - protein, 10 aa, Yellow fever virus
LGFMNEDHWF

SEQ ID NO: 247381 - protein, 10 aa, Yellow fever virus
IYADDTAGWD

SEQ ID NO: 247382 - protein, 10 aa, Yellow fever virus
ADDTAGWDTK

SEQ ID NO: 247383 - protein, 10 aa, Yellow fever virus
DDTAGWDTKV

SEQ ID NO: 247384 - protein, 10 aa, Yellow fever virus
DTAGWDTKVT

SEQ ID NO: 247385 - protein, 10 aa, Yellow fever virus
IIELTYRHKV

SEQ ID NO: 247386 - protein, 10 aa, Yellow fever virus
IELTYRHKVV

SEQ ID NO: 247387 - protein, 10 aa, Yellow fever virus
KLTYQNKVVK

SEQ ID NO: 247388 - protein, 10 aa, Yellow fever virus
LTYQNKVVKV

SEQ ID NO: 247389 - protein, 10 aa, Yellow fever virus
MDIISRKDQR

SEQ ID NO: 247390 - protein, 10 aa, Yellow fever virus
DIISRKDQRG

SEQ ID NO: 247391 - protein, 10 aa, Yellow fever virus
IISRKDQRGS

SEQ ID NO: 247392 - protein, 10 aa, Yellow fever virus
ISRKDQRGSG

SEQ ID NO: 247393 - protein, 10 aa, Yellow fever virus
SRKDQRGSGQ

SEQ ID NO: 247394 - protein, 10 aa, Yellow fever virus
RKDQRGSGQV

SEQ ID NO: 247395 - protein, 10 aa, Yellow fever virus
KDQRGSGQVG

SEQ ID NO: 247396 - protein, 10 aa, Yellow fever virus
DQRGSGQVVT

SEQ ID NO: 247397 - protein, 10 aa, Yellow fever virus
QRGSGQVVTY

SEQ ID NO: 247398 - protein, 10 aa, Yellow fever virus
RGSGQVVTYA

SEQ ID NO: 247399 - protein, 10 aa, Yellow fever virus
GSGQVVTYAL

SEQ ID NO: 247400 - protein, 10 aa, Yellow fever virus
SGQVVTYALN

SEQ ID NO: 247401 - protein, 10 aa, Yellow fever virus
GQVVTYALNT

SEQ ID NO: 247402 - protein, 10 aa, Yellow fever virus
RMAVSGDDCV

SEQ ID NO: 247403 - protein, 10 aa, Yellow fever virus
MAVSGDDCVV

SEQ ID NO: 247404 - protein, 10 aa, Yellow fever virus
AVSGDDCVVK

SEQ ID NO: 247405 - protein, 10 aa, Yellow fever virus
VSGDDCVVKP

SEQ ID NO: 247406 - protein, 10 aa, Yellow fever virus
LNDMGKIRKD

SEQ ID NO: 247407 - protein, 10 aa, Yellow fever virus
NDMGKIRKDI

SEQ ID NO: 247408 - protein, 10 aa, Yellow fever virus
QVPFCSNHFT

SEQ ID NO: 247409 - protein, 10 aa, Yellow fever virus
VPFCSHHFHQ

SEQ ID NO: 247410 - protein, 10 aa, Yellow fever virus
PFCSHHFHQL

SEQ ID NO: 247411 - protein, 10 aa, Yellow fever virus
QDELVGRARV

SEQ ID NO: 247412 - protein, 10 aa, Yellow fever virus
DELVGRARVS

SEQ ID NO: 247413 - protein, 10 aa, Yellow fever virus
GRARVSQGAG

SEQ ID NO: 247414 - protein, 10 aa, Yellow fever virus
RARVSQGAGW

SEQ ID NO: 247415 - protein, 10 aa, Yellow fever virus
ARVSQGAGWS

SEQ ID NO: 247416 - protein, 10 aa, Yellow fever virus
RVSQGAGWSL

SEQ ID NO: 247417 - protein, 10 aa, Yellow fever virus
TACLGKAYAQ

SEQ ID NO: 247418 - protein, 10 aa, Yellow fever virus
ACLGKAYAQM

SEQ ID NO: 247419 - protein, 10 aa, Yellow fever virus
LLYFHRRDLR

SEQ ID NO: 247420 - protein, 10 aa, Yellow fever virus
LYFHRRDLRL

SEQ ID NO: 247421 - protein, 10 aa, Yellow fever virus
YFHRRDLRLM

SEQ ID NO: 247422 - protein, 10 aa, Yellow fever virus
FHRRDLRLAS

SEQ ID NO: 247423 - protein, 10 aa, Yellow fever virus
PTGRTTWSIH

SEQ ID NO: 247424 - protein, 10 aa, Yellow fever virus
TGRTTWSIHA

SEQ ID NO: 247425 - protein, 10 aa, Yellow fever virus
HEWMTTEDML

SEQ ID NO: 247426 - protein, 10 aa, Yellow fever virus
GKREDIWCGS

SEQ ID NO: 247427 - protein, 10 aa, Yellow fever virus
KREDIWCGSL

SEQ ID NO: 247428 - protein, 10 aa, Yellow fever virus
REDIWCGSLI

SEQ ID NO: 247429 - protein, 10 aa, Yellow fever virus
EDIWCGSLIG

SEQ ID NO: 247430 - protein, 10 aa, Yellow fever virus
DIWCGSLIGT

SEQ ID NO: 247431 - protein, 10 aa, Yellow fever virus
IWCGSLIGTR

SEQ ID NO: 247432 - protein, 10 aa, Yellow fever virus
SQLAKRFSRG

SEQ ID NO: 247433 - protein, 10 aa, Yellow fever virus
QLAKRFSRGL

SEQ ID NO: 247434 - protein, 10 aa, Yellow fever virus
LAKRFSRGLL

SEQ ID NO: 247435 - protein, 10 aa, Yellow fever virus
SDRGWGNHCG

SEQ ID NO: 247436 - protein, 10 aa, Yellow fever virus
NHCGLFGKGS

SEQ ID NO: 247437 - protein, 10 aa, Yellow fever virus
GCGLFGKGSI

SEQ ID NO: 247438 - protein, 10 aa, Yellow fever virus
ALGSQEGGLH

SEQ ID NO: 247439 - protein, 10 aa, Yellow fever virus
RMAILGETAW

SEQ ID NO: 247440 - protein, 10 aa, Yellow fever virus
MAILGETAWD

SEQ ID NO: 247441 - protein, 10 aa, Yellow fever virus
AILGETAWDF

SEQ ID NO: 247442 - protein, 10 aa, Yellow fever virus
ILGETAWDFG

SEQ ID NO: 247443 - protein, 10 aa, Yellow fever virus
IGEHAWDFGS

SEQ ID NO: 247444 - protein, 10 aa, Yellow fever virus
TAWDFGSLGG

SEQ ID NO: 247445 - protein, 10 aa, Yellow fever virus
AVHSDLSYWI

SEQ ID NO: 247446 - protein, 10 aa, Yellow fever virus
VHSDLSYWIE

SEQ ID NO: 247447 - protein, 10 aa, Yellow fever virus
HTDQSLWMKS

SEQ ID NO: 247448 - protein, 10 aa, Yellow fever virus
WPKTHTLWSN

SEQ ID NO: 247449 - protein, 10 aa, Yellow fever virus
WCCRSCSLPP

SEQ ID NO: 247450 - protein, 10 aa, Yellow fever virus
CCRSCSLPPL

SEQ ID NO: 247451 - protein, 10 aa, Yellow fever virus
CRSCSLPPLR

SEQ ID NO: 247452 - protein, 10 aa, Yellow fever virus
TENGCWYGME

SEQ ID NO: 247453 - protein, 10 aa, Yellow fever virus
ENGCWYGMEI

SEQ ID NO: 247454 - protein, 10 aa, Yellow fever virus
NGCWYGMEIR

SEQ ID NO: 247455 - protein, 10 aa, Yellow fever virus
VFHTLWHTTK

SEQ ID NO: 247456 - protein, 10 aa, Yellow fever virus
FHTLWHTTRG

SEQ ID NO: 247457 - protein, 10 aa, Yellow fever virus
HTMWHVTRGS

SEQ ID NO: 247458 - protein, 10 aa, Yellow fever virus
TMWHVTRGSV

SEQ ID NO: 247459 - protein, 10 aa, Yellow fever virus
MWHVTRGSVI

SEQ ID NO: 247460 - protein, 10 aa, Yellow fever virus
LDLHPGAGKT

SEQ ID NO: 247461 - protein, 10 aa, Yellow fever virus
DLHPGAGKTR

SEQ ID NO: 247462 - protein, 10 aa, Yellow fever virus
LRTLVLAPTR

SEQ ID NO: 247463 - protein, 10 aa, Yellow fever virus
RTLVLAPTRV

SEQ ID NO: 247464 - protein, 10 aa, Yellow fever virus
TLVLAPTRVV

SEQ ID NO: 247465 - protein, 10 aa, Yellow fever virus
LVLAPTRVVL

SEQ ID NO: 247466 - protein, 10 aa, Yellow fever virus
VLAPTRVVAA

SEQ ID NO: 247467 - protein, 10 aa, Yellow fever virus
LAPTRVVLKE

SEQ ID NO: 247468 - protein, 10 aa, Yellow fever virus
APTRVVLKEM

SEQ ID NO: 247469 - protein, 10 aa, Yellow fever virus
PTRVVAAEMA

SEQ ID NO: 247470 - protein, 10 aa, Yellow fever virus
TRVVAAEMAE

SEQ ID NO: 247471 - protein, 10 aa, Yellow fever virus
RVVAAEMAEA

SEQ ID NO: 247472 - protein, 10 aa, Yellow fever virus
VVAAEMAEAL

SEQ ID NO: 247473 - protein, 10 aa, Yellow fever virus
GNEIVDVMCH

SEQ ID NO: 247474 - protein, 10 aa, Yellow fever virus
NEIVDVMCHA

SEQ ID NO: 247475 - protein, 10 aa, Yellow fever virus
AIVDVMCHAT

SEQ ID NO: 247476 - protein, 10 aa, Yellow fever virus
IVDVMCHATY

SEQ ID NO: 247477 - protein, 10 aa, Yellow fever virus
VDVMCHATYV

SEQ ID NO: 247478 - protein, 10 aa, Yellow fever virus
DLMCHATFTT

SEQ ID NO: 247479 - protein, 10 aa, Yellow fever virus
LMCHATFTTR

SEQ ID NO: 247480 - protein, 10 aa, Yellow fever virus
MCHATFTTRL

SEQ ID NO: 247481 - protein, 10 aa, Yellow fever virus
CHATFTTRLL

SEQ ID NO: 247482 - protein, 10 aa, Yellow fever virus
HATFTTRLLS

SEQ ID NO: 247483 - protein, 10 aa, Yellow fever virus
ATFTTRLLSS

SEQ ID NO: 247484 - protein, 10 aa, Yellow fever virus
IMDEAHWTDP

SEQ ID NO: 247485 - protein, 10 aa, Yellow fever virus
MDEAHWTDPH

SEQ ID NO: 247486 - protein, 10 aa, Yellow fever virus
DEAHWTDPHS

SEQ ID NO: 247487 - protein, 10 aa, Yellow fever virus
EAHFTDPSSV

SEQ ID NO: 247488 - protein, 10 aa, Yellow fever virus
AHFTDPSSVA

SEQ ID NO: 247489 - protein, 10 aa, Yellow fever virus
HFTDPSSVAA

SEQ ID NO: 247490 - protein, 10 aa, Yellow fever virus
FTDPSSVAAR

SEQ ID NO: 247491 - protein, 10 aa, Yellow fever virus
TDPSSVAARG

SEQ ID NO: 247492 - protein, 10 aa, Yellow fever virus
DPSSVAARGY

SEQ ID NO: 247493 - protein, 10 aa, Yellow fever virus
PSSVAARGYI

SEQ ID NO: 247494 - protein, 10 aa, Yellow fever virus
SIAARGYIAT

SEQ ID NO: 247495 - protein, 10 aa, Yellow fever virus
AARGYIATKV

SEQ ID NO: 247496 - protein, 10 aa, Yellow fever virus
LGEAAAIFMT

SEQ ID NO: 247497 - protein, 10 aa, Yellow fever virus
NKCALVLMTA

SEQ ID NO: 247498 - protein, 10 aa, Yellow fever virus
KCALVLMTAT

SEQ ID NO: 247499 - protein, 10 aa, Yellow fever virus
CALVLMTATP

SEQ ID NO: 247500 - protein, 10 aa, Yellow fever virus
ALVLMTATPP

SEQ ID NO: 247501 - protein, 10 aa, Yellow fever virus
LVLMTATPPG

SEQ ID NO: 247502 - protein, 10 aa, Yellow fever virus
IFMTATPPGA

SEQ ID NO: 247503 - protein, 10 aa, Yellow fever virus
GKTVWFVASV

SEQ ID NO: 247504 - protein, 10 aa, Yellow fever virus
DWDFVITTDI

SEQ ID NO: 247505 - protein, 10 aa, Yellow fever virus
WDFVITTDIS

SEQ ID NO: 247506 - protein, 10 aa, Yellow fever virus
DFVITTDISE

SEQ ID NO: 247507 - protein, 10 aa, Yellow fever virus
FVITTDISEM

SEQ ID NO: 247508 - protein, 10 aa, Yellow fever virus
DISEMGANFG

SEQ ID NO: 247509 - protein, 10 aa, Yellow fever virus
ISEMGANFGA

SEQ ID NO: 247510 - protein, 10 aa, Yellow fever virus
RVIDSRKSVK

SEQ ID NO: 247511 - protein, 10 aa, Yellow fever virus
VIDSRKSVKP

SEQ ID NO: 247512 - protein, 10 aa, Yellow fever virus
IDSRKSVKPT

SEQ ID NO: 247513 - protein, 10 aa, Yellow fever virus
DSRKSVKPTI

SEQ ID NO: 247514 - protein, 10 aa, Yellow fever virus
SRKSVKPTII

SEQ ID NO: 247515 - protein, 10 aa, Yellow fever virus
ASAAQRRGRV

SEQ ID NO: 247516 - protein, 10 aa, Yellow fever virus
AQRRGRVGRQ

SEQ ID NO: 247517 - protein, 10 aa, Yellow fever virus
LLTHCDFTPW

SEQ ID NO: 247518 - protein, 10 aa, Yellow fever virus
LTHCDFTPWL

SEQ ID NO: 247519 - protein, 10 aa, Yellow fever virus
RTADLPVWLA

SEQ ID NO: 247520 - protein, 10 aa, Yellow fever virus
VLIPEPEKQR

SEQ ID NO: 247521 - protein, 10 aa, Yellow fever virus
LIPEPEKQRS

SEQ ID NO: 247522 - protein, 10 aa, Yellow fever virus
IPEPEKQRSQ

SEQ ID NO: 247523 - protein, 10 aa, Yellow fever virus
PEPEKQRSQT

SEQ ID NO: 247524 - protein, 10 aa, Yellow fever virus
EPEKQRSQTD

SEQ ID NO: 247525 - protein, 10 aa, Yellow fever virus
PEKQRSQTDN

SEQ ID NO: 247526 - protein, 10 aa, Yellow fever virus
EKQRSQTDNQ

SEQ ID NO: 247527 - protein, 10 aa, Yellow fever virus
KQRSQTDNQL

SEQ ID NO: 247528 - protein, 10 aa, Yellow fever virus
QRSQTDNQLA

SEQ ID NO: 247529 - protein, 10 aa, Yellow fever virus
PATAWALYGG

SEQ ID NO: 247530 - protein, 10 aa, Yellow fever virus
ATAWALYGGS

SEQ ID NO: 247531 - protein, 10 aa, Yellow fever virus
TAWALYGGST

SEQ ID NO: 247532 - protein, 10 aa, Yellow fever virus
AWALYGGSTV

SEQ ID NO: 247533 - protein, 10 aa, Yellow fever virus
HYGYMLPGWQ

SEQ ID NO: 247534 - protein, 10 aa, Yellow fever virus
YGYMLPGWQA

SEQ ID NO: 247535 - protein, 10 aa, Yellow fever virus
GYMLPGWQAE

SEQ ID NO: 247536 - protein, 10 aa, Yellow fever virus
YMLPGWQAEA

SEQ ID NO: 247537 - protein, 10 aa, Yellow fever virus
MLPGWQAEAL

SEQ ID NO: 247538 - protein, 10 aa, Yellow fever virus
LPGWQAEALR

SEQ ID NO: 247539 - protein, 10 aa, Yellow fever virus
PGWQAEALRA

SEQ ID NO: 247540 - protein, 10 aa, Yellow fever virus
GWQAEALRAA

SEQ ID NO: 247541 - protein, 10 aa, Yellow fever virus
WQAEALRAAQ

SEQ ID NO: 247542 - protein, 10 aa, Yellow fever virus
QAEALRAAQR

SEQ ID NO: 247543 - protein, 10 aa, Yellow fever virus
AEALRAAQRR

SEQ ID NO: 247544 - protein, 10 aa, Yellow fever virus
RSAQRRTAAG

SEQ ID NO: 247545 - protein, 10 aa, Yellow fever virus
SAQRRTAAGI

SEQ ID NO: 247546 - protein, 10 aa, Yellow fever virus
AQRRTAAGIM

SEQ ID NO: 247547 - protein, 10 aa, Yellow fever virus
QRRTAAGIMK

SEQ ID NO: 247548 - protein, 10 aa, Yellow fever virus
RRTAAGIMKN

SEQ ID NO: 247549 - protein, 10 aa, Yellow fever virus
RTAAGIMKNA

SEQ ID NO: 247550 - protein, 10 aa, Yellow fever virus
TAAGIMKNAV

SEQ ID NO: 247551 - protein, 10 aa, Yellow fever virus
AAGIMKNPTI

SEQ ID NO: 247552 - protein, 10 aa, Yellow fever virus
SAMVRNPMVD

SEQ ID NO: 247553 - protein, 10 aa, Yellow fever virus
AMVRNPMVDG

SEQ ID NO: 247554 - protein, 10 aa, Yellow fever virus
MQKKVGQIML

SEQ ID NO: 247555 - protein, 10 aa, Yellow fever virus
SSVWNATTAI

SEQ ID NO: 247556 - protein, 10 aa, Yellow fever virus
SVWNATTAIG

SEQ ID NO: 247557 - protein, 10 aa, Yellow fever virus
CHVMRGSYLA

SEQ ID NO: 247558 - protein, 10 aa, Yellow fever virus
HVMRGSYLAG

SEQ ID NO: 247559 - protein, 10 aa, Yellow fever virus
VMRGSYLAGG

SEQ ID NO: 247560 - protein, 10 aa, Yellow fever virus
MRGSYLAGGS

SEQ ID NO: 247561 - protein, 10 aa, Yellow fever virus
RGSYLAGGSI

SEQ ID NO: 247562 - protein, 10 aa, Yellow fever virus
VSRGSAKLQW

SEQ ID NO: 247563 - protein, 10 aa, Yellow fever virus
GRVIDLGCGR

SEQ ID NO: 247564 - protein, 10 aa, Yellow fever virus
RVIDLGCGRG

SEQ ID NO: 247565 - protein, 10 aa, Yellow fever virus
VMDLGCGRGG

SEQ ID NO: 247566 - protein, 10 aa, Yellow fever virus
MDLGCGRGGW

SEQ ID NO: 247567 - protein, 10 aa, Yellow fever virus
CGRGGWSYYM

SEQ ID NO: 247568 - protein, 10 aa, Yellow fever virus
GYTKGGAGHE

SEQ ID NO: 247569 - protein, 10 aa, Yellow fever virus
TLGRDGHEKP

SEQ ID NO: 247570 - protein, 10 aa, Yellow fever virus
SDTLFCDIGE

SEQ ID NO: 247571 - protein, 10 aa, Yellow fever virus
DTIMCDIGES

SEQ ID NO: 247572 - protein, 10 aa, Yellow fever virus
TIMCDIGESN

SEQ ID NO: 247573 - protein, 10 aa, Yellow fever virus
LFCDIGESSP

SEQ ID NO: 247574 - protein, 10 aa, Yellow fever virus
LVRLPLSRNS

SEQ ID NO: 247575 - protein, 10 aa, Yellow fever virus
VRLPLSRNSN

SEQ ID NO: 247576 - protein, 10 aa, Yellow fever virus
RLPLSRNSNH

SEQ ID NO: 247577 - protein, 10 aa, Yellow fever virus
LPLSRNSNHE

SEQ ID NO: 247578 - protein, 10 aa, Yellow fever virus
PFSRNSTHEM

SEQ ID NO: 247579 - protein, 10 aa, Yellow fever virus
FSRNSTHEMY

SEQ ID NO: 247580 - protein, 10 aa, Yellow fever virus
SRNSTHEMYY

SEQ ID NO: 247581 - protein, 10 aa, Yellow fever virus
RNSNHEMYWV

SEQ ID NO: 247582 - protein, 10 aa, Yellow fever virus
NSNHEMYWVS

SEQ ID NO: 247583 - protein, 10 aa, Yellow fever virus
PYRTWAYHGS

SEQ ID NO: 247584 - protein, 10 aa, Yellow fever virus
YRTWAYHGSY

SEQ ID NO: 247585 - protein, 10 aa, Yellow fever virus
GSASSLVNGV

SEQ ID NO: 247586 - protein, 10 aa, Yellow fever virus
SASSLVNGVV

SEQ ID NO: 247587 - protein, 10 aa, Yellow fever virus
NGVVRLLSKP

SEQ ID NO: 247588 - protein, 10 aa, Yellow fever virus
GVVRLLSKPW

SEQ ID NO: 247589 - protein, 10 aa, Yellow fever virus
VVRLLSKPWD

SEQ ID NO: 247590 - protein, 10 aa, Yellow fever virus
LAMTDTTPFG

SEQ ID NO: 247591 - protein, 10 aa, Yellow fever virus
VFKEKVDTRA

SEQ ID NO: 247592 - protein, 10 aa, Yellow fever virus
FKEKVDTKAP

SEQ ID NO: 247593 - protein, 10 aa, Yellow fever virus
TCIYNMMGKR

SEQ ID NO: 247594 - protein, 10 aa, Yellow fever virus
MMGKREKKLS

SEQ ID NO: 247595 - protein, 10 aa, Yellow fever virus
MGKREKKLSE

SEQ ID NO: 247596 - protein, 10 aa, Yellow fever virus
GKREKKLSEF

SEQ ID NO: 247597 - protein, 10 aa, Yellow fever virus
KREKKLSEFG

SEQ ID NO: 247598 - protein, 10 aa, Yellow fever virus
REKKLGEFGR

SEQ ID NO: 247599 - protein, 10 aa, Yellow fever virus
EKKLGEFGRA

SEQ ID NO: 247600 - protein, 10 aa, Yellow fever virus
KKLGEFGRAK

SEQ ID NO: 247601 - protein, 10 aa, Yellow fever virus
KLGEFGRAKG

SEQ ID NO: 247602 - protein, 10 aa, Yellow fever virus
LGEFGRAKGS

SEQ ID NO: 247603 - protein, 10 aa, Yellow fever virus
GEFGVAKGSR

SEQ ID NO: 247604 - protein, 10 aa, Yellow fever virus
EFGVAKGSRA

SEQ ID NO: 247605 - protein, 10 aa, Yellow fever virus
FGVAKGSRAI

SEQ ID NO: 247606 - protein, 10 aa, Yellow fever virus
GVAKGSRAIW

SEQ ID NO: 247607 - protein, 10 aa, Yellow fever virus
RAKGSRAIWY

SEQ ID NO: 247608 - protein, 10 aa, Yellow fever virus
RAIWYMWLGS

SEQ ID NO: 247609 - protein, 10 aa, Yellow fever virus
AIWYMWLGSR

SEQ ID NO: 247610 - protein, 10 aa, Yellow fever virus
IWFMWLGARF

SEQ ID NO: 247611 - protein, 10 aa, Yellow fever virus
WFMWLGARFL

SEQ ID NO: 247612 - protein, 10 aa, Yellow fever virus
FMWLGARFLE

SEQ ID NO: 247613 - protein, 10 aa, Yellow fever virus
MWLGSRFLEF

SEQ ID NO: 247614 - protein, 10 aa, Yellow fever virus
WLGSRFLEFE

SEQ ID NO: 247615 - protein, 10 aa, Yellow fever virus
LGSRFLEFEA

SEQ ID NO: 247616 - protein, 10 aa, Yellow fever virus
GSRFLEFEAL

SEQ ID NO: 247617 - protein, 10 aa, Yellow fever virus
SRFLEFEALG

SEQ ID NO: 247618 - protein, 10 aa, Yellow fever virus
YLEFEALGFL

SEQ ID NO: 247619 - protein, 10 aa, Yellow fever virus
LGFLNEDHWL

SEQ ID NO: 247620 - protein, 10 aa, Yellow fever virus
FYADDTAGWD

SEQ ID NO: 247621 - protein, 10 aa, Yellow fever virus
IMQKAYHAKV

SEQ ID NO: 247622 - protein, 10 aa, Yellow fever virus
MQKAYHAKVV

SEQ ID NO: 247623 - protein, 10 aa, Yellow fever virus
ELTYRHKVVK

SEQ ID NO: 247624 - protein, 10 aa, Yellow fever virus
LTYRHKVVKV

SEQ ID NO: 247625 - protein, 10 aa, Yellow fever virus
MDIISRRDQR

SEQ ID NO: 247626 - protein, 10 aa, Yellow fever virus
DIISRRDQRG

SEQ ID NO: 247627 - protein, 10 aa, Yellow fever virus
IISRRDQRGS

SEQ ID NO: 247628 - protein, 10 aa, Yellow fever virus
ISREDQRGSG

SEQ ID NO: 247629 - protein, 10 aa, Yellow fever virus
SREDQRGSGQ

SEQ ID NO: 247630 - protein, 10 aa, Yellow fever virus
REDQRGSGQV

SEQ ID NO: 247631 - protein, 10 aa, Yellow fever virus
EDQRGSGQVV

SEQ ID NO: 247632 - protein, 10 aa, Yellow fever virus
RGSGQVVTYG

SEQ ID NO: 247633 - protein, 10 aa, Yellow fever virus
GSGQVVTYGL

SEQ ID NO: 247634 - protein, 10 aa, Yellow fever virus
SGQVVTYGLN

SEQ ID NO: 247635 - protein, 10 aa, Yellow fever virus
GQVVTYGLNT

SEQ ID NO: 247636 - protein, 10 aa, Yellow fever virus
RMLVSGDDCV

SEQ ID NO: 247637 - protein, 10 aa, Yellow fever virus
MLVSGDDCVV

SEQ ID NO: 247638 - protein, 10 aa, Yellow fever virus
LVSGDDCVVR

SEQ ID NO: 247639 - protein, 10 aa, Yellow fever virus
VSGDDCVVRP

SEQ ID NO: 247640 - protein, 10 aa, Yellow fever virus
LNAMSKVRKD

SEQ ID NO: 247641 - protein, 10 aa, Yellow fever virus
NAMSKVRKDI

SEQ ID NO: 247642 - protein, 10 aa, Yellow fever virus
EVPFCSHHFH

SEQ ID NO: 247643 - protein, 10 aa, Yellow fever virus
VPFCSNHFTE

SEQ ID NO: 247644 - protein, 10 aa, Yellow fever virus
PFCSNHFTEL

SEQ ID NO: 247645 - protein, 10 aa, Yellow fever virus
QDELVGRARI

SEQ ID NO: 247646 - protein, 10 aa, Yellow fever virus
DELVGRARIS

SEQ ID NO: 247647 - protein, 10 aa, Yellow fever virus
GRARISPGAG

SEQ ID NO: 247648 - protein, 10 aa, Yellow fever virus
RARISPGAGW

SEQ ID NO: 247649 - protein, 10 aa, Yellow fever virus
ARISPGAGWN

SEQ ID NO: 247650 - protein, 10 aa, Yellow fever virus
RISPGAGWNV

SEQ ID NO: 247651 - protein, 10 aa, Yellow fever virus
TACLAKSYAQ

SEQ ID NO: 247652 - protein, 10 aa, Yellow fever virus
ACLAKSYAQM

SEQ ID NO: 247653 - protein, 10 aa, Yellow fever virus
LSYFHRRDLR

SEQ ID NO: 247654 - protein, 10 aa, Yellow fever virus
SYFHRRDLRT

SEQ ID NO: 247655 - protein, 10 aa, Yellow fever virus
YFHRRDLRTL

SEQ ID NO: 247656 - protein, 10 aa, Yellow fever virus
FHRRDLRLMA

SEQ ID NO: 247657 - protein, 10 aa, Yellow fever virus
PTGRTSWSIH

SEQ ID NO: 247658 - protein, 10 aa, Yellow fever virus
TGRTSWSIHS

SEQ ID NO: 247659 - protein, 10 aa, Yellow fever virus
GEWMTTEDML

SEQ ID NO: 247660 - protein, 10 aa, Yellow fever virus
GKREDLWCGS

SEQ ID NO: 247661 - protein, 10 aa, Yellow fever virus
KREDLWCGSL

SEQ ID NO: 247662 - protein, 10 aa, Yellow fever virus
REDLWCGSLI

SEQ ID NO: 247663 - protein, 10 aa, Yellow fever virus
EDLWCGSLIG

SEQ ID NO: 247664 - protein, 10 aa, Yellow fever virus
DLWCGSLIGL

SEQ ID NO: 247665 - protein, 10 aa, Yellow fever virus
LWCGSLIGLS

SEQ ID NO: 247666 - protein, 10 aa, Yellow fever virus
QGLVKRFSTG

SEQ ID NO: 247667 - protein, 10 aa, Yellow fever virus
GLVKRFSTGL

SEQ ID NO: 247668 - protein, 10 aa, Yellow fever virus
LVKRFSTGLF

SEQ ID NO: 247669 - protein, 10 aa, Yellow fever virus
GCGLFGKGGV

SEQ ID NO: 247670 - protein, 10 aa, Yellow fever virus
NLGDQTGVLL

SEQ ID NO: 247671 - protein, 10 aa, Yellow fever virus
RLTVIGEHAW

SEQ ID NO: 247672 - protein, 10 aa, Yellow fever virus
LTVIGEHAWD

SEQ ID NO: 247673 - protein, 10 aa, Yellow fever virus
TVIGEHAWDF

SEQ ID NO: 247674 - protein, 10 aa, Yellow fever virus
VIGEHAWDFG

SEQ ID NO: 247675 - protein, 10 aa, Yellow fever virus
MGDTAWDFSS

SEQ ID NO: 247676 - protein, 10 aa, Yellow fever virus
HAWDFGSTGG

SEQ ID NO: 247677 - protein, 10 aa, Yellow fever virus
SAHGSPTFWM

SEQ ID NO: 247678 - protein, 10 aa, Yellow fever virus
AHGSPTFWMG

SEQ ID NO: 247679 - protein, 10 aa, Yellow fever virus
HGSPTFWMGS

SEQ ID NO: 247680 - protein, 10 aa, Yellow fever virus
WPASHTIDNA

SEQ ID NO: 247681 - protein, 10 aa, Yellow fever virus
WCCRTCTLPP

SEQ ID NO: 247682 - protein, 10 aa, Yellow fever virus
CCRSCTMPPV

SEQ ID NO: 247683 - protein, 10 aa, Yellow fever virus
CRSCTMPPVS

SEQ ID NO: 247684 - protein, 10 aa, Yellow fever virus
TGTDCWYAME

SEQ ID NO: 247685 - protein, 10 aa, Yellow fever virus
GTDCWYAMEI

SEQ ID NO: 247686 - protein, 10 aa, Yellow fever virus
TDCWYAMEIR

SEQ ID NO: 247687 - protein, 10 aa, Yellow fever virus
VFHTLWHTTR

SEQ ID NO: 247688 - protein, 10 aa, Yellow fever virus
LHTMWHVTRG

SEQ ID NO: 247689 - protein, 10 aa, Yellow fever virus
HTLWHTTRGA

SEQ ID NO: 247690 - protein, 10 aa, Yellow fever virus
TLWHTTRGAA

SEQ ID NO: 247691 - protein, 10 aa, Yellow fever virus
LWHTTRGAAI

SEQ ID NO: 247692 - protein, 10 aa, Yellow fever virus
LDLHPGSGKT

SEQ ID NO: 247693 - protein, 10 aa, Yellow fever virus
DMHPGSGKTH

SEQ ID NO: 247694 - protein, 10 aa, Yellow fever virus
LVLAPTRVVA

SEQ ID NO: 247695 - protein, 10 aa, Yellow fever virus
VLAPTRVVAS

SEQ ID NO: 247696 - protein, 10 aa, Yellow fever virus
PTRVVLKEME

SEQ ID NO: 247697 - protein, 10 aa, Yellow fever virus
TRVVLKEMER

SEQ ID NO: 247698 - protein, 10 aa, Yellow fever virus
RVVLKEMERA

SEQ ID NO: 247699 - protein, 10 aa, Yellow fever virus
VVLKEMERAL

SEQ ID NO: 247700 - protein, 10 aa, Yellow fever virus
GGAIVDVMCH

SEQ ID NO: 247701 - protein, 10 aa, Yellow fever virus
GAIVDVMCHA

SEQ ID NO: 247702 - protein, 10 aa, Yellow fever virus
EVIDAMCHAT

SEQ ID NO: 247703 - protein, 10 aa, Yellow fever virus
VIDAMCHATL

SEQ ID NO: 247704 - protein, 10 aa, Yellow fever virus
IDAMCHATLT

SEQ ID NO: 247705 - protein, 10 aa, Yellow fever virus
DVMCHATYVN

SEQ ID NO: 247706 - protein, 10 aa, Yellow fever virus
VMCHATYVNR

SEQ ID NO: 247707 - protein, 10 aa, Yellow fever virus
MCHATYVNRR

SEQ ID NO: 247708 - protein, 10 aa, Yellow fever virus
CHATYVNRRL

SEQ ID NO: 247709 - protein, 10 aa, Yellow fever virus
HATYVNRRLL

SEQ ID NO: 247710 - protein, 10 aa, Yellow fever virus
ATYVNRRLLP

SEQ ID NO: 247711 - protein, 10 aa, Yellow fever virus
MDEAHFLDPA

SEQ ID NO: 247712 - protein, 10 aa, Yellow fever virus
DEAHFLDPAS

SEQ ID NO: 247713 - protein, 10 aa, Yellow fever virus
EAHWTDPHSI

SEQ ID NO: 247714 - protein, 10 aa, Yellow fever virus
AHWTDPHSIA

SEQ ID NO: 247715 - protein, 10 aa, Yellow fever virus
HWTDPHSIAA

SEQ ID NO: 247716 - protein, 10 aa, Yellow fever virus
WTDPHSIAAR

SEQ ID NO: 247717 - protein, 10 aa, Yellow fever virus
TDPHSIAARG

SEQ ID NO: 247718 - protein, 10 aa, Yellow fever virus
DPHSIAARGH

SEQ ID NO: 247719 - protein, 10 aa, Yellow fever virus
PHSIAARGHL

SEQ ID NO: 247720 - protein, 10 aa, Yellow fever virus
SIAARGHLYT

SEQ ID NO: 247721 - protein, 10 aa, Yellow fever virus
AARGHLYTLA

SEQ ID NO: 247722 - protein, 10 aa, Yellow fever virus
ENKCALVLMT

SEQ ID NO: 247723 - protein, 10 aa, Yellow fever virus
NESATILMTA

SEQ ID NO: 247724 - protein, 10 aa, Yellow fever virus
ESATILMTAT

SEQ ID NO: 247725 - protein, 10 aa, Yellow fever virus
SATILMTATP

SEQ ID NO: 247726 - protein, 10 aa, Yellow fever virus
ATILMTATPP

SEQ ID NO: 247727 - protein, 10 aa, Yellow fever virus
VLMTATPPGK

SEQ ID NO: 247728 - protein, 10 aa, Yellow fever virus
GRTAWFVPSI

SEQ ID NO: 247729 - protein, 10 aa, Yellow fever virus
KPDFVVTTDI

SEQ ID NO: 247730 - protein, 10 aa, Yellow fever virus
PDFVVTTDIS

SEQ ID NO: 247731 - protein, 10 aa, Yellow fever virus
DISEMGANLD

SEQ ID NO: 247732 - protein, 10 aa, Yellow fever virus
ISEMGANLDV

SEQ ID NO: 247733 - protein, 10 aa, Yellow fever virus
RVIDCRKSVK

SEQ ID NO: 247734 - protein, 10 aa, Yellow fever virus
VIDCRKSVKP

SEQ ID NO: 247735 - protein, 10 aa, Yellow fever virus
IDCRKSVKPT

SEQ ID NO: 247736 - protein, 10 aa, Yellow fever virus
DCRKSVKPTI

SEQ ID NO: 247737 - protein, 10 aa, Yellow fever virus
CRKSVKPTIL

SEQ ID NO: 247738 - protein, 10 aa, Yellow fever virus
SSAAQRRGRV

SEQ ID NO: 247739 - protein, 10 aa, Yellow fever virus
LVRNCDLPVW

SEQ ID NO: 247740 - protein, 10 aa, Yellow fever virus
VRNCDLPVWL

SEQ ID NO: 247741 - protein, 10 aa, Yellow fever virus
THCDFTPWLA

SEQ ID NO: 247742 - protein, 10 aa, Yellow fever virus
VLQPEAGKQR

SEQ ID NO: 247743 - protein, 10 aa, Yellow fever virus
LQPEAGKQRS

SEQ ID NO: 247744 - protein, 10 aa, Yellow fever virus
QPEAGKQRSS

SEQ ID NO: 247745 - protein, 10 aa, Yellow fever virus
PEAGKQRSSD

SEQ ID NO: 247746 - protein, 10 aa, Yellow fever virus
EAGKQRSSDD

SEQ ID NO: 247747 - protein, 10 aa, Yellow fever virus
AGKQRSSDDN

SEQ ID NO: 247748 - protein, 10 aa, Yellow fever virus
GKQRSSDDNK

SEQ ID NO: 247749 - protein, 10 aa, Yellow fever virus
KQRSSDDNKL

SEQ ID NO: 247750 - protein, 10 aa, Yellow fever virus
QRTPQDNQLI

SEQ ID NO: 247751 - protein, 10 aa, Yellow fever virus
PARSWGTYVL

SEQ ID NO: 247752 - protein, 10 aa, Yellow fever virus
ARSWGTYVLV

SEQ ID NO: 247753 - protein, 10 aa, Yellow fever virus
RSWGTYVLVV

SEQ ID NO: 247754 - protein, 10 aa, Yellow fever virus
SWGTYVLVVS

SEQ ID NO: 247755 - protein, 10 aa, Yellow fever virus
HLAIVVSGLE

SEQ ID NO: 247756 - protein, 10 aa, Yellow fever virus
LAIVVSGLEA

SEQ ID NO: 247757 - protein, 10 aa, Yellow fever virus
AIVVSGLEAE

SEQ ID NO: 247758 - protein, 10 aa, Yellow fever virus
IVVSGLEAEL

SEQ ID NO: 247759 - protein, 10 aa, Yellow fever virus
VVSGLEAELT

SEQ ID NO: 247760 - protein, 10 aa, Yellow fever virus
VSGLEAELTQ

SEQ ID NO: 247761 - protein, 10 aa, Yellow fever virus
SGLEAELTQR

SEQ ID NO: 247762 - protein, 10 aa, Yellow fever virus
GLEAELTQRA

SEQ ID NO: 247763 - protein, 10 aa, Yellow fever virus
LEAELTQRAH

SEQ ID NO: 247764 - protein, 10 aa, Yellow fever virus
EAELTQRAHK

SEQ ID NO: 247765 - protein, 10 aa, Yellow fever virus
AELTQRAHKV

SEQ ID NO: 247766 - protein, 10 aa, Yellow fever virus
RAAQRRTAAG

SEQ ID NO: 247767 - protein, 10 aa, Yellow fever virus
AAQRRTAAGI

SEQ ID NO: 247768 - protein, 10 aa, Yellow fever virus
AHKVFFSAMV

SEQ ID NO: 247769 - protein, 10 aa, Yellow fever virus
HKVFFSAMVR

SEQ ID NO: 247770 - protein, 10 aa, Yellow fever virus
KVFFSAMVRN

SEQ ID NO: 247771 - protein, 10 aa, Yellow fever virus
VFFSAMVRNP

SEQ ID NO: 247772 - protein, 10 aa, Yellow fever virus
FFSAMVRNPM

SEQ ID NO: 247773 - protein, 10 aa, Yellow fever virus
FSAMVRNPMV

SEQ ID NO: 247774 - protein, 10 aa, Yellow fever virus
AGIMKNPTID

SEQ ID NO: 247775 - protein, 10 aa, Yellow fever virus
GIMKNPTIDG

SEQ ID NO: 247776 - protein, 10 aa, Yellow fever virus
MQKKVGQVLL

SEQ ID NO: 247777 - protein, 10 aa, Yellow fever virus
SAVWNSTTAT

SEQ ID NO: 247778 - protein, 10 aa, Yellow fever virus
AVWNSTTATG

SEQ ID NO: 247779 - protein, 10 aa, Yellow fever virus
SGVVRGSLWG

SEQ ID NO: 247780 - protein, 10 aa, Yellow fever virus
GVVRGSLWGF

SEQ ID NO: 247781 - protein, 10 aa, Yellow fever virus
VVRGSLWGFL

SEQ ID NO: 247782 - protein, 10 aa, Yellow fever virus
VRGSLWGFLP

SEQ ID NO: 247783 - protein, 10 aa, Yellow fever virus
RGSLWGFLPL

SEQ ID NO: 247784 - protein, 10 aa, Yellow fever virus
VSRGSSKIRW

SEQ ID NO: 247785 - protein, 10 aa, Yellow fever virus
GEVVDLGCGR

SEQ ID NO: 247786 - protein, 10 aa, Yellow fever virus
EVVDLGCGRG

SEQ ID NO: 247787 - protein, 10 aa, Yellow fever virus
CGRGGWSYYA

SEQ ID NO: 247788 - protein, 10 aa, Yellow fever virus
AYTIGGKGHE

SEQ ID NO: 247789 - protein, 10 aa, Yellow fever virus
TIGGKGHETP

SEQ ID NO: 247790 - protein, 10 aa, Yellow fever virus
ADTIMCDIGE

SEQ ID NO: 247791 - protein, 10 aa, Yellow fever virus
IMCDIGESNP

SEQ ID NO: 247792 - protein, 10 aa, Yellow fever virus
LVRTPFSRNS

SEQ ID NO: 247793 - protein, 10 aa, Yellow fever virus
VRTPFSRNST

SEQ ID NO: 247794 - protein, 10 aa, Yellow fever virus
RTPFSRNSTH

SEQ ID NO: 247795 - protein, 10 aa, Yellow fever virus
TPFSRNSTHE

SEQ ID NO: 247796 - protein, 10 aa, Yellow fever virus
RNSTHEMYYS

SEQ ID NO: 247797 - protein, 10 aa, Yellow fever virus
NSTHEMYYST

SEQ ID NO: 247798 - protein, 10 aa, Yellow fever virus
PYRTWTYHGS

SEQ ID NO: 247799 - protein, 10 aa, Yellow fever virus
YRTWTYHGSY

SEQ ID NO: 247800 - protein, 10 aa, Yellow fever virus
GSAASLINGV

SEQ ID NO: 247801 - protein, 10 aa, Yellow fever virus
SAASLINGVV

SEQ ID NO: 247802 - protein, 10 aa, Yellow fever virus
NGVVKLMSKP

SEQ ID NO: 247803 - protein, 10 aa, Yellow fever virus
GVVKLMSKPW

SEQ ID NO: 247804 - protein, 10 aa, Yellow fever virus
VVKLMSKPWD

SEQ ID NO: 247805 - protein, 10 aa, Yellow fever virus
MAMTDTTAFG

SEQ ID NO: 247806 - protein, 10 aa, Yellow fever virus
FKEKVDTRAK

SEQ ID NO: 247807 - protein, 10 aa, Yellow fever virus
HCVYNMMGKR

SEQ ID NO: 247808 - protein, 10 aa, Yellow fever virus
REKKLGEFGV

SEQ ID NO: 247809 - protein, 10 aa, Yellow fever virus
EKKLGEFGVA

SEQ ID NO: 247810 - protein, 10 aa, Yellow fever virus
KKLGEFGVAK

SEQ ID NO: 247811 - protein, 10 aa, Yellow fever virus
KLGEFGVAKG

SEQ ID NO: 247812 - protein, 10 aa, Yellow fever virus
LGEFGVAKGS

SEQ ID NO: 247813 - protein, 10 aa, Yellow fever virus
SEFGKAKGSR

SEQ ID NO: 247814 - protein, 10 aa, Yellow fever virus
VAKGSRAIWY

SEQ ID NO: 247815 - protein, 10 aa, Yellow fever virus
IWFMWLGARY

SEQ ID NO: 247816 - protein, 10 aa, Yellow fever virus
WFMWLGARYL

SEQ ID NO: 247817 - protein, 10 aa, Yellow fever virus
FMWLGARYLE

SEQ ID NO: 247818 - protein, 10 aa, Yellow fever virus
LGFLNEDHWA

SEQ ID NO: 247819 - protein, 10 aa, Yellow fever virus
VMEMTYKNKV

SEQ ID NO: 247820 - protein, 10 aa, Yellow fever virus
MEMTYKNKVV

SEQ ID NO: 247821 - protein, 10 aa, Yellow fever virus
QKAYHAKVVK

SEQ ID NO: 247822 - protein, 10 aa, Yellow fever virus
KAYHAKVVKV

SEQ ID NO: 247823 - protein, 10 aa, Yellow fever virus
MDVISREDQR

SEQ ID NO: 247824 - protein, 10 aa, Yellow fever virus
DVISREDQRG

SEQ ID NO: 247825 - protein, 10 aa, Yellow fever virus
VISREDQRGS

SEQ ID NO: 247826 - protein, 10 aa, Yellow fever virus
ITRRDQRGSG

SEQ ID NO: 247827 - protein, 10 aa, Yellow fever virus
TRRDQRGSGQ

SEQ ID NO: 247828 - protein, 10 aa, Yellow fever virus
RDQRGSGQVV

SEQ ID NO: 247829 - protein, 10 aa, Yellow fever virus
AVSGDDCVVR

SEQ ID NO: 247830 - protein, 10 aa, Yellow fever virus
LNDMAKTRKD

SEQ ID NO: 247831 - protein, 10 aa, Yellow fever virus
NDMAKTRKDI

SEQ ID NO: 247832 - protein, 10 aa, Yellow fever virus
QVPFCSNHFQ

SEQ ID NO: 247833 - protein, 10 aa, Yellow fever virus
VPFCSHHFHK

SEQ ID NO: 247834 - protein, 10 aa, Yellow fever virus
PFCSHHFHKI

SEQ ID NO: 247835 - protein, 10 aa, Yellow fever virus
QDELIGRGRV

SEQ ID NO: 247836 - protein, 10 aa, Yellow fever virus
DELIGRGRVS

SEQ ID NO: 247837 - protein, 10 aa, Yellow fever virus
GRGRVSPGNG

SEQ ID NO: 247838 - protein, 10 aa, Yellow fever virus
RGRVSPGNGW

SEQ ID NO: 247839 - protein, 10 aa, Yellow fever virus
GRVSPGNGWM

SEQ ID NO: 247840 - protein, 10 aa, Yellow fever virus
RVSPGNGWMI

SEQ ID NO: 247841 - protein, 10 aa, Yellow fever virus
TACLAKAYAQ

SEQ ID NO: 247842 - protein, 10 aa, Yellow fever virus
ACLAKAYAQM

SEQ ID NO: 247843 - protein, 10 aa, Yellow fever virus
LMYFHKRDMR

SEQ ID NO: 247844 - protein, 10 aa, Yellow fever virus
MYFHKRDMRL

SEQ ID NO: 247845 - protein, 10 aa, Yellow fever virus
YFHKRDMRLL

SEQ ID NO: 247846 - protein, 10 aa, Yellow fever virus
FHRRDLRTLG

SEQ ID NO: 247847 - protein, 10 aa, Yellow fever virus
PQGRTTWSIH

SEQ ID NO: 247848 - protein, 10 aa, Yellow fever virus
QGRTTWSIHG

SEQ ID NO: 247849 - protein, 10 aa, Yellow fever virus
GAWMTTEDML

SEQ ID NO: 247850 - protein, 10 aa, Yellow fever virus
TKRQDKLCGS

SEQ ID NO: 247851 - protein, 10 aa, Yellow fever virus
KRQDKLCGSL

SEQ ID NO: 247852 - protein, 10 aa, Yellow fever virus
RQDKLCGSLI

SEQ ID NO: 247853 - protein, 10 aa, Yellow fever virus
QDKLCGSLIG

SEQ ID NO: 247854 - protein, 10 aa, Yellow fever virus
DMLCSSLVGR

SEQ ID NO: 247855 - protein, 10 aa, Yellow fever virus
MLCSSLVGRK

SEQ ID NO: 247856 - protein, 10 aa, Yellow fever virus
SNKIKQKTKQ

SEQ ID NO: 247857 - protein, 10 aa, Yellow fever virus
NKIKQKTKQI

SEQ ID NO: 247858 - protein, 10 aa, Yellow fever virus
KIKQKTKQIG

SEQ ID NO: 247859 - protein, 10 aa, Yellow fever virus
HCGLFGKGSI

SEQ ID NO: 247860 - protein, 10 aa, Yellow fever virus
ALGNQEGSLK

SEQ ID NO: 247861 - protein, 10 aa, Yellow fever virus
RLAVMGDTAW

SEQ ID NO: 247862 - protein, 10 aa, Yellow fever virus
LAVMGDTAWD

SEQ ID NO: 247863 - protein, 10 aa, Yellow fever virus
AVMGDTAWDF

SEQ ID NO: 247864 - protein, 10 aa, Yellow fever virus
VMGDTAWDFS

SEQ ID NO: 247865 - protein, 10 aa, Yellow fever virus
TAWDFSSAGG

SEQ ID NO: 247866 - protein, 10 aa, Yellow fever virus
AVHTDQSLWM

SEQ ID NO: 247867 - protein, 10 aa, Yellow fever virus
VHTDQSLWMK

SEQ ID NO: 247868 - protein, 10 aa, Yellow fever virus
WPRSHTLWSN

SEQ ID NO: 247869 - protein, 10 aa, Yellow fever virus
CCRTCTLPPV

SEQ ID NO: 247870 - protein, 10 aa, Yellow fever virus
CRTCTLPPVT

SEQ ID NO: 247871 - protein, 10 aa, Yellow fever virus
GSDGCWYPME

SEQ ID NO: 247872 - protein, 10 aa, Yellow fever virus
SDGCWYPMEI

SEQ ID NO: 247873 - protein, 10 aa, Yellow fever virus
VLHTMWHVTR

SEQ ID NO: 247874 - protein, 10 aa, Yellow fever virus
TMWHVTRGAA

SEQ ID NO: 247875 - protein, 10 aa, Yellow fever virus
MWHVTRGAAL

SEQ ID NO: 247876 - protein, 10 aa, Yellow fever virus
LDMHPGSGKT

SEQ ID NO: 247877 - protein, 10 aa, Yellow fever virus
DFHPGAGKTR

SEQ ID NO: 247878 - protein, 10 aa, Yellow fever virus
VLAPTRVVLK

SEQ ID NO: 247879 - protein, 10 aa, Yellow fever virus
PTRVVLSEMK

SEQ ID NO: 247880 - protein, 10 aa, Yellow fever virus
TRVVLSEMKE

SEQ ID NO: 247881 - protein, 10 aa, Yellow fever virus
RVVLSEMKEA

SEQ ID NO: 247882 - protein, 10 aa, Yellow fever virus
VVLSEMKEAF

SEQ ID NO: 247883 - protein, 10 aa, Yellow fever virus
GREVIDAMCH

SEQ ID NO: 247884 - protein, 10 aa, Yellow fever virus
REVIDAMCHA

SEQ ID NO: 247885 - protein, 10 aa, Yellow fever virus
DAMCHATLTY

SEQ ID NO: 247886 - protein, 10 aa, Yellow fever virus
AMCHATLTYR

SEQ ID NO: 247887 - protein, 10 aa, Yellow fever virus
MCHATLTYRM

SEQ ID NO: 247888 - protein, 10 aa, Yellow fever virus
CHATLTYRML

SEQ ID NO: 247889 - protein, 10 aa, Yellow fever virus
HATLTYRMLE

SEQ ID NO: 247890 - protein, 10 aa, Yellow fever virus
ATLTYRMLEP

SEQ ID NO: 247891 - protein, 10 aa, Yellow fever virus
EAHFLDPASI

SEQ ID NO: 247892 - protein, 10 aa, Yellow fever virus
AHFLDPASIA

SEQ ID NO: 247893 - protein, 10 aa, Yellow fever virus
HFLDPASIAA

SEQ ID NO: 247894 - protein, 10 aa, Yellow fever virus
FLDPASIAAR

SEQ ID NO: 247895 - protein, 10 aa, Yellow fever virus
LDPASIAARG

SEQ ID NO: 247896 - protein, 10 aa, Yellow fever virus
DPASIAARGW

SEQ ID NO: 247897 - protein, 10 aa, Yellow fever virus
PASIAARGWA

SEQ ID NO: 247898 - protein, 10 aa, Yellow fever virus
SIAARGWAAH

SEQ ID NO: 247899 - protein, 10 aa, Yellow fever virus
AARGWAAHRA

SEQ ID NO: 247900 - protein, 10 aa, Yellow fever virus
ANESATILMT

SEQ ID NO: 247901 - protein, 10 aa, Yellow fever virus
ILMTATPPGT

SEQ ID NO: 247902 - protein, 10 aa, Yellow fever virus
RPTAWFLPSI

SEQ ID NO: 247903 - protein, 10 aa, Yellow fever virus
RVIDGRTNIK

SEQ ID NO: 247904 - protein, 10 aa, Yellow fever virus
VIDGRTNIKP

SEQ ID NO: 247905 - protein, 10 aa, Yellow fever virus
LDCRTAFKPV

SEQ ID NO: 247906 - protein, 10 aa, Yellow fever virus
DCRTAFKPVL

SEQ ID NO: 247907 - protein, 10 aa, Yellow fever virus
CRTAFKPVLV

SEQ ID NO: 247908 - protein, 10 aa, Yellow fever virus
LMKRGDLPVW

SEQ ID NO: 247909 - protein, 10 aa, Yellow fever virus
RNCDLPVWLS

SEQ ID NO: 247910 - protein, 10 aa, Yellow fever virus
VVIPEPGQQR

SEQ ID NO: 247911 - protein, 10 aa, Yellow fever virus
VIPEPGQQRS

SEQ ID NO: 247912 - protein, 10 aa, Yellow fever virus
IPEPGQQRSI

SEQ ID NO: 247913 - protein, 10 aa, Yellow fever virus
PEPGQQRSIQ

SEQ ID NO: 247914 - protein, 10 aa, Yellow fever virus
EPGQQRSIQD

SEQ ID NO: 247915 - protein, 10 aa, Yellow fever virus
PGQQRSIQDN

SEQ ID NO: 247916 - protein, 10 aa, Yellow fever virus
GQQRSIQDNQ

SEQ ID NO: 247917 - protein, 10 aa, Yellow fever virus
QRSSDDNKLA

SEQ ID NO: 247918 - protein, 10 aa, Yellow fever virus
GAAWTVYVGI

SEQ ID NO: 247919 - protein, 10 aa, Yellow fever virus
AAWTVYVGIV

SEQ ID NO: 247920 - protein, 10 aa, Yellow fever virus
AWTVYVGIVT

SEQ ID NO: 247921 - protein, 10 aa, Yellow fever virus
HWSLILPGIK

SEQ ID NO: 247922 - protein, 10 aa, Yellow fever virus
WSLILPGIKA

SEQ ID NO: 247923 - protein, 10 aa, Yellow fever virus
SLILPGIKAQ

SEQ ID NO: 247924 - protein, 10 aa, Yellow fever virus
LILPGIKAQQ

SEQ ID NO: 247925 - protein, 10 aa, Yellow fever virus
ILPGIKAQQS

SEQ ID NO: 247926 - protein, 10 aa, Yellow fever virus
LPGIKAQQSK

SEQ ID NO: 247927 - protein, 10 aa, Yellow fever virus
PGIKAQQSKL

SEQ ID NO: 247928 - protein, 10 aa, Yellow fever virus
GIKAQQSKLA

SEQ ID NO: 247929 - protein, 10 aa, Yellow fever virus
IKAQQSKLAQ

SEQ ID NO: 247930 - protein, 10 aa, Yellow fever virus
KAQQSKLAQR

SEQ ID NO: 247931 - protein, 10 aa, Yellow fever virus
AQQSKLAQRR

SEQ ID NO: 247932 - protein, 10 aa, Yellow fever virus
QRAHKVFFSA

SEQ ID NO: 247933 - protein, 10 aa, Yellow fever virus
RAHKVFFSAM

SEQ ID NO: 247934 - protein, 10 aa, Yellow fever virus
AQRRVFHGVA

SEQ ID NO: 247935 - protein, 10 aa, Yellow fever virus
QRRVFHGVAK

SEQ ID NO: 247936 - protein, 10 aa, Yellow fever virus
RVFHGVAKNP

SEQ ID NO: 247937 - protein, 10 aa, Yellow fever virus
VFHGVAKNPV

SEQ ID NO: 247938 - protein, 10 aa, Yellow fever virus
FHGVAKNPVV

SEQ ID NO: 247939 - protein, 10 aa, Yellow fever virus
HGVAKNPVVD

SEQ ID NO: 247940 - protein, 10 aa, Yellow fever virus
GVAKNPVVDG

SEQ ID NO: 247941 - protein, 10 aa, Yellow fever virus
DTLWTMPVAC

SEQ ID NO: 247942 - protein, 10 aa, Yellow fever virus
TLWTMPVACG

SEQ ID NO: 247943 - protein, 10 aa, Yellow fever virus
TGVMRGNHYA

SEQ ID NO: 247944 - protein, 10 aa, Yellow fever virus
GVMRGNHYAF

SEQ ID NO: 247945 - protein, 10 aa, Yellow fever virus
VMRGNHYAFV

SEQ ID NO: 247946 - protein, 10 aa, Yellow fever virus
MRGNHYAFVG

SEQ ID NO: 247947 - protein, 10 aa, Yellow fever virus
RGNHYAFVGV

SEQ ID NO: 247948 - protein, 10 aa, Yellow fever virus
VSRGTAKLAW

SEQ ID NO: 247949 - protein, 10 aa, Yellow fever virus
GKVMDLGCGR

SEQ ID NO: 247950 - protein, 10 aa, Yellow fever virus
KVMDLGCGRG

SEQ ID NO: 247951 - protein, 10 aa, Yellow fever virus
CGRGGWCYYA

SEQ ID NO: 247952 - protein, 10 aa, Yellow fever virus
GFTLGRDGHE

SEQ ID NO: 247953 - protein, 10 aa, Yellow fever virus
SDTLLCDIGE

SEQ ID NO: 247954 - protein, 10 aa, Yellow fever virus
VIRNPLSRNS

SEQ ID NO: 247955 - protein, 10 aa, Yellow fever virus
IRNPLSRNST

SEQ ID NO: 247956 - protein, 10 aa, Yellow fever virus
RNSTHEMYYV

SEQ ID NO: 247957 - protein, 10 aa, Yellow fever virus
NSTHEMYYVS

SEQ ID NO: 247958 - protein, 10 aa, Yellow fever virus
PYRTWQYWGS

SEQ ID NO: 247959 - protein, 10 aa, Yellow fever virus
YRTWQYWGSY

SEQ ID NO: 247960 - protein, 10 aa, Yellow fever virus
GSAASMVNGV

SEQ ID NO: 247961 - protein, 10 aa, Yellow fever virus
SAASMVNGVI

SEQ ID NO: 247962 - protein, 10 aa, Yellow fever virus
NGVVKLLSWP

SEQ ID NO: 247963 - protein, 10 aa, Yellow fever virus
GVVKLLSWPW

SEQ ID NO: 247964 - protein, 10 aa, Yellow fever virus
VVKLLSWPWN

SEQ ID NO: 247965 - protein, 10 aa, Yellow fever virus
FKEKVDTKAQ

SEQ ID NO: 247966 - protein, 10 aa, Yellow fever virus
REKKLSEFGK

SEQ ID NO: 247967 - protein, 10 aa, Yellow fever virus
EKKLSEFGKA

SEQ ID NO: 247968 - protein, 10 aa, Yellow fever virus
KKLSEFGKAK

SEQ ID NO: 247969 - protein, 10 aa, Yellow fever virus
KLSEFGKAKG

SEQ ID NO: 247970 - protein, 10 aa, Yellow fever virus
LSEFGKAKGS

SEQ ID NO: 247971 - protein, 10 aa, Yellow fever virus
IWYMWLGSRF

SEQ ID NO: 247972 - protein, 10 aa, Yellow fever virus
WYMWLGSRFL

SEQ ID NO: 247973 - protein, 10 aa, Yellow fever virus
YMWLGSRFLE

SEQ ID NO: 247974 - protein, 10 aa, Yellow fever virus
EMTYKNKVVK

SEQ ID NO: 247975 - protein, 10 aa, Yellow fever virus
MTYKNKVVKV

SEQ ID NO: 247976 - protein, 10 aa, Yellow fever virus
MDVITRRDQR

SEQ ID NO: 247977 - protein, 10 aa, Yellow fever virus
DVITRRDQRG

SEQ ID NO: 247978 - protein, 10 aa, Yellow fever virus
VITRRDQRGS

SEQ ID NO: 247979 - protein, 10 aa, Yellow fever virus
NDMGKVRKDV

SEQ ID NO: 247980 - protein, 10 aa, Yellow fever virus
NVPFCSHHFH

SEQ ID NO: 247981 - protein, 10 aa, Yellow fever virus
VPFCSNHFQE

SEQ ID NO: 247982 - protein, 10 aa, Yellow fever virus
PFCSNHFQEI

SEQ ID NO: 247983 - protein, 10 aa, Yellow fever virus
GRARVSPGCG

SEQ ID NO: 247984 - protein, 10 aa, Yellow fever virus
RARVSPGCGW

SEQ ID NO: 247985 - protein, 10 aa, Yellow fever virus
ARVSPGCGWS

SEQ ID NO: 247986 - protein, 10 aa, Yellow fever virus
RVSPGCGWSV

SEQ ID NO: 247987 - protein, 10 aa, Yellow fever virus
TACLSKAYGQ

SEQ ID NO: 247988 - protein, 10 aa, Yellow fever virus
ACLSKAYGQM

SEQ ID NO: 247989 - protein, 10 aa, Yellow fever virus
FHKRDMRLLS

SEQ ID NO: 247990 - protein, 10 aa, Yellow fever virus
PKSHDMLCSS

SEQ ID NO: 247991 - protein, 10 aa, Yellow fever virus
KSHDMLCSSL

SEQ ID NO: 247992 - protein, 10 aa, Yellow fever virus
SHDMLCSSLV

SEQ ID NO: 247993 - protein, 10 aa, Yellow fever virus
HDMLCSSLVG

SEQ ID NO: 247994 - protein, 10 aa, Yellow fever virus
DKLCGSLIGM

SEQ ID NO: 247995 - protein, 10 aa, Yellow fever virus
KLCGSLIGMT

SEQ ID NO: 247996 - protein, 11 aa, Tick-borne encephalitis virus
QLAKRFSKGLL

SEQ ID NO: 247997 - protein, 11 aa, Tick-borne encephalitis virus
VDRGWGNGCGL

SEQ ID NO: 247998 - protein, 11 aa, Tick-borne encephalitis virus
DRGWGNGCGLF

SEQ ID NO: 247999 - protein, 11 aa, Tick-borne encephalitis virus
RGWGNGCGLFG

SEQ ID NO: 248000 - protein, 11 aa, Tick-borne encephalitis virus
GWGNGCGLFGK

SEQ ID NO: 248001 - protein, 11 aa, Tick-borne encephalitis virus
WGNGCGLFGKG

SEQ ID NO: 248002 - protein, 11 aa, Tick-borne encephalitis virus
GNGCGLFGKGS

SEQ ID NO: 248003 - protein, 11 aa, Tick-borne encephalitis virus
NGCGLFGKGSL

SEQ ID NO: 248004 - protein, 11 aa, Tick-borne encephalitis virus
RMAILGDTAWD

SEQ ID NO: 248005 - protein, 11 aa, Tick-borne encephalitis virus
MAILGDTAWDF

SEQ ID NO: 248006 - protein, 11 aa, Tick-borne encephalitis virus
AILGDTAWDFG

SEQ ID NO: 248007 - protein, 11 aa, Tick-borne encephalitis virus
ILGDTAWDFGS

SEQ ID NO: 248008 - protein, 11 aa, Tick-borne encephalitis virus
AVHADMGYWIE

SEQ ID NO: 248009 - protein, 11 aa, Tick-borne encephalitis virus
VHADMGYWIES

SEQ ID NO: 248010 - protein, 11 aa, Tick-borne encephalitis virus
WCCRSCTLPPL

SEQ ID NO: 248011 - protein, 11 aa, Tick-borne encephalitis virus
CCRSCTLPPLR

SEQ ID NO: 248012 - protein, 11 aa, Tick-borne encephalitis virus
GEDGCWYGMEI

SEQ ID NO: 248013 - protein, 11 aa, Tick-borne encephalitis virus
EDGCWYGMEIR

SEQ ID NO: 248014 - protein, 11 aa, Tick-borne encephalitis virus
DGCWYGMEIRP

SEQ ID NO: 248015 - protein, 11 aa, Tick-borne encephalitis virus
VFHTMWHVTRG

SEQ ID NO: 248016 - protein, 11 aa, Tick-borne encephalitis virus
FHTMWHVTRGA

SEQ ID NO: 248017 - protein, 11 aa, Tick-borne encephalitis virus
HTMWHVTRGAV

SEQ ID NO: 248018 - protein, 11 aa, Tick-borne encephalitis virus
LRTLILAPTRV

SEQ ID NO: 248019 - protein, 11 aa, Tick-borne encephalitis virus
RTLILAPTRVV

SEQ ID NO: 248020 - protein, 11 aa, Tick-borne encephalitis virus
TLILAPTRVVA

SEQ ID NO: 248021 - protein, 11 aa, Tick-borne encephalitis virus
ILAPTRVVAAE

SEQ ID NO: 248022 - protein, 11 aa, Tick-borne encephalitis virus
LAPTRVVAAEM

SEQ ID NO: 248023 - protein, 11 aa, Tick-borne encephalitis virus
APTRVVAAEME

SEQ ID NO: 248024 - protein, 11 aa, Tick-borne encephalitis virus
PTRVVAAEMEE

SEQ ID NO: 248025 - protein, 11 aa, Tick-borne encephalitis virus
TRVVAAEMEEA

SEQ ID NO: 248026 - protein, 11 aa, Tick-borne encephalitis virus
RVVAAEMEEAL

SEQ ID NO: 248027 - protein, 11 aa, Tick-borne encephalitis virus
GREIVDLMCHA

SEQ ID NO: 248028 - protein, 11 aa, Tick-borne encephalitis virus
REIVDLMCHAT

SEQ ID NO: 248029 - protein, 11 aa, Tick-borne encephalitis virus
EIVDLMCHATF

SEQ ID NO: 248030 - protein, 11 aa, Tick-borne encephalitis virus
IVDLMCHATFT

SEQ ID NO: 248031 - protein, 11 aa, Tick-borne encephalitis virus
VDLMCHATFTM

SEQ ID NO: 248032 - protein, 11 aa, Tick-borne encephalitis virus
DLMCHATFTMR

SEQ ID NO: 248033 - protein, 11 aa, Tick-borne encephalitis virus
LMCHATFTMRL

SEQ ID NO: 248034 - protein, 11 aa, Tick-borne encephalitis virus
MCHATFTMRLL

SEQ ID NO: 248035 - protein, 11 aa, Tick-borne encephalitis virus
CHATFTMRLLS

SEQ ID NO: 248036 - protein, 11 aa, Tick-borne encephalitis virus
HATFTMRLLSP

SEQ ID NO: 248037 - protein, 11 aa, Tick-borne encephalitis virus
MDEAHFTDPAS

SEQ ID NO: 248038 - protein, 11 aa, Tick-borne encephalitis virus
DEAHFTDPASI

SEQ ID NO: 248039 - protein, 11 aa, Tick-borne encephalitis virus
EAHFTDPASIA

SEQ ID NO: 248040 - protein, 11 aa, Tick-borne encephalitis virus
AHFTDPASIAA

SEQ ID NO: 248041 - protein, 11 aa, Tick-borne encephalitis virus
HFTDPASIAAR

SEQ ID NO: 248042 - protein, 11 aa, Tick-borne encephalitis virus
FTDPASIAARG

SEQ ID NO: 248043 - protein, 11 aa, Tick-borne encephalitis virus
TDPASIAARGY

SEQ ID NO: 248044 - protein, 11 aa, Tick-borne encephalitis virus
DPASIAARGYI

SEQ ID NO: 248045 - protein, 11 aa, Tick-borne encephalitis virus
MGEAAAIFMTA

SEQ ID NO: 248046 - protein, 11 aa, Tick-borne encephalitis virus
GEAAAIFMTAT

SEQ ID NO: 248047 - protein, 11 aa, Tick-borne encephalitis virus
EAAAIFMTATP

SEQ ID NO: 248048 - protein, 11 aa, Tick-borne encephalitis virus
AAAIFMTATPP

SEQ ID NO: 248049 - protein, 11 aa, Tick-borne encephalitis virus
AAIFMTATPPG

SEQ ID NO: 248050 - protein, 11 aa, Tick-borne encephalitis virus
DWDFVVTTDIS

SEQ ID NO: 248051 - protein, 11 aa, Tick-borne encephalitis virus
WDFVVTTDISE

SEQ ID NO: 248052 - protein, 11 aa, Tick-borne encephalitis virus
DFVVTTDISEM

SEQ ID NO: 248053 - protein, 11 aa, Tick-borne encephalitis virus
FVVTTDISEMG

SEQ ID NO: 248054 - protein, 11 aa, Tick-borne encephalitis virus
VVTTDISEMGA

SEQ ID NO: 248055 - protein, 11 aa, Tick-borne encephalitis virus
VTTDISEMGAN

SEQ ID NO: 248056 - protein, 11 aa, Tick-borne encephalitis virus
TTDISEMGANF

SEQ ID NO: 248057 - protein, 11 aa, Tick-borne encephalitis virus
TDISEMGANFK

SEQ ID NO: 248058 - protein, 11 aa, Tick-borne encephalitis virus
DISEMGANFKA

SEQ ID NO: 248059 - protein, 11 aa, Tick-borne encephalitis virus
RVIDPRRCLKP

SEQ ID NO: 248060 - protein, 11 aa, Tick-borne encephalitis virus
VIDPRRCLKPV

SEQ ID NO: 248061 - protein, 11 aa, Tick-borne encephalitis virus
IDPRRCLKPVI

SEQ ID NO: 248062 - protein, 11 aa, Tick-borne encephalitis virus
DPRRCLKPVIL

SEQ ID NO: 248063 - protein, 11 aa, Tick-borne encephalitis virus
ASAAQRRGRIG

SEQ ID NO: 248064 - protein, 11 aa, Tick-borne encephalitis virus
SAAQRRGRIGR

SEQ ID NO: 248065 - protein, 11 aa, Tick-borne encephalitis virus
AAQRRGRIGRN

SEQ ID NO: 248066 - protein, 11 aa, Tick-borne encephalitis virus
LMRRGDLPVWL

SEQ ID NO: 248067 - protein, 11 aa, Tick-borne encephalitis virus
MRRGDLPVWLA

SEQ ID NO: 248068 - protein, 11 aa, Tick-borne encephalitis virus
LLIPEPEKQRT

SEQ ID NO: 248069 - protein, 11 aa, Tick-borne encephalitis virus
LIPEPEKQRTP

SEQ ID NO: 248070 - protein, 11 aa, Tick-borne encephalitis virus
IPEPEKQRTPQ

SEQ ID NO: 248071 - protein, 11 aa, Tick-borne encephalitis virus
PEPEKQRTPQD

SEQ ID NO: 248072 - protein, 11 aa, Tick-borne encephalitis virus
EPEKQRTPQDN

SEQ ID NO: 248073 - protein, 11 aa, Tick-borne encephalitis virus
PEKQRTPQDNQ

SEQ ID NO: 248074 - protein, 11 aa, Tick-borne encephalitis virus
EKQRTPQDNQL

SEQ ID NO: 248075 - protein, 11 aa, Tick-borne encephalitis virus
PASAWTLYAVA

SEQ ID NO: 248076 - protein, 11 aa, Tick-borne encephalitis virus
ASAWTLYAVAT

SEQ ID NO: 248077 - protein, 11 aa, Tick-borne encephalitis virus
SAWTLYAVATT

SEQ ID NO: 248078 - protein, 11 aa, Tick-borne encephalitis virus
HYAIIGPGLQA

SEQ ID NO: 248079 - protein, 11 aa, Tick-borne encephalitis virus
YAIIGPGLQAK

SEQ ID NO: 248080 - protein, 11 aa, Tick-borne encephalitis virus
AIIGPGLQAKA

SEQ ID NO: 248081 - protein, 11 aa, Tick-borne encephalitis virus
IIGPGLQAKAT

SEQ ID NO: 248082 - protein, 11 aa, Tick-borne encephalitis virus
IGPGLQAKATR

SEQ ID NO: 248083 - protein, 11 aa, Tick-borne encephalitis virus
GPGLQAKATRE

SEQ ID NO: 248084 - protein, 11 aa, Tick-borne encephalitis virus
PGLQAKATREA

SEQ ID NO: 248085 - protein, 11 aa, Tick-borne encephalitis virus
GLQAKATREAQ

SEQ ID NO: 248086 - protein, 11 aa, Tick-borne encephalitis virus
LQAKATREAQK

SEQ ID NO: 248087 - protein, 11 aa, Tick-borne encephalitis virus
QAKATREAQKR

SEQ ID NO: 248088 - protein, 11 aa, Tick-borne encephalitis virus
AQKRTAAGIMK

SEQ ID NO: 248089 - protein, 11 aa, Tick-borne encephalitis virus
QKRTAAGIMKN

SEQ ID NO: 248090 - protein, 11 aa, Tick-borne encephalitis virus
KRTAAGIMKNP

SEQ ID NO: 248091 - protein, 11 aa, Tick-borne encephalitis virus
RTAAGIMKNPT

SEQ ID NO: 248092 - protein, 11 aa, Tick-borne encephalitis virus
AAGIMKNPTVD

SEQ ID NO: 248093 - protein, 11 aa, Tick-borne encephalitis virus
AGIMKNPTVDG

SEQ ID NO: 248094 - protein, 11 aa, Tick-borne encephalitis virus
FEKQLGQVMLL

SEQ ID NO: 248095 - protein, 11 aa, Tick-borne encephalitis virus
GKFWNTTIAVS

SEQ ID NO: 248096 - protein, 11 aa, Tick-borne encephalitis virus
ANIFRGSYLAG

SEQ ID NO: 248097 - protein, 11 aa, Tick-borne encephalitis virus
NIFRGSYLAGA

SEQ ID NO: 248098 - protein, 11 aa, Tick-borne encephalitis virus
FRGSYLAGAGL

SEQ ID NO: 248099 - protein, 11 aa, Tick-borne encephalitis virus
GKVIDLGCGRG

SEQ ID NO: 248100 - protein, 11 aa, Tick-borne encephalitis virus
KVIDLGCGRGG

SEQ ID NO: 248101 - protein, 11 aa, Tick-borne encephalitis virus
VIDLGCGRGGW

SEQ ID NO: 248102 - protein, 11 aa, Tick-borne encephalitis virus
IDLGCGRGGWS

SEQ ID NO: 248103 - protein, 11 aa, Tick-borne encephalitis virus
DLGCGRGGWSY

SEQ ID NO: 248104 - protein, 11 aa, Tick-borne encephalitis virus
LGCGRGGWSYY

SEQ ID NO: 248105 - protein, 11 aa, Tick-borne encephalitis virus
GCGRGGWSYYC

SEQ ID NO: 248106 - protein, 11 aa, Tick-borne encephalitis virus
CDTLLCDIGES

SEQ ID NO: 248107 - protein, 11 aa, Tick-borne encephalitis virus
DTLLCDIGESS

SEQ ID NO: 248108 - protein, 11 aa, Tick-borne encephalitis virus
TLLCDIGESSP

SEQ ID NO: 248109 - protein, 11 aa, Tick-borne encephalitis virus
LVRNPLSRNST

SEQ ID NO: 248110 - protein, 11 aa, Tick-borne encephalitis virus
VRNPLSRNSTH

SEQ ID NO: 248111 - protein, 11 aa, Tick-borne encephalitis virus
RNPLSRNSTHE

SEQ ID NO: 248112 - protein, 11 aa, Tick-borne encephalitis virus
NPLSRNSTHEM

SEQ ID NO: 248113 - protein, 11 aa, Tick-borne encephalitis virus
PLSRNSTHEMY

SEQ ID NO: 248114 - protein, 11 aa, Tick-borne encephalitis virus
LSRNSTHEMYW

SEQ ID NO: 248115 - protein, 11 aa, Tick-borne encephalitis virus
SRNSTHEMYWV

SEQ ID NO: 248116 - protein, 11 aa, Tick-borne encephalitis virus
RNSTHEMYWVS

SEQ ID NO: 248117 - protein, 11 aa, Tick-borne encephalitis virus
PYKTWAYHGSY

SEQ ID NO: 248118 - protein, 11 aa, Tick-borne encephalitis virus
GSASSMVNGVV

SEQ ID NO: 248119 - protein, 11 aa, Tick-borne encephalitis virus
NGVVKLLTKPW

SEQ ID NO: 248120 - protein, 11 aa, Tick-borne encephalitis virus
GVVKLLTKPWD

SEQ ID NO: 248121 - protein, 11 aa, Tick-borne encephalitis virus
MAMTDTTPFGQ

SEQ ID NO: 248122 - protein, 11 aa, Tick-borne encephalitis virus
AMTDTTPFGQQ

SEQ ID NO: 248123 - protein, 11 aa, Tick-borne encephalitis virus
MTDTTPFGQQR

SEQ ID NO: 248124 - protein, 11 aa, Tick-borne encephalitis virus
TDTTPFGQQRV

SEQ ID NO: 248125 - protein, 11 aa, Tick-borne encephalitis virus
DTTPFGQQRVF

SEQ ID NO: 248126 - protein, 11 aa, Tick-borne encephalitis virus
TTPFGQQRVFK

SEQ ID NO: 248127 - protein, 11 aa, Tick-borne encephalitis virus
TPFGQQRVFKE

SEQ ID NO: 248128 - protein, 11 aa, Tick-borne encephalitis virus
PFGQQRVFKEK

SEQ ID NO: 248129 - protein, 11 aa, Tick-borne encephalitis virus
FGQQRVFKEKV

SEQ ID NO: 248130 - protein, 11 aa, Tick-borne encephalitis virus
GQQRVFKEKVD

SEQ ID NO: 248131 - protein, 11 aa, Tick-borne encephalitis virus
QQRVFKEKVDT

SEQ ID NO: 248132 - protein, 11 aa, Tick-borne encephalitis virus
QRVFKEKVDTR

SEQ ID NO: 248133 - protein, 11 aa, Tick-borne encephalitis virus
RVFKEKVDTRT

SEQ ID NO: 248134 - protein, 11 aa, Tick-borne encephalitis virus
VFKEKVDTRTP

SEQ ID NO: 248135 - protein, 11 aa, Tick-borne encephalitis virus
TCVYNMMGKRE

SEQ ID NO: 248136 - protein, 11 aa, Tick-borne encephalitis virus
CVYNMMGKREK

SEQ ID NO: 248137 - protein, 11 aa, Tick-borne encephalitis virus
VYNMMGKREKK

SEQ ID NO: 248138 - protein, 11 aa, Tick-borne encephalitis virus
YNMMGKREKKL

SEQ ID NO: 248139 - protein, 11 aa, Tick-borne encephalitis virus
NMMGKREKKLG

SEQ ID NO: 248140 - protein, 11 aa, Tick-borne encephalitis virus
MMGKREKKLGE

SEQ ID NO: 248141 - protein, 11 aa, Tick-borne encephalitis virus
MGKREKKLGEF

SEQ ID NO: 248142 - protein, 11 aa, Tick-borne encephalitis virus
GKREKKLGEFG

SEQ ID NO: 248143 - protein, 11 aa, Tick-borne encephalitis virus
KREKKLGEFGK

SEQ ID NO: 248144 - protein, 11 aa, Tick-borne encephalitis virus
REKKLGEFGKA

SEQ ID NO: 248145 - protein, 11 aa, Tick-borne encephalitis virus
EKKLGEFGKAK

SEQ ID NO: 248146 - protein, 11 aa, Tick-borne encephalitis virus
KKLGEFGKAKG

SEQ ID NO: 248147 - protein, 11 aa, Tick-borne encephalitis virus
KLGEFGKAKGS

SEQ ID NO: 248148 - protein, 11 aa, Tick-borne encephalitis virus
LGEFGKAKGSR

SEQ ID NO: 248149 - protein, 11 aa, Tick-borne encephalitis virus
GEFGKAKGSRA

SEQ ID NO: 248150 - protein, 11 aa, Tick-borne encephalitis virus
EFGKAKGSRAI

SEQ ID NO: 248151 - protein, 11 aa, Tick-borne encephalitis virus
FGKAKGSRAIW

SEQ ID NO: 248152 - protein, 11 aa, Tick-borne encephalitis virus
GKAKGSRAIWY

SEQ ID NO: 248153 - protein, 11 aa, Tick-borne encephalitis virus
KAKGSRAIWYM

SEQ ID NO: 248154 - protein, 11 aa, Tick-borne encephalitis virus
AKGSRAIWYMW

SEQ ID NO: 248155 - protein, 11 aa, Tick-borne encephalitis virus
KGSRAIWYMWL

SEQ ID NO: 248156 - protein, 11 aa, Tick-borne encephalitis virus
GSRAIWYMWLG

SEQ ID NO: 248157 - protein, 11 aa, Tick-borne encephalitis virus
SRAIWYMWLGA

SEQ ID NO: 248158 - protein, 11 aa, Tick-borne encephalitis virus
RAIWYMWLGAR

SEQ ID NO: 248159 - protein, 11 aa, Tick-borne encephalitis virus
AIWYMWLGARF

SEQ ID NO: 248160 - protein, 11 aa, Tick-borne encephalitis virus
IWYMWLGARFL

SEQ ID NO: 248161 - protein, 11 aa, Tick-borne encephalitis virus
WYMWLGARFLE

SEQ ID NO: 248162 - protein, 11 aa, Tick-borne encephalitis virus
YMWLGARFLEF

SEQ ID NO: 248163 - protein, 11 aa, Tick-borne encephalitis virus
MWLGARFLEFE

SEQ ID NO: 248164 - protein, 11 aa, Tick-borne encephalitis virus
WLGARFLEFEA

SEQ ID NO: 248165 - protein, 11 aa, Tick-borne encephalitis virus
LGARFLEFEAL

SEQ ID NO: 248166 - protein, 11 aa, Tick-borne encephalitis virus
GARFLEFEALG

SEQ ID NO: 248167 - protein, 11 aa, Tick-borne encephalitis virus
ARFLEFEALGF

SEQ ID NO: 248168 - protein, 11 aa, Tick-borne encephalitis virus
RFLEFEALGFM

SEQ ID NO: 248169 - protein, 11 aa, Tick-borne encephalitis virus
FLEFEALGFMN

SEQ ID NO: 248170 - protein, 11 aa, Tick-borne encephalitis virus
LEFEALGFLNE

SEQ ID NO: 248171 - protein, 11 aa, Tick-borne encephalitis virus
EFEALGFLNED

SEQ ID NO: 248172 - protein, 11 aa, Tick-borne encephalitis virus
FEALGFLNEDH

SEQ ID NO: 248173 - protein, 11 aa, Tick-borne encephalitis virus
EALGFLNEDHW

SEQ ID NO: 248174 - protein, 11 aa, Tick-borne encephalitis virus
ALGFLNEDHWF

SEQ ID NO: 248175 - protein, 11 aa, Tick-borne encephalitis virus
MYADDTAGWDT

SEQ ID NO: 248176 - protein, 11 aa, Tick-borne encephalitis virus
YADDTAGWDTR

SEQ ID NO: 248177 - protein, 11 aa, Tick-borne encephalitis virus
ADDTAGWDTRI

SEQ ID NO: 248178 - protein, 11 aa, Tick-borne encephalitis virus
DDTAGWDTRIT

SEQ ID NO: 248179 - protein, 11 aa, Tick-borne encephalitis virus
IFKLTYQNKVV

SEQ ID NO: 248180 - protein, 11 aa, Tick-borne encephalitis virus
FKLTYQNKVVR

SEQ ID NO: 248181 - protein, 11 aa, Tick-borne encephalitis virus
KLTYQNKVVRV

SEQ ID NO: 248182 - protein, 11 aa, Tick-borne encephalitis virus
MDVISRRDQRG

SEQ ID NO: 248183 - protein, 11 aa, Tick-borne encephalitis virus
DVISRRDQRGS

SEQ ID NO: 248184 - protein, 11 aa, Tick-borne encephalitis virus
VISRRDQRGSG

SEQ ID NO: 248185 - protein, 11 aa, Tick-borne encephalitis virus
ISRRDQRGSGQ

SEQ ID NO: 248186 - protein, 11 aa, Tick-borne encephalitis virus
SRRDQRGSGQV

SEQ ID NO: 248187 - protein, 11 aa, Tick-borne encephalitis virus
RRDQRGSGQVG

SEQ ID NO: 248188 - protein, 11 aa, Tick-borne encephalitis virus
RDQRGSGQVGT

SEQ ID NO: 248189 - protein, 11 aa, Tick-borne encephalitis virus
DQRGSGQVGTY

SEQ ID NO: 248190 - protein, 11 aa, Tick-borne encephalitis virus
QRGSGQVGTYG

SEQ ID NO: 248191 - protein, 11 aa, Tick-borne encephalitis virus
RGSGQVGTYGL

SEQ ID NO: 248192 - protein, 11 aa, Tick-borne encephalitis virus
GSGQVGTYGLN

SEQ ID NO: 248193 - protein, 11 aa, Tick-borne encephalitis virus
SGQVGTYGLNT

SEQ ID NO: 248194 - protein, 11 aa, Tick-borne encephalitis virus
RMAISGDDCVV

SEQ ID NO: 248195 - protein, 11 aa, Tick-borne encephalitis virus
MAISGDDCVVK

SEQ ID NO: 248196 - protein, 11 aa, Tick-borne encephalitis virus
AISGDDCVVKP

SEQ ID NO: 248197 - protein, 11 aa, Tick-borne encephalitis virus
LNDMGKVRKDI

SEQ ID NO: 248198 - protein, 11 aa, Tick-borne encephalitis virus
VPFCSHHFHEL

SEQ ID NO: 248199 - protein, 11 aa, Tick-borne encephalitis virus
QDELIGRARIS

SEQ ID NO: 248200 - protein, 11 aa, Tick-borne encephalitis virus
GRARISQGAGW

SEQ ID NO: 248201 - protein, 11 aa, Tick-borne encephalitis virus
RARISQGAGWS

SEQ ID NO: 248202 - protein, 11 aa, Tick-borne encephalitis virus
ARISQGAGWSL

SEQ ID NO: 248203 - protein, 11 aa, Tick-borne encephalitis virus
TACLGKSYAQM

SEQ ID NO: 248204 - protein, 11 aa, Tick-borne encephalitis virus
LMYFHRRDLRL

SEQ ID NO: 248205 - protein, 11 aa, Tick-borne encephalitis virus
MYFHRRDLRLA

SEQ ID NO: 248206 - protein, 11 aa, Tick-borne encephalitis virus
YFHRRDLRLAA

SEQ ID NO: 248207 - protein, 11 aa, Tick-borne encephalitis virus
PTSRTTWSIHA

SEQ ID NO: 248208 - protein, 11 aa, Tick-borne encephalitis virus
GKREDQWCGSL

SEQ ID NO: 248209 - protein, 11 aa, Tick-borne encephalitis virus
KREDQWCGSLI

SEQ ID NO: 248210 - protein, 11 aa, Tick-borne encephalitis virus
REDQWCGSLIG

SEQ ID NO: 248211 - protein, 11 aa, Tick-borne encephalitis virus
EDQWCGSLIGL

SEQ ID NO: 248212 - protein, 11 aa, Tick-borne encephalitis virus
DQWCGSLIGLT

SEQ ID NO: 248213 - protein, 11 aa, Tick-borne encephalitis virus
QLTKRFSLGML

SEQ ID NO: 248214 - protein, 11 aa, Tick-borne encephalitis virus
TDRGWGNGCGL

SEQ ID NO: 248215 - protein, 11 aa, Tick-borne encephalitis virus
DRGWGNHCGLF

SEQ ID NO: 248216 - protein, 11 aa, Tick-borne encephalitis virus
RGWGNHCGLFG

SEQ ID NO: 248217 - protein, 11 aa, Tick-borne encephalitis virus
GWGNHCGLFGK

SEQ ID NO: 248218 - protein, 11 aa, Tick-borne encephalitis virus
WGNHCGLFGKG

SEQ ID NO: 248219 - protein, 11 aa, Tick-borne encephalitis virus
GNGCGLFGKGG

SEQ ID NO: 248220 - protein, 11 aa, Tick-borne encephalitis virus
NGCGLFGKGGI

SEQ ID NO: 248221 - protein, 11 aa, Tick-borne encephalitis virus
RLAALGDTAWD

SEQ ID NO: 248222 - protein, 11 aa, Tick-borne encephalitis virus
LAALGDTAWDF

SEQ ID NO: 248223 - protein, 11 aa, Tick-borne encephalitis virus
AALGDTAWDFG

SEQ ID NO: 248224 - protein, 11 aa, Tick-borne encephalitis virus
ALGDTAWDFGS

SEQ ID NO: 248225 - protein, 11 aa, Tick-borne encephalitis virus
AIHSDLSYWIE

SEQ ID NO: 248226 - protein, 11 aa, Tick-borne encephalitis virus
IHSDLSYWIES

SEQ ID NO: 248227 - protein, 11 aa, Tick-borne encephalitis virus
WCCRSCTMPPL

SEQ ID NO: 248228 - protein, 11 aa, Tick-borne encephalitis virus
CCRSCTMPPLR

SEQ ID NO: 248229 - protein, 11 aa, Tick-borne encephalitis virus
TDSGCWYGMEI

SEQ ID NO: 248230 - protein, 11 aa, Tick-borne encephalitis virus
DSGCWYGMEIR

SEQ ID NO: 248231 - protein, 11 aa, Tick-borne encephalitis virus
SGCWYGMEIRP

SEQ ID NO: 248232 - protein, 11 aa, Tick-borne encephalitis virus
TFHTMWHVTRG

SEQ ID NO: 248233 - protein, 11 aa, Tick-borne encephalitis virus
FHTLWHTTKGA

SEQ ID NO: 248234 - protein, 11 aa, Tick-borne encephalitis virus
HTLWHTTKGAA

SEQ ID NO: 248235 - protein, 11 aa, Tick-borne encephalitis virus
LRTAVLAPTRV

SEQ ID NO: 248236 - protein, 11 aa, Tick-borne encephalitis virus
RTAVLAPTRVV

SEQ ID NO: 248237 - protein, 11 aa, Tick-borne encephalitis virus
TAVLAPTRVVA

SEQ ID NO: 248238 - protein, 11 aa, Tick-borne encephalitis virus
ILAPTRVVASE

SEQ ID NO: 248239 - protein, 11 aa, Tick-borne encephalitis virus
LAPTRVVASEM

SEQ ID NO: 248240 - protein, 11 aa, Tick-borne encephalitis virus
APTRVVASEMA

SEQ ID NO: 248241 - protein, 11 aa, Tick-borne encephalitis virus
PTRVVASEMAE

SEQ ID NO: 248242 - protein, 11 aa, Tick-borne encephalitis virus
TRVVASEMAEA

SEQ ID NO: 248243 - protein, 11 aa, Tick-borne encephalitis virus
RVVASEMAEAL

SEQ ID NO: 248244 - protein, 11 aa, Tick-borne encephalitis virus
GKEIVDLMCHA

SEQ ID NO: 248245 - protein, 11 aa, Tick-borne encephalitis virus
KEIVDLMCHAT

SEQ ID NO: 248246 - protein, 11 aa, Tick-borne encephalitis virus
EIVDVMCHATL

SEQ ID NO: 248247 - protein, 11 aa, Tick-borne encephalitis virus
IVDVMCHATLT

SEQ ID NO: 248248 - protein, 11 aa, Tick-borne encephalitis virus
VDVMCHATLTH

SEQ ID NO: 248249 - protein, 11 aa, Tick-borne encephalitis virus
DVMCHATLTHR

SEQ ID NO: 248250 - protein, 11 aa, Tick-borne encephalitis virus
VMCHATLTHRL

SEQ ID NO: 248251 - protein, 11 aa, Tick-borne encephalitis virus
MCHATLTHRLM

SEQ ID NO: 248252 - protein, 11 aa, Tick-borne encephalitis virus
CHATLTHRLMS

SEQ ID NO: 248253 - protein, 11 aa, Tick-borne encephalitis virus
HATLTHRLMSP

SEQ ID NO: 248254 - protein, 11 aa, Tick-borne encephalitis virus
MDEAHFTDPSS

SEQ ID NO: 248255 - protein, 11 aa, Tick-borne encephalitis virus
DEAHFTDPSSI

SEQ ID NO: 248256 - protein, 11 aa, Tick-borne encephalitis virus
EAHFTDPSSIA

SEQ ID NO: 248257 - protein, 11 aa, Tick-borne encephalitis virus
AHFTDPSSIAA

SEQ ID NO: 248258 - protein, 11 aa, Tick-borne encephalitis virus
HFTDPSSIAAR

SEQ ID NO: 248259 - protein, 11 aa, Tick-borne encephalitis virus
FTDPSSIAARG

SEQ ID NO: 248260 - protein, 11 aa, Tick-borne encephalitis virus
TDPSSIAARGY

SEQ ID NO: 248261 - protein, 11 aa, Tick-borne encephalitis virus
DPSSIAARGYI

SEQ ID NO: 248262 - protein, 11 aa, Tick-borne encephalitis virus
MGEAAGIFMTA

SEQ ID NO: 248263 - protein, 11 aa, Tick-borne encephalitis virus
GEAAGIFMTAT

SEQ ID NO: 248264 - protein, 11 aa, Tick-borne encephalitis virus
EAAGIFMTATP

SEQ ID NO: 248265 - protein, 11 aa, Tick-borne encephalitis virus
AAGIFMTATPP

SEQ ID NO: 248266 - protein, 11 aa, Tick-borne encephalitis virus
AGIFMTATPPG

SEQ ID NO: 248267 - protein, 11 aa, Tick-borne encephalitis virus
DWDYVVTTDIS

SEQ ID NO: 248268 - protein, 11 aa, Tick-borne encephalitis virus
WDYVVTTDISE

SEQ ID NO: 248269 - protein, 11 aa, Tick-borne encephalitis virus
DYVVTTDISEM

SEQ ID NO: 248270 - protein, 11 aa, Tick-borne encephalitis virus
YVVTTDISEMG

SEQ ID NO: 248271 - protein, 11 aa, Tick-borne encephalitis virus
VITTDISEMGA

SEQ ID NO: 248272 - protein, 11 aa, Tick-borne encephalitis virus
ITTDISEMGAN

SEQ ID NO: 248273 - protein, 11 aa, Tick-borne encephalitis virus
TTDISEMGANL

SEQ ID NO: 248274 - protein, 11 aa, Tick-borne encephalitis virus
TDISEMGANFR

SEQ ID NO: 248275 - protein, 11 aa, Tick-borne encephalitis virus
DISEMGANFRA

SEQ ID NO: 248276 - protein, 11 aa, Tick-borne encephalitis virus
RVIDPRRCMKP

SEQ ID NO: 248277 - protein, 11 aa, Tick-borne encephalitis virus
VIDPRRCMKPV

SEQ ID NO: 248278 - protein, 11 aa, Tick-borne encephalitis virus
IDPRRCMKPVI

SEQ ID NO: 248279 - protein, 11 aa, Tick-borne encephalitis virus
DPRRCMKPVIL

SEQ ID NO: 248280 - protein, 11 aa, Tick-borne encephalitis virus
SSAAQRRGRIG

SEQ ID NO: 248281 - protein, 11 aa, Tick-borne encephalitis virus
SAAQRRGRVGR

SEQ ID NO: 248282 - protein, 11 aa, Tick-borne encephalitis virus
AAQRRGRVGRN

SEQ ID NO: 248283 - protein, 11 aa, Tick-borne encephalitis virus
LLRTADLPVWL

SEQ ID NO: 248284 - protein, 11 aa, Tick-borne encephalitis virus
MRRGDLPVWLS

SEQ ID NO: 248285 - protein, 11 aa, Tick-borne encephalitis virus
LLIPEPDRQRT

SEQ ID NO: 248286 - protein, 11 aa, Tick-borne encephalitis virus
LIPEPDRQRTP

SEQ ID NO: 248287 - protein, 11 aa, Tick-borne encephalitis virus
IPEPDRQRTPQ

SEQ ID NO: 248288 - protein, 11 aa, Tick-borne encephalitis virus
PEPDRQRTPQD

SEQ ID NO: 248289 - protein, 11 aa, Tick-borne encephalitis virus
EPDRQRTPQDN

SEQ ID NO: 248290 - protein, 11 aa, Tick-borne encephalitis virus
PDRQRTPQDNQ

SEQ ID NO: 248291 - protein, 11 aa, Tick-borne encephalitis virus
DRQRTPQDNQL

SEQ ID NO: 248292 - protein, 11 aa, Tick-borne encephalitis virus
PATAWSLYAVT

SEQ ID NO: 248293 - protein, 11 aa, Tick-borne encephalitis virus
ATAWSLYAVTT

SEQ ID NO: 248294 - protein, 11 aa, Tick-borne encephalitis virus
TAWSLYAVTTA

SEQ ID NO: 248295 - protein, 11 aa, Tick-borne encephalitis virus
HYAYMVPGWQA

SEQ ID NO: 248296 - protein, 11 aa, Tick-borne encephalitis virus
YAYMVPGWQAE

SEQ ID NO: 248297 - protein, 11 aa, Tick-borne encephalitis virus
AYMVPGWQAEA

SEQ ID NO: 248298 - protein, 11 aa, Tick-borne encephalitis virus
YMVPGWQAEAM

SEQ ID NO: 248299 - protein, 11 aa, Tick-borne encephalitis virus
MVPGWQAEAMR

SEQ ID NO: 248300 - protein, 11 aa, Tick-borne encephalitis virus
VPGWQAEAMRS

SEQ ID NO: 248301 - protein, 11 aa, Tick-borne encephalitis virus
PGWQAEAMRSA

SEQ ID NO: 248302 - protein, 11 aa, Tick-borne encephalitis virus
GWQAEAMRSAQ

SEQ ID NO: 248303 - protein, 11 aa, Tick-borne encephalitis virus
WQAEAMRSAQR

SEQ ID NO: 248304 - protein, 11 aa, Tick-borne encephalitis virus
QAEAMRSAQRR

SEQ ID NO: 248305 - protein, 11 aa, Tick-borne encephalitis virus
AQKRAAAGIMK

SEQ ID NO: 248306 - protein, 11 aa, Tick-borne encephalitis virus
QKRAAAGIMKN

SEQ ID NO: 248307 - protein, 11 aa, Tick-borne encephalitis virus
KRAAAGIMKNP

SEQ ID NO: 248308 - protein, 11 aa, Tick-borne encephalitis virus
RAAAGIMKNPT

SEQ ID NO: 248309 - protein, 11 aa, Tick-borne encephalitis virus
AAGIMKNAVVD

SEQ ID NO: 248310 - protein, 11 aa, Tick-borne encephalitis virus
AGIMKNAVVDG

SEQ ID NO: 248311 - protein, 11 aa, Tick-borne encephalitis virus
FEKQLGQIMLL

SEQ ID NO: 248312 - protein, 11 aa, Tick-borne encephalitis virus
GRFWNTTIAVS

SEQ ID NO: 248313 - protein, 11 aa, Tick-borne encephalitis virus
CHIMRGGWLSC

SEQ ID NO: 248314 - protein, 11 aa, Tick-borne encephalitis virus
HIMRGGWLSCL

SEQ ID NO: 248315 - protein, 11 aa, Tick-borne encephalitis virus
MRGGWLSCLSI

SEQ ID NO: 248316 - protein, 11 aa, Tick-borne encephalitis virus
GKVVDLGCGRG

SEQ ID NO: 248317 - protein, 11 aa, Tick-borne encephalitis virus
KVVDLGCGRGG

SEQ ID NO: 248318 - protein, 11 aa, Tick-borne encephalitis virus
VVDLGCGRGGW

SEQ ID NO: 248319 - protein, 11 aa, Tick-borne encephalitis virus
VDLGCGRGGWS

SEQ ID NO: 248320 - protein, 11 aa, Tick-borne encephalitis virus
DLGCGRGGWCY

SEQ ID NO: 248321 - protein, 11 aa, Tick-borne encephalitis virus
LGCGRGGWCYY

SEQ ID NO: 248322 - protein, 11 aa, Tick-borne encephalitis virus
GCGRGGWCYYM

SEQ ID NO: 248323 - protein, 11 aa, Tick-borne encephalitis virus
VDTLLCDIGES

SEQ ID NO: 248324 - protein, 11 aa, Tick-borne encephalitis virus
DTLFCDIGESS

SEQ ID NO: 248325 - protein, 11 aa, Tick-borne encephalitis virus
TLLCDIGESSS

SEQ ID NO: 248326 - protein, 11 aa, Tick-borne encephalitis virus
LVRCPLSRNST

SEQ ID NO: 248327 - protein, 11 aa, Tick-borne encephalitis virus
VRCPLSRNSTH

SEQ ID NO: 248328 - protein, 11 aa, Tick-borne encephalitis virus
RCPLSRNSTHE

SEQ ID NO: 248329 - protein, 11 aa, Tick-borne encephalitis virus
CPLSRNSTHEM

SEQ ID NO: 248330 - protein, 11 aa, Tick-borne encephalitis virus
PLSRNSNHEMY

SEQ ID NO: 248331 - protein, 11 aa, Tick-borne encephalitis virus
LSRNSNHEMYW

SEQ ID NO: 248332 - protein, 11 aa, Tick-borne encephalitis virus
SRNSTHEMYWI

SEQ ID NO: 248333 - protein, 11 aa, Tick-borne encephalitis virus
RNSTHEMYWIS

SEQ ID NO: 248334 - protein, 11 aa, Tick-borne encephalitis virus
PYRTWNYHGSY

SEQ ID NO: 248335 - protein, 11 aa, Tick-borne encephalitis virus
GSASSMINGVV

SEQ ID NO: 248336 - protein, 11 aa, Tick-borne encephalitis virus
NGVVRLLTKPW

SEQ ID NO: 248337 - protein, 11 aa, Tick-borne encephalitis virus
GVVRLLTKPWD

SEQ ID NO: 248338 - protein, 11 aa, Tick-borne encephalitis virus
IAMTDTTPFGQ

SEQ ID NO: 248339 - protein, 11 aa, Tick-borne encephalitis virus
AMTDTTAFGQQ

SEQ ID NO: 248340 - protein, 11 aa, Tick-borne encephalitis virus
MTDTTAFGQQR

SEQ ID NO: 248341 - protein, 11 aa, Tick-borne encephalitis virus
TDTTAFGQQRV

SEQ ID NO: 248342 - protein, 11 aa, Tick-borne encephalitis virus
DTTAFGQQRVF

SEQ ID NO: 248343 - protein, 11 aa, Tick-borne encephalitis virus
TTAFGQQRVFK

SEQ ID NO: 248344 - protein, 11 aa, Tick-borne encephalitis virus
TAFGQQRVFKE

SEQ ID NO: 248345 - protein, 11 aa, Tick-borne encephalitis virus
AFGQQRVFKEK

SEQ ID NO: 248346 - protein, 11 aa, Tick-borne encephalitis virus
QRVFKEKVDTK

SEQ ID NO: 248347 - protein, 11 aa, Tick-borne encephalitis virus
RVFKEKVDTKA

SEQ ID NO: 248348 - protein, 11 aa, Tick-borne encephalitis virus
VFKEKVDTRTQ

SEQ ID NO: 248349 - protein, 11 aa, Tick-borne encephalitis virus
SCVYNMMGKRE

SEQ ID NO: 248350 - protein, 11 aa, Tick-borne encephalitis virus
CIYNMMGKREK

SEQ ID NO: 248351 - protein, 11 aa, Tick-borne encephalitis virus
IYNMMGKREKK

SEQ ID NO: 248352 - protein, 11 aa, Tick-borne encephalitis virus
YNMMGKREKKP

SEQ ID NO: 248353 - protein, 11 aa, Tick-borne encephalitis virus
NMMGKREKKPG

SEQ ID NO: 248354 - protein, 11 aa, Tick-borne encephalitis virus
MMGKREKKPGE

SEQ ID NO: 248355 - protein, 11 aa, Tick-borne encephalitis virus
MGKREKKPGEF

SEQ ID NO: 248356 - protein, 11 aa, Tick-borne encephalitis virus
GKREKKPGEFG

SEQ ID NO: 248357 - protein, 11 aa, Tick-borne encephalitis virus
KREKKPGEFGK

SEQ ID NO: 248358 - protein, 11 aa, Tick-borne encephalitis virus
REKKPGEFGKA

SEQ ID NO: 248359 - protein, 11 aa, Tick-borne encephalitis virus
EKKPGEFGKAK

SEQ ID NO: 248360 - protein, 11 aa, Tick-borne encephalitis virus
KKPGEFGKAKG

SEQ ID NO: 248361 - protein, 11 aa, Tick-borne encephalitis virus
KPGEFGKAKGS

SEQ ID NO: 248362 - protein, 11 aa, Tick-borne encephalitis virus
PGEFGKAKGSR

SEQ ID NO: 248363 - protein, 11 aa, Tick-borne encephalitis virus
GEFGRAKGSRA

SEQ ID NO: 248364 - protein, 11 aa, Tick-borne encephalitis virus
EFGRAKGSRAI

SEQ ID NO: 248365 - protein, 11 aa, Tick-borne encephalitis virus
FGRAKGSRAIW

SEQ ID NO: 248366 - protein, 11 aa, Tick-borne encephalitis virus
GKAKGSRAIWF

SEQ ID NO: 248367 - protein, 11 aa, Tick-borne encephalitis virus
KAKGSRAIWFM

SEQ ID NO: 248368 - protein, 11 aa, Tick-borne encephalitis virus
AKGSRAIWFMW

SEQ ID NO: 248369 - protein, 11 aa, Tick-borne encephalitis virus
KGSRAIWFMWL

SEQ ID NO: 248370 - protein, 11 aa, Tick-borne encephalitis virus
GSRAIWFMWLG

SEQ ID NO: 248371 - protein, 11 aa, Tick-borne encephalitis virus
SRAIWFMWLGA

SEQ ID NO: 248372 - protein, 11 aa, Tick-borne encephalitis virus
RAIWFMWLGAR

SEQ ID NO: 248373 - protein, 11 aa, Tick-borne encephalitis virus
AIWYMWLGARY

SEQ ID NO: 248374 - protein, 11 aa, Tick-borne encephalitis virus
IWYMWLGARYL

SEQ ID NO: 248375 - protein, 11 aa, Tick-borne encephalitis virus
WYMWLGARYLE

SEQ ID NO: 248376 - protein, 11 aa, Tick-borne encephalitis virus
YMWLGARYLEF

SEQ ID NO: 248377 - protein, 11 aa, Tick-borne encephalitis virus
MWLGARYLEFE

SEQ ID NO: 248378 - protein, 11 aa, Tick-borne encephalitis virus
WLGARYLEFEA

SEQ ID NO: 248379 - protein, 11 aa, Tick-borne encephalitis virus
LGARYLEFEAL

SEQ ID NO: 248380 - protein, 11 aa, Tick-borne encephalitis virus
GARYLEFEALG

SEQ ID NO: 248381 - protein, 11 aa, Tick-borne encephalitis virus
ARYLEFEALGF

SEQ ID NO: 248382 - protein, 11 aa, Tick-borne encephalitis virus
RFLEFEALGFL

SEQ ID NO: 248383 - protein, 11 aa, Tick-borne encephalitis virus
FLEFEALGFLN

SEQ ID NO: 248384 - protein, 11 aa, Tick-borne encephalitis virus
LEFEALGFMNE

SEQ ID NO: 248385 - protein, 11 aa, Tick-borne encephalitis virus
EFEALGFMNED

SEQ ID NO: 248386 - protein, 11 aa, Tick-borne encephalitis virus
FEALGFMNEDH

SEQ ID NO: 248387 - protein, 11 aa, Tick-borne encephalitis virus
EALGFMNEDHW

SEQ ID NO: 248388 - protein, 11 aa, Tick-borne encephalitis virus
ALGFMNEDHWF

SEQ ID NO: 248389 - protein, 11 aa, Tick-borne encephalitis virus
IYADDTAGWDT

SEQ ID NO: 248390 - protein, 11 aa, Tick-borne encephalitis virus
YADDTAGWDTK

SEQ ID NO: 248391 - protein, 11 aa, Tick-borne encephalitis virus
ADDTAGWDTKV

SEQ ID NO: 248392 - protein, 11 aa, Tick-borne encephalitis virus
DDTAGWDTKVT

SEQ ID NO: 248393 - protein, 11 aa, Tick-borne encephalitis virus
IIELTYRHKVV

SEQ ID NO: 248394 - protein, 11 aa, Tick-borne encephalitis virus
FKLTYQNKVVK

SEQ ID NO: 248395 - protein, 11 aa, Tick-borne encephalitis virus
KLTYQNKVVKV

SEQ ID NO: 248396 - protein, 11 aa, Tick-borne encephalitis virus
MDIISRKDQRG

SEQ ID NO: 248397 - protein, 11 aa, Tick-borne encephalitis virus
DIISRKDQRGS

SEQ ID NO: 248398 - protein, 11 aa, Tick-borne encephalitis virus
IISRKDQRGSG

SEQ ID NO: 248399 - protein, 11 aa, Tick-borne encephalitis virus
ISRKDQRGSGQ

SEQ ID NO: 248400 - protein, 11 aa, Tick-borne encephalitis virus
SRKDQRGSGQV

SEQ ID NO: 248401 - protein, 11 aa, Tick-borne encephalitis virus
RKDQRGSGQVG

SEQ ID NO: 248402 - protein, 11 aa, Tick-borne encephalitis virus
KDQRGSGQVGT

SEQ ID NO: 248403 - protein, 11 aa, Tick-borne encephalitis virus
DQRGSGQVVTY

SEQ ID NO: 248404 - protein, 11 aa, Tick-borne encephalitis virus
QRGSGQVVTYA

SEQ ID NO: 248405 - protein, 11 aa, Tick-borne encephalitis virus
RGSGQVVTYAL

SEQ ID NO: 248406 - protein, 11 aa, Tick-borne encephalitis virus
GSGQVVTYALN

SEQ ID NO: 248407 - protein, 11 aa, Tick-borne encephalitis virus
SGQVVTYALNT

SEQ ID NO: 248408 - protein, 11 aa, Tick-borne encephalitis virus
RMAVSGDDCVV

SEQ ID NO: 248409 - protein, 11 aa, Tick-borne encephalitis virus
MAVSGDDCVVK

SEQ ID NO: 248410 - protein, 11 aa, Tick-borne encephalitis virus
AVSGDDCVVKP

SEQ ID NO: 248411 - protein, 11 aa, Tick-borne encephalitis virus
LNDMGKIRKDI

SEQ ID NO: 248412 - protein, 11 aa, Tick-borne encephalitis virus
VPFCSHHFHQL

SEQ ID NO: 248413 - protein, 11 aa, Tick-borne encephalitis virus
QDELVGRARVS

SEQ ID NO: 248414 - protein, 11 aa, Tick-borne encephalitis virus
GRARVSQGAGW

SEQ ID NO: 248415 - protein, 11 aa, Tick-borne encephalitis virus
RARVSQGAGWS

SEQ ID NO: 248416 - protein, 11 aa, Tick-borne encephalitis virus
ARVSQGAGWSL

SEQ ID NO: 248417 - protein, 11 aa, Tick-borne encephalitis virus
TACLGKAYAQM

SEQ ID NO: 248418 - protein, 11 aa, Tick-borne encephalitis virus
LLYFHRRDLRL

SEQ ID NO: 248419 - protein, 11 aa, Tick-borne encephalitis virus
LYFHRRDLRLM

SEQ ID NO: 248420 - protein, 11 aa, Tick-borne encephalitis virus
YFHRRDLRLAS

SEQ ID NO: 248421 - protein, 11 aa, Tick-borne encephalitis virus
PTGRTTWSIHA

SEQ ID NO: 248422 - protein, 11 aa, Tick-borne encephalitis virus
GKREDIWCGSL

SEQ ID NO: 248423 - protein, 11 aa, Tick-borne encephalitis virus
KREDIWCGSLI

SEQ ID NO: 248424 - protein, 11 aa, Tick-borne encephalitis virus
REDIWCGSLIG

SEQ ID NO: 248425 - protein, 11 aa, Tick-borne encephalitis virus
EDIWCGSLIGT

SEQ ID NO: 248426 - protein, 11 aa, Tick-borne encephalitis virus
DIWCGSLIGTR

SEQ ID NO: 248427 - protein, 11 aa, Tick-borne encephalitis virus
QLAKRFSRGLL

SEQ ID NO: 248428 - protein, 11 aa, Tick-borne encephalitis virus
SDRGWGNHCGL

SEQ ID NO: 248429 - protein, 11 aa, Tick-borne encephalitis virus
GNHCGLFGKGS

SEQ ID NO: 248430 - protein, 11 aa, Tick-borne encephalitis virus
NGCGLFGKGSI

SEQ ID NO: 248431 - protein, 11 aa, Tick-borne encephalitis virus
RMAILGETAWD

SEQ ID NO: 248432 - protein, 11 aa, Tick-borne encephalitis virus
MAILGETAWDF

SEQ ID NO: 248433 - protein, 11 aa, Tick-borne encephalitis virus
AILGETAWDFG

SEQ ID NO: 248434 - protein, 11 aa, Tick-borne encephalitis virus
ILGETAWDFGS

SEQ ID NO: 248435 - protein, 11 aa, Tick-borne encephalitis virus
AVHSDLSYWIE

SEQ ID NO: 248436 - protein, 11 aa, Tick-borne encephalitis virus
VHSDLSYWIES

SEQ ID NO: 248437 - protein, 11 aa, Tick-borne encephalitis virus
WCCRSCSLPPL

SEQ ID NO: 248438 - protein, 11 aa, Tick-borne encephalitis virus
CCRSCSLPPLR

SEQ ID NO: 248439 - protein, 11 aa, Tick-borne encephalitis virus
TENGCWYGMEI

SEQ ID NO: 248440 - protein, 11 aa, Tick-borne encephalitis virus
ENGCWYGMEIR

SEQ ID NO: 248441 - protein, 11 aa, Tick-borne encephalitis virus
NGCWYGMEIRP

SEQ ID NO: 248442 - protein, 11 aa, Tick-borne encephalitis virus
VFHTLWHTTKG

SEQ ID NO: 248443 - protein, 11 aa, Tick-borne encephalitis virus
FHTMWHVTRGS

SEQ ID NO: 248444 - protein, 11 aa, Tick-borne encephalitis virus
HTMWHVTRGSV

SEQ ID NO: 248445 - protein, 11 aa, Tick-borne encephalitis virus
LRTLVLAPTRV

SEQ ID NO: 248446 - protein, 11 aa, Tick-borne encephalitis virus
RTLVLAPTRVV

SEQ ID NO: 248447 - protein, 11 aa, Tick-borne encephalitis virus
TLVLAPTRVVL

SEQ ID NO: 248448 - protein, 11 aa, Tick-borne encephalitis virus
VLAPTRVVAAE

SEQ ID NO: 248449 - protein, 11 aa, Tick-borne encephalitis virus
LAPTRVVLKEM

SEQ ID NO: 248450 - protein, 11 aa, Tick-borne encephalitis virus
APTRVVAAEMA

SEQ ID NO: 248451 - protein, 11 aa, Tick-borne encephalitis virus
PTRVVAAEMAE

SEQ ID NO: 248452 - protein, 11 aa, Tick-borne encephalitis virus
TRVVAAEMAEA

SEQ ID NO: 248453 - protein, 11 aa, Tick-borne encephalitis virus
RVVAAEMAEAL

SEQ ID NO: 248454 - protein, 11 aa, Tick-borne encephalitis virus
GNEIVDVMCHA

SEQ ID NO: 248455 - protein, 11 aa, Tick-borne encephalitis virus
NEIVDVMCHAT

SEQ ID NO: 248456 - protein, 11 aa, Tick-borne encephalitis virus
AIVDVMCHATY

SEQ ID NO: 248457 - protein, 11 aa, Tick-borne encephalitis virus
IVDVMCHATYV

SEQ ID NO: 248458 - protein, 11 aa, Tick-borne encephalitis virus
VDLMCHATFTT

SEQ ID NO: 248459 - protein, 11 aa, Tick-borne encephalitis virus
DLMCHATFTTR

SEQ ID NO: 248460 - protein, 11 aa, Tick-borne encephalitis virus
LMCHATFTTRL

SEQ ID NO: 248461 - protein, 11 aa, Tick-borne encephalitis virus
MCHATFTTRLL

SEQ ID NO: 248462 - protein, 11 aa, Tick-borne encephalitis virus
CHATFTTRLLS

SEQ ID NO: 248463 - protein, 11 aa, Tick-borne encephalitis virus
HATFTTRLLSS

SEQ ID NO: 248464 - protein, 11 aa, Tick-borne encephalitis virus
MDEAHWTDPHS

SEQ ID NO: 248465 - protein, 11 aa, Tick-borne encephalitis virus
DEAHFTDPSSV

SEQ ID NO: 248466 - protein, 11 aa, Tick-borne encephalitis virus
EAHFTDPSSVA

SEQ ID NO: 248467 - protein, 11 aa, Tick-borne encephalitis virus
AHFTDPSSVAA

SEQ ID NO: 248468 - protein, 11 aa, Tick-borne encephalitis virus
HFTDPSSVAAR

SEQ ID NO: 248469 - protein, 11 aa, Tick-borne encephalitis virus
FTDPSSVAARG

SEQ ID NO: 248470 - protein, 11 aa, Tick-borne encephalitis virus
TDPSSVAARGY

SEQ ID NO: 248471 - protein, 11 aa, Tick-borne encephalitis virus
DPSSVAARGYI

SEQ ID NO: 248472 - protein, 11 aa, Tick-borne encephalitis virus
LGEAAAIFMTA

SEQ ID NO: 248473 - protein, 11 aa, Tick-borne encephalitis virus
NKCALVLMTAT

SEQ ID NO: 248474 - protein, 11 aa, Tick-borne encephalitis virus
KCALVLMTATP

SEQ ID NO: 248475 - protein, 11 aa, Tick-borne encephalitis virus
CALVLMTATPP

SEQ ID NO: 248476 - protein, 11 aa, Tick-borne encephalitis virus
ALVLMTATPPG

SEQ ID NO: 248477 - protein, 11 aa, Tick-borne encephalitis virus
DWDFVITTDIS

SEQ ID NO: 248478 - protein, 11 aa, Tick-borne encephalitis virus
WDFVITTDISE

SEQ ID NO: 248479 - protein, 11 aa, Tick-borne encephalitis virus
DFVITTDISEM

SEQ ID NO: 248480 - protein, 11 aa, Tick-borne encephalitis virus
FVITTDISEMG

SEQ ID NO: 248481 - protein, 11 aa, Tick-borne encephalitis virus
TDISEMGANFG

SEQ ID NO: 248482 - protein, 11 aa, Tick-borne encephalitis virus
DISEMGANFGA

SEQ ID NO: 248483 - protein, 11 aa, Tick-borne encephalitis virus
RVIDSRKSVKP

SEQ ID NO: 248484 - protein, 11 aa, Tick-borne encephalitis virus
VIDSRKSVKPT

SEQ ID NO: 248485 - protein, 11 aa, Tick-borne encephalitis virus
IDSRKSVKPTI

SEQ ID NO: 248486 - protein, 11 aa, Tick-borne encephalitis virus
DSRKSVKPTII

SEQ ID NO: 248487 - protein, 11 aa, Tick-borne encephalitis virus
ASAAQRRGRVG

SEQ ID NO: 248488 - protein, 11 aa, Tick-borne encephalitis virus
AAQRRGRVGRQ

SEQ ID NO: 248489 - protein, 11 aa, Tick-borne encephalitis virus
LLTHCDFTPWL

SEQ ID NO: 248490 - protein, 11 aa, Tick-borne encephalitis virus
LRTADLPVWLA

SEQ ID NO: 248491 - protein, 11 aa, Tick-borne encephalitis virus
VLIPEPEKQRS

SEQ ID NO: 248492 - protein, 11 aa, Tick-borne encephalitis virus
LIPEPEKQRSQ

SEQ ID NO: 248493 - protein, 11 aa, Tick-borne encephalitis virus
IPEPEKQRSQT

SEQ ID NO: 248494 - protein, 11 aa, Tick-borne encephalitis virus
PEPEKQRSQTD

SEQ ID NO: 248495 - protein, 11 aa, Tick-borne encephalitis virus
EPEKQRSQTDN

SEQ ID NO: 248496 - protein, 11 aa, Tick-borne encephalitis virus
PEKQRSQTDNQ

SEQ ID NO: 248497 - protein, 11 aa, Tick-borne encephalitis virus
EKQRSQTDNQL

SEQ ID NO: 248498 - protein, 11 aa, Tick-borne encephalitis virus
PATAWALYGGS

SEQ ID NO: 248499 - protein, 11 aa, Tick-borne encephalitis virus
ATAWALYGGST

SEQ ID NO: 248500 - protein, 11 aa, Tick-borne encephalitis virus
TAWALYGGSTV

SEQ ID NO: 248501 - protein, 11 aa, Tick-borne encephalitis virus
HYGYMLPGWQA

SEQ ID NO: 248502 - protein, 11 aa, Tick-borne encephalitis virus
YGYMLPGWQAE

SEQ ID NO: 248503 - protein, 11 aa, Tick-borne encephalitis virus
GYMLPGWQAEA

SEQ ID NO: 248504 - protein, 11 aa, Tick-borne encephalitis virus
YMLPGWQAEAL

SEQ ID NO: 248505 - protein, 11 aa, Tick-borne encephalitis virus
MLPGWQAEALR

SEQ ID NO: 248506 - protein, 11 aa, Tick-borne encephalitis virus
LPGWQAEALRA

SEQ ID NO: 248507 - protein, 11 aa, Tick-borne encephalitis virus
PGWQAEALRAA

SEQ ID NO: 248508 - protein, 11 aa, Tick-borne encephalitis virus
GWQAEALRAAQ

SEQ ID NO: 248509 - protein, 11 aa, Tick-borne encephalitis virus
WQAEALRAAQR

SEQ ID NO: 248510 - protein, 11 aa, Tick-borne encephalitis virus
QAEALRAAQRR

SEQ ID NO: 248511 - protein, 11 aa, Tick-borne encephalitis virus
AQRRTAAGIMK

SEQ ID NO: 248512 - protein, 11 aa, Tick-borne encephalitis virus
QRRTAAGIMKN

SEQ ID NO: 248513 - protein, 11 aa, Tick-borne encephalitis virus
RRTAAGIMKNA

SEQ ID NO: 248514 - protein, 11 aa, Tick-borne encephalitis virus
RTAAGIMKNAV

SEQ ID NO: 248515 - protein, 11 aa, Tick-borne encephalitis virus
AAGIMKNPTID

SEQ ID NO: 248516 - protein, 11 aa, Tick-borne encephalitis virus
SAMVRNPMVDG

SEQ ID NO: 248517 - protein, 11 aa, Tick-borne encephalitis virus
MQKKVGQIMLI

SEQ ID NO: 248518 - protein, 11 aa, Tick-borne encephalitis virus
SSVWNATTAIG

SEQ ID NO: 248519 - protein, 11 aa, Tick-borne encephalitis virus
CHVMRGSYLAG

SEQ ID NO: 248520 - protein, 11 aa, Tick-borne encephalitis virus
HVMRGSYLAGG

SEQ ID NO: 248521 - protein, 11 aa, Tick-borne encephalitis virus
MRGSYLAGGSI

SEQ ID NO: 248522 - protein, 11 aa, Tick-borne encephalitis virus
GRVIDLGCGRG

SEQ ID NO: 248523 - protein, 11 aa, Tick-borne encephalitis virus
RVIDLGCGRGG

SEQ ID NO: 248524 - protein, 11 aa, Tick-borne encephalitis virus
VMDLGCGRGGW

SEQ ID NO: 248525 - protein, 11 aa, Tick-borne encephalitis virus
IDLGCGRGGWC

SEQ ID NO: 248526 - protein, 11 aa, Tick-borne encephalitis virus
GCGRGGWSYYM

SEQ ID NO: 248527 - protein, 11 aa, Tick-borne encephalitis virus
SDTLFCDIGES

SEQ ID NO: 248528 - protein, 11 aa, Tick-borne encephalitis virus
DTIMCDIGESN

SEQ ID NO: 248529 - protein, 11 aa, Tick-borne encephalitis virus
TLFCDIGESSP

SEQ ID NO: 248530 - protein, 11 aa, Tick-borne encephalitis virus
LVRLPLSRNSN

SEQ ID NO: 248531 - protein, 11 aa, Tick-borne encephalitis virus
VRLPLSRNSNH

SEQ ID NO: 248532 - protein, 11 aa, Tick-borne encephalitis virus
RLPLSRNSNHE

SEQ ID NO: 248533 - protein, 11 aa, Tick-borne encephalitis virus
LPLSRNSNHEM

SEQ ID NO: 248534 - protein, 11 aa, Tick-borne encephalitis virus
PFSRNSTHEMY

SEQ ID NO: 248535 - protein, 11 aa, Tick-borne encephalitis virus
FSRNSTHEMYY

SEQ ID NO: 248536 - protein, 11 aa, Tick-borne encephalitis virus
SRNSNHEMYWV

SEQ ID NO: 248537 - protein, 11 aa, Tick-borne encephalitis virus
RNSNHEMYWVS

SEQ ID NO: 248538 - protein, 11 aa, Tick-borne encephalitis virus
PYRTWAYHGSY

SEQ ID NO: 248539 - protein, 11 aa, Tick-borne encephalitis virus
GSASSLVNGVV

SEQ ID NO: 248540 - protein, 11 aa, Tick-borne encephalitis virus
NGVVRLLSKPW

SEQ ID NO: 248541 - protein, 11 aa, Tick-borne encephalitis virus
GVVRLLSKPWD

SEQ ID NO: 248542 - protein, 11 aa, Tick-borne encephalitis virus
LAMTDTTPFGQ

SEQ ID NO: 248543 - protein, 11 aa, Tick-borne encephalitis virus
RVFKEKVDTRA

SEQ ID NO: 248544 - protein, 11 aa, Tick-borne encephalitis virus
VFKEKVDTKAP

SEQ ID NO: 248545 - protein, 11 aa, Tick-borne encephalitis virus
TCIYNMMGKRE

SEQ ID NO: 248546 - protein, 11 aa, Tick-borne encephalitis virus
NMMGKREKKLS

SEQ ID NO: 248547 - protein, 11 aa, Tick-borne encephalitis virus
MMGKREKKLSE

SEQ ID NO: 248548 - protein, 11 aa, Tick-borne encephalitis virus
MGKREKKLSEF

SEQ ID NO: 248549 - protein, 11 aa, Tick-borne encephalitis virus
GKREKKLSEFG

SEQ ID NO: 248550 - protein, 11 aa, Tick-borne encephalitis virus
KREKKLGEFGR

SEQ ID NO: 248551 - protein, 11 aa, Tick-borne encephalitis virus
REKKLGEFGRA

SEQ ID NO: 248552 - protein, 11 aa, Tick-borne encephalitis virus
EKKLGEFGRAK

SEQ ID NO: 248553 - protein, 11 aa, Tick-borne encephalitis virus
KKLGEFGRAKG

SEQ ID NO: 248554 - protein, 11 aa, Tick-borne encephalitis virus
KLGEFGRAKGS

SEQ ID NO: 248555 - protein, 11 aa, Tick-borne encephalitis virus
LGEFGRAKGSR

SEQ ID NO: 248556 - protein, 11 aa, Tick-borne encephalitis virus
GEFGVAKGSRA

SEQ ID NO: 248557 - protein, 11 aa, Tick-borne encephalitis virus
EFGVAKGSRAI

SEQ ID NO: 248558 - protein, 11 aa, Tick-borne encephalitis virus
FGVAKGSRAIW

SEQ ID NO: 248559 - protein, 11 aa, Tick-borne encephalitis virus
GRAKGSRAIWY

SEQ ID NO: 248560 - protein, 11 aa, Tick-borne encephalitis virus
RAKGSRAIWYM

SEQ ID NO: 248561 - protein, 11 aa, Tick-borne encephalitis virus
SRAIWYMWLGS

SEQ ID NO: 248562 - protein, 11 aa, Tick-borne encephalitis virus
RAIWYMWLGSR

SEQ ID NO: 248563 - protein, 11 aa, Tick-borne encephalitis virus
AIWFMWLGARF

SEQ ID NO: 248564 - protein, 11 aa, Tick-borne encephalitis virus
IWFMWLGARFL

SEQ ID NO: 248565 - protein, 11 aa, Tick-borne encephalitis virus
WFMWLGARFLE

SEQ ID NO: 248566 - protein, 11 aa, Tick-borne encephalitis virus
FMWLGARFLEF

SEQ ID NO: 248567 - protein, 11 aa, Tick-borne encephalitis virus
MWLGSRFLEFE

SEQ ID NO: 248568 - protein, 11 aa, Tick-borne encephalitis virus
WLGSRFLEFEA

SEQ ID NO: 248569 - protein, 11 aa, Tick-borne encephalitis virus
LGSRFLEFEAL

SEQ ID NO: 248570 - protein, 11 aa, Tick-borne encephalitis virus
GSRFLEFEALG

SEQ ID NO: 248571 - protein, 11 aa, Tick-borne encephalitis virus
SRFLEFEALGF

SEQ ID NO: 248572 - protein, 11 aa, Tick-borne encephalitis virus
RYLEFEALGFL

SEQ ID NO: 248573 - protein, 11 aa, Tick-borne encephalitis virus
YLEFEALGFLN

SEQ ID NO: 248574 - protein, 11 aa, Tick-borne encephalitis virus
ALGFLNEDHWL

SEQ ID NO: 248575 - protein, 11 aa, Tick-borne encephalitis virus
FYADDTAGWDT

SEQ ID NO: 248576 - protein, 11 aa, Tick-borne encephalitis virus
IMQKAYHAKVV

SEQ ID NO: 248577 - protein, 11 aa, Tick-borne encephalitis virus
IELTYRHKVVK

SEQ ID NO: 248578 - protein, 11 aa, Tick-borne encephalitis virus
ELTYRHKVVKV

SEQ ID NO: 248579 - protein, 11 aa, Tick-borne encephalitis virus
MDIISRRDQRG

SEQ ID NO: 248580 - protein, 11 aa, Tick-borne encephalitis virus
DIISRRDQRGS

SEQ ID NO: 248581 - protein, 11 aa, Tick-borne encephalitis virus
IISRRDQRGSG

SEQ ID NO: 248582 - protein, 11 aa, Tick-borne encephalitis virus
ISREDQRGSGQ

SEQ ID NO: 248583 - protein, 11 aa, Tick-borne encephalitis virus
SREDQRGSGQV

SEQ ID NO: 248584 - protein, 11 aa, Tick-borne encephalitis virus
REDQRGSGQVV

SEQ ID NO: 248585 - protein, 11 aa, Tick-borne encephalitis virus
EDQRGSGQVVT

SEQ ID NO: 248586 - protein, 11 aa, Tick-borne encephalitis virus
QRGSGQVVTYG

SEQ ID NO: 248587 - protein, 11 aa, Tick-borne encephalitis virus
RGSGQVVTYGL

SEQ ID NO: 248588 - protein, 11 aa, Tick-borne encephalitis virus
GSGQVVTYGLN

SEQ ID NO: 248589 - protein, 11 aa, Tick-borne encephalitis virus
SGQVVTYGLNT

SEQ ID NO: 248590 - protein, 11 aa, Tick-borne encephalitis virus
RMLVSGDDCVV

SEQ ID NO: 248591 - protein, 11 aa, Tick-borne encephalitis virus
MLVSGDDCVVR

SEQ ID NO: 248592 - protein, 11 aa, Tick-borne encephalitis virus
LVSGDDCVVRP

SEQ ID NO: 248593 - protein, 11 aa, Tick-borne encephalitis virus
LNAMSKVRKDI

SEQ ID NO: 248594 - protein, 11 aa, Tick-borne encephalitis virus
VPFCSNHFTEL

SEQ ID NO: 248595 - protein, 11 aa, Tick-borne encephalitis virus
QDELVGRARIS

SEQ ID NO: 248596 - protein, 11 aa, Tick-borne encephalitis virus
GRARISPGAGW

SEQ ID NO: 248597 - protein, 11 aa, Tick-borne encephalitis virus
RARISPGAGWN

SEQ ID NO: 248598 - protein, 11 aa, Tick-borne encephalitis virus
ARISPGAGWNV

SEQ ID NO: 248599 - protein, 11 aa, Tick-borne encephalitis virus
TACLAKSYAQM

SEQ ID NO: 248600 - protein, 11 aa, Tick-borne encephalitis virus
LSYFHRRDLRT

SEQ ID NO: 248601 - protein, 11 aa, Tick-borne encephalitis virus
SYFHRRDLRTL

SEQ ID NO: 248602 - protein, 11 aa, Tick-borne encephalitis virus
YFHRRDLRLMA

SEQ ID NO: 248603 - protein, 11 aa, Tick-borne encephalitis virus
PTGRTSWSIHS

SEQ ID NO: 248604 - protein, 11 aa, Tick-borne encephalitis virus
GKREDLWCGSL

SEQ ID NO: 248605 - protein, 11 aa, Tick-borne encephalitis virus
KREDLWCGSLI

SEQ ID NO: 248606 - protein, 11 aa, Tick-borne encephalitis virus
REDLWCGSLIG

SEQ ID NO: 248607 - protein, 11 aa, Tick-borne encephalitis virus
EDLWCGSLIGL

SEQ ID NO: 248608 - protein, 11 aa, Tick-borne encephalitis virus
DLWCGSLIGLS

SEQ ID NO: 248609 - protein, 11 aa, Tick-borne encephalitis virus
GLVKRFSTGLF

SEQ ID NO: 248610 - protein, 11 aa, Tick-borne encephalitis virus
SDRGWGNGCGL

SEQ ID NO: 248611 - protein, 11 aa, Tick-borne encephalitis virus
NGCGLFGKGGV

SEQ ID NO: 248612 - protein, 11 aa, Tick-borne encephalitis virus
RLTVIGEHAWD

SEQ ID NO: 248613 - protein, 11 aa, Tick-borne encephalitis virus
LTVIGEHAWDF

SEQ ID NO: 248614 - protein, 11 aa, Tick-borne encephalitis virus
TVIGEHAWDFG

SEQ ID NO: 248615 - protein, 11 aa, Tick-borne encephalitis virus
VIGEHAWDFGS

SEQ ID NO: 248616 - protein, 11 aa, Tick-borne encephalitis virus
SAHGSPTFWMG

SEQ ID NO: 248617 - protein, 11 aa, Tick-borne encephalitis virus
AHGSPTFWMGS

SEQ ID NO: 248618 - protein, 11 aa, Tick-borne encephalitis virus
WCCRSCTMPPV

SEQ ID NO: 248619 - protein, 11 aa, Tick-borne encephalitis virus
CCRSCTMPPVS

SEQ ID NO: 248620 - protein, 11 aa, Tick-borne encephalitis virus
TGTDCWYAMEI

SEQ ID NO: 248621 - protein, 11 aa, Tick-borne encephalitis virus
GTDCWYAMEIR

SEQ ID NO: 248622 - protein, 11 aa, Tick-borne encephalitis virus
TDCWYAMEIRP

SEQ ID NO: 248623 - protein, 11 aa, Tick-borne encephalitis virus
VFHTLWHTTRG

SEQ ID NO: 248624 - protein, 11 aa, Tick-borne encephalitis virus
FHTLWHTTRGA

SEQ ID NO: 248625 - protein, 11 aa, Tick-borne encephalitis virus
HTLWHTTRGAA

SEQ ID NO: 248626 - protein, 11 aa, Tick-borne encephalitis virus
TLVLAPTRVVA

SEQ ID NO: 248627 - protein, 11 aa, Tick-borne encephalitis virus
VLAPTRVVASE

SEQ ID NO: 248628 - protein, 11 aa, Tick-borne encephalitis virus
APTRVVLKEME

SEQ ID NO: 248629 - protein, 11 aa, Tick-borne encephalitis virus
PTRVVLKEMER

SEQ ID NO: 248630 - protein, 11 aa, Tick-borne encephalitis virus
TRVVLKEMERA

SEQ ID NO: 248631 - protein, 11 aa, Tick-borne encephalitis virus
RVVLKEMERAL

SEQ ID NO: 248632 - protein, 11 aa, Tick-borne encephalitis virus
GGAIVDVMCHA

SEQ ID NO: 248633 - protein, 11 aa, Tick-borne encephalitis virus
GAIVDVMCHAT

SEQ ID NO: 248634 - protein, 11 aa, Tick-borne encephalitis virus
EVIDAMCHATL

SEQ ID NO: 248635 - protein, 11 aa, Tick-borne encephalitis virus
VIDAMCHATLT

SEQ ID NO: 248636 - protein, 11 aa, Tick-borne encephalitis virus
VDVMCHATYVN

SEQ ID NO: 248637 - protein, 11 aa, Tick-borne encephalitis virus
DVMCHATYVNR

SEQ ID NO: 248638 - protein, 11 aa, Tick-borne encephalitis virus
VMCHATYVNRR

SEQ ID NO: 248639 - protein, 11 aa, Tick-borne encephalitis virus
MCHATYVNRRL

SEQ ID NO: 248640 - protein, 11 aa, Tick-borne encephalitis virus
CHATYVNRRLL

SEQ ID NO: 248641 - protein, 11 aa, Tick-borne encephalitis virus
HATYVNRRLLP

SEQ ID NO: 248642 - protein, 11 aa, Tick-borne encephalitis virus
MDEAHFLDPAS

SEQ ID NO: 248643 - protein, 11 aa, Tick-borne encephalitis virus
DEAHWTDPHSI

SEQ ID NO: 248644 - protein, 11 aa, Tick-borne encephalitis virus
EAHWTDPHSIA

SEQ ID NO: 248645 - protein, 11 aa, Tick-borne encephalitis virus
AHWTDPHSIAA

SEQ ID NO: 248646 - protein, 11 aa, Tick-borne encephalitis virus
HWTDPHSIAAR

SEQ ID NO: 248647 - protein, 11 aa, Tick-borne encephalitis virus
WTDPHSIAARG

SEQ ID NO: 248648 - protein, 11 aa, Tick-borne encephalitis virus
TDPHSIAARGH

SEQ ID NO: 248649 - protein, 11 aa, Tick-borne encephalitis virus
DPHSIAARGHL

SEQ ID NO: 248650 - protein, 11 aa, Tick-borne encephalitis virus
ENKCALVLMTA

SEQ ID NO: 248651 - protein, 11 aa, Tick-borne encephalitis virus
NESATILMTAT

SEQ ID NO: 248652 - protein, 11 aa, Tick-borne encephalitis virus
ESATILMTATP

SEQ ID NO: 248653 - protein, 11 aa, Tick-borne encephalitis virus
SATILMTATPP

SEQ ID NO: 248654 - protein, 11 aa, Tick-borne encephalitis virus
ATILMTATPPG

SEQ ID NO: 248655 - protein, 11 aa, Tick-borne encephalitis virus
KPDFVVTTDIS

SEQ ID NO: 248656 - protein, 11 aa, Tick-borne encephalitis virus
PDFVVTTDISE

SEQ ID NO: 248657 - protein, 11 aa, Tick-borne encephalitis virus
TDISEMGANLD

SEQ ID NO: 248658 - protein, 11 aa, Tick-borne encephalitis virus
DISEMGANLDV

SEQ ID NO: 248659 - protein, 11 aa, Tick-borne encephalitis virus
RVIDCRKSVKP

SEQ ID NO: 248660 - protein, 11 aa, Tick-borne encephalitis virus
VIDCRKSVKPT

SEQ ID NO: 248661 - protein, 11 aa, Tick-borne encephalitis virus
IDCRKSVKPTI

SEQ ID NO: 248662 - protein, 11 aa, Tick-borne encephalitis virus
DCRKSVKPTIL

SEQ ID NO: 248663 - protein, 11 aa, Tick-borne encephalitis virus
SSAAQRRGRVG

SEQ ID NO: 248664 - protein, 11 aa, Tick-borne encephalitis virus
LVRNCDLPVWL

SEQ ID NO: 248665 - protein, 11 aa, Tick-borne encephalitis virus
LTHCDFTPWLA

SEQ ID NO: 248666 - protein, 11 aa, Tick-borne encephalitis virus
VLQPEAGKQRS

SEQ ID NO: 248667 - protein, 11 aa, Tick-borne encephalitis virus
LQPEAGKQRSS

SEQ ID NO: 248668 - protein, 11 aa, Tick-borne encephalitis virus
QPEAGKQRSSD

SEQ ID NO: 248669 - protein, 11 aa, Tick-borne encephalitis virus
PEAGKQRSSDD

SEQ ID NO: 248670 - protein, 11 aa, Tick-borne encephalitis virus
EAGKQRSSDDN

SEQ ID NO: 248671 - protein, 11 aa, Tick-borne encephalitis virus
AGKQRSSDDNK

SEQ ID NO: 248672 - protein, 11 aa, Tick-borne encephalitis virus
GKQRSSDDNKL

SEQ ID NO: 248673 - protein, 11 aa, Tick-borne encephalitis virus
PARSWGTYVLV

SEQ ID NO: 248674 - protein, 11 aa, Tick-borne encephalitis virus
ARSWGTYVLVV

SEQ ID NO: 248675 - protein, 11 aa, Tick-borne encephalitis virus
RSWGTYVLVVS

SEQ ID NO: 248676 - protein, 11 aa, Tick-borne encephalitis virus
HLAIVVSGLEA

SEQ ID NO: 248677 - protein, 11 aa, Tick-borne encephalitis virus
LAIVVSGLEAE

SEQ ID NO: 248678 - protein, 11 aa, Tick-borne encephalitis virus
AIVVSGLEAEL

SEQ ID NO: 248679 - protein, 11 aa, Tick-borne encephalitis virus
IVVSGLEAELT

SEQ ID NO: 248680 - protein, 11 aa, Tick-borne encephalitis virus
VVSGLEAELTQ

SEQ ID NO: 248681 - protein, 11 aa, Tick-borne encephalitis virus
VSGLEAELTQR

SEQ ID NO: 248682 - protein, 11 aa, Tick-borne encephalitis virus
SGLEAELTQRA

SEQ ID NO: 248683 - protein, 11 aa, Tick-borne encephalitis virus
GLEAELTQRAH

SEQ ID NO: 248684 - protein, 11 aa, Tick-borne encephalitis virus
LEAELTQRAHK

SEQ ID NO: 248685 - protein, 11 aa, Tick-borne encephalitis virus
EAELTQRAHKV

SEQ ID NO: 248686 - protein, 11 aa, Tick-borne encephalitis virus
AHKVFFSAMVR

SEQ ID NO: 248687 - protein, 11 aa, Tick-borne encephalitis virus
HKVFFSAMVRN

SEQ ID NO: 248688 - protein, 11 aa, Tick-borne encephalitis virus
KVFFSAMVRNP

SEQ ID NO: 248689 - protein, 11 aa, Tick-borne encephalitis virus
VFFSAMVRNPM

SEQ ID NO: 248690 - protein, 11 aa, Tick-borne encephalitis virus
FSAMVRNPMVD

SEQ ID NO: 248691 - protein, 11 aa, Tick-borne encephalitis virus
AGIMKNPTIDG

SEQ ID NO: 248692 - protein, 11 aa, Tick-borne encephalitis virus
MQKKVGQVLLI

SEQ ID NO: 248693 - protein, 11 aa, Tick-borne encephalitis virus
SAVWNSTTATG

SEQ ID NO: 248694 - protein, 11 aa, Tick-borne encephalitis virus
SGVVRGSLWGF

SEQ ID NO: 248695 - protein, 11 aa, Tick-borne encephalitis virus
GVVRGSLWGFL

SEQ ID NO: 248696 - protein, 11 aa, Tick-borne encephalitis virus
VRGSLWGFLPL

SEQ ID NO: 248697 - protein, 11 aa, Tick-borne encephalitis virus
GEVVDLGCGRG

SEQ ID NO: 248698 - protein, 11 aa, Tick-borne encephalitis virus
EVVDLGCGRGG

SEQ ID NO: 248699 - protein, 11 aa, Tick-borne encephalitis virus
MDLGCGRGGWS

SEQ ID NO: 248700 - protein, 11 aa, Tick-borne encephalitis virus
GCGRGGWSYYA

SEQ ID NO: 248701 - protein, 11 aa, Tick-borne encephalitis virus
ADTIMCDIGES

SEQ ID NO: 248702 - protein, 11 aa, Tick-borne encephalitis virus
TIMCDIGESNP

SEQ ID NO: 248703 - protein, 11 aa, Tick-borne encephalitis virus
LVRTPFSRNST

SEQ ID NO: 248704 - protein, 11 aa, Tick-borne encephalitis virus
VRTPFSRNSTH

SEQ ID NO: 248705 - protein, 11 aa, Tick-borne encephalitis virus
RTPFSRNSTHE

SEQ ID NO: 248706 - protein, 11 aa, Tick-borne encephalitis virus
TPFSRNSTHEM

SEQ ID NO: 248707 - protein, 11 aa, Tick-borne encephalitis virus
LSRNSTHEMYY

SEQ ID NO: 248708 - protein, 11 aa, Tick-borne encephalitis virus
SRNSTHEMYYS

SEQ ID NO: 248709 - protein, 11 aa, Tick-borne encephalitis virus
RNSTHEMYYST

SEQ ID NO: 248710 - protein, 11 aa, Tick-borne encephalitis virus
PYRTWTYHGSY

SEQ ID NO: 248711 - protein, 11 aa, Tick-borne encephalitis virus
GSAASLINGVV

SEQ ID NO: 248712 - protein, 11 aa, Tick-borne encephalitis virus
NGVVKLMSKPW

SEQ ID NO: 248713 - protein, 11 aa, Tick-borne encephalitis virus
GVVKLMSKPWD

SEQ ID NO: 248714 - protein, 11 aa, Tick-borne encephalitis virus
MAMTDTTAFGQ

SEQ ID NO: 248715 - protein, 11 aa, Tick-borne encephalitis virus
VFKEKVDTRAK

SEQ ID NO: 248716 - protein, 11 aa, Tick-borne encephalitis virus
HCVYNMMGKRE

SEQ ID NO: 248717 - protein, 11 aa, Tick-borne encephalitis virus
KREKKLGEFGV

SEQ ID NO: 248718 - protein, 11 aa, Tick-borne encephalitis virus
REKKLGEFGVA

SEQ ID NO: 248719 - protein, 11 aa, Tick-borne encephalitis virus
EKKLGEFGVAK

SEQ ID NO: 248720 - protein, 11 aa, Tick-borne encephalitis virus
KKLGEFGVAKG

SEQ ID NO: 248721 - protein, 11 aa, Tick-borne encephalitis virus
KLGEFGVAKGS

SEQ ID NO: 248722 - protein, 11 aa, Tick-borne encephalitis virus
LGEFGVAKGSR

SEQ ID NO: 248723 - protein, 11 aa, Tick-borne encephalitis virus
SEFGKAKGSRA

SEQ ID NO: 248724 - protein, 11 aa, Tick-borne encephalitis virus
GVAKGSRAIWY

SEQ ID NO: 248725 - protein, 11 aa, Tick-borne encephalitis virus
VAKGSRAIWYM

SEQ ID NO: 248726 - protein, 11 aa, Tick-borne encephalitis virus
AIWFMWLGARY

SEQ ID NO: 248727 - protein, 11 aa, Tick-borne encephalitis virus
IWFMWLGARYL

SEQ ID NO: 248728 - protein, 11 aa, Tick-borne encephalitis virus
WFMWLGARYLE

SEQ ID NO: 248729 - protein, 11 aa, Tick-borne encephalitis virus
FMWLGARYLEF

SEQ ID NO: 248730 - protein, 11 aa, Tick-borne encephalitis virus
ALGFLNEDHWA

SEQ ID NO: 248731 - protein, 11 aa, Tick-borne encephalitis virus
VMEMTYKNKVV

SEQ ID NO: 248732 - protein, 11 aa, Tick-borne encephalitis virus
MQKAYHAKVVK

SEQ ID NO: 248733 - protein, 11 aa, Tick-borne encephalitis virus
QKAYHAKVVKV

SEQ ID NO: 248734 - protein, 11 aa, Tick-borne encephalitis virus
MDVISREDQRG

SEQ ID NO: 248735 - protein, 11 aa, Tick-borne encephalitis virus
DVISREDQRGS

SEQ ID NO: 248736 - protein, 11 aa, Tick-borne encephalitis virus
VISREDQRGSG

SEQ ID NO: 248737 - protein, 11 aa, Tick-borne encephalitis virus
ITRRDQRGSGQ

SEQ ID NO: 248738 - protein, 11 aa, Tick-borne encephalitis virus
TRRDQRGSGQV

SEQ ID NO: 248739 - protein, 11 aa, Tick-borne encephalitis virus
RRDQRGSGQVV

SEQ ID NO: 248740 - protein, 11 aa, Tick-borne encephalitis virus
RDQRGSGQVVT

SEQ ID NO: 248741 - protein, 11 aa, Tick-borne encephalitis virus
MAVSGDDCVVR

SEQ ID NO: 248742 - protein, 11 aa, Tick-borne encephalitis virus
AVSGDDCVVRP

SEQ ID NO: 248743 - protein, 11 aa, Tick-borne encephalitis virus
LNDMAKTRKDI

SEQ ID NO: 248744 - protein, 11 aa, Tick-borne encephalitis virus
VPFCSHHFHKI

SEQ ID NO: 248745 - protein, 11 aa, Tick-borne encephalitis virus
QDELIGRGRVS

SEQ ID NO: 248746 - protein, 11 aa, Tick-borne encephalitis virus
GRGRVSPGNGW

SEQ ID NO: 248747 - protein, 11 aa, Tick-borne encephalitis virus
RGRVSPGNGWM

SEQ ID NO: 248748 - protein, 11 aa, Tick-borne encephalitis virus
GRVSPGNGWMI

SEQ ID NO: 248749 - protein, 11 aa, Tick-borne encephalitis virus
TACLAKAYAQM

SEQ ID NO: 248750 - protein, 11 aa, Tick-borne encephalitis virus
LMYFHKRDMRL

SEQ ID NO: 248751 - protein, 11 aa, Tick-borne encephalitis virus
MYFHKRDMRLL

SEQ ID NO: 248752 - protein, 11 aa, Tick-borne encephalitis virus
YFHRRDLRTLG

SEQ ID NO: 248753 - protein, 11 aa, Tick-borne encephalitis virus
PQGRTTWSIHG

SEQ ID NO: 248754 - protein, 11 aa, Tick-borne encephalitis virus
TKRQDKLCGSL

SEQ ID NO: 248755 - protein, 11 aa, Tick-borne encephalitis virus
KRQDKLCGSLI

SEQ ID NO: 248756 - protein, 11 aa, Tick-borne encephalitis virus
RQDKLCGSLIG

SEQ ID NO: 248757 - protein, 11 aa, Tick-borne encephalitis virus
QDKLCGSLIGM

SEQ ID NO: 248758 - protein, 11 aa, Tick-borne encephalitis virus
DMLCSSLVGRK

SEQ ID NO: 248759 - protein, 11 aa, Tick-borne encephalitis virus
NKIKQKTKQIG

SEQ ID NO: 248760 - protein, 11 aa, Tick-borne encephalitis virus
NHCGLFGKGSI

SEQ ID NO: 248761 - protein, 11 aa, Tick-borne encephalitis virus
RLAVMGDTAWD

SEQ ID NO: 248762 - protein, 11 aa, Tick-borne encephalitis virus
LAVMGDTAWDF

SEQ ID NO: 248763 - protein, 11 aa, Tick-borne encephalitis virus
AVMGDTAWDFS

SEQ ID NO: 248764 - protein, 11 aa, Tick-borne encephalitis virus
VMGDTAWDFSS

SEQ ID NO: 248765 - protein, 11 aa, Tick-borne encephalitis virus
AVHTDQSLWMK

SEQ ID NO: 248766 - protein, 11 aa, Tick-borne encephalitis virus
VHTDQSLWMKS

SEQ ID NO: 248767 - protein, 11 aa, Tick-borne encephalitis virus
WCCRTCTLPPV

SEQ ID NO: 248768 - protein, 11 aa, Tick-borne encephalitis virus
CCRTCTLPPVT

SEQ ID NO: 248769 - protein, 11 aa, Tick-borne encephalitis virus
GSDGCWYPMEI

SEQ ID NO: 248770 - protein, 11 aa, Tick-borne encephalitis virus
SDGCWYPMEIR

SEQ ID NO: 248771 - protein, 11 aa, Tick-borne encephalitis virus
VLHTMWHVTRG

SEQ ID NO: 248772 - protein, 11 aa, Tick-borne encephalitis virus
LHTMWHVTRGA

SEQ ID NO: 248773 - protein, 11 aa, Tick-borne encephalitis virus
HTMWHVTRGAA

SEQ ID NO: 248774 - protein, 11 aa, Tick-borne encephalitis virus
VLAPTRVVLKE

SEQ ID NO: 248775 - protein, 11 aa, Tick-borne encephalitis virus
APTRVVLSEMK

SEQ ID NO: 248776 - protein, 11 aa, Tick-borne encephalitis virus
PTRVVLSEMKE

SEQ ID NO: 248777 - protein, 11 aa, Tick-borne encephalitis virus
TRVVLSEMKEA

SEQ ID NO: 248778 - protein, 11 aa, Tick-borne encephalitis virus
RVVLSEMKEAF

SEQ ID NO: 248779 - protein, 11 aa, Tick-borne encephalitis virus
GREVIDAMCHA

SEQ ID NO: 248780 - protein, 11 aa, Tick-borne encephalitis virus
REVIDAMCHAT

SEQ ID NO: 248781 - protein, 11 aa, Tick-borne encephalitis virus
IDAMCHATLTY

SEQ ID NO: 248782 - protein, 11 aa, Tick-borne encephalitis virus
DAMCHATLTYR

SEQ ID NO: 248783 - protein, 11 aa, Tick-borne encephalitis virus
AMCHATLTYRM

SEQ ID NO: 248784 - protein, 11 aa, Tick-borne encephalitis virus
MCHATLTYRML

SEQ ID NO: 248785 - protein, 11 aa, Tick-borne encephalitis virus
CHATLTYRMLE

SEQ ID NO: 248786 - protein, 11 aa, Tick-borne encephalitis virus
HATLTYRMLEP

SEQ ID NO: 248787 - protein, 11 aa, Tick-borne encephalitis virus
DEAHFLDPASI

SEQ ID NO: 248788 - protein, 11 aa, Tick-borne encephalitis virus
EAHFLDPASIA

SEQ ID NO: 248789 - protein, 11 aa, Tick-borne encephalitis virus
AHFLDPASIAA

SEQ ID NO: 248790 - protein, 11 aa, Tick-borne encephalitis virus
HFLDPASIAAR

SEQ ID NO: 248791 - protein, 11 aa, Tick-borne encephalitis virus
FLDPASIAARG

SEQ ID NO: 248792 - protein, 11 aa, Tick-borne encephalitis virus
LDPASIAARGW

SEQ ID NO: 248793 - protein, 11 aa, Tick-borne encephalitis virus
DPASIAARGWA

SEQ ID NO: 248794 - protein, 11 aa, Tick-borne encephalitis virus
ANESATILMTA

SEQ ID NO: 248795 - protein, 11 aa, Tick-borne encephalitis virus
RVIDGRTNIKP

SEQ ID NO: 248796 - protein, 11 aa, Tick-borne encephalitis virus
VLDCRTAFKPV

SEQ ID NO: 248797 - protein, 11 aa, Tick-borne encephalitis virus
LDCRTAFKPVL

SEQ ID NO: 248798 - protein, 11 aa, Tick-borne encephalitis virus
DCRTAFKPVLV

SEQ ID NO: 248799 - protein, 11 aa, Tick-borne encephalitis virus
LMKRGDLPVWL

SEQ ID NO: 248800 - protein, 11 aa, Tick-borne encephalitis virus
VRNCDLPVWLS

SEQ ID NO: 248801 - protein, 11 aa, Tick-borne encephalitis virus
VVIPEPGQQRS

SEQ ID NO: 248802 - protein, 11 aa, Tick-borne encephalitis virus
VIPEPGQQRSI

SEQ ID NO: 248803 - protein, 11 aa, Tick-borne encephalitis virus
IPEPGQQRSIQ

SEQ ID NO: 248804 - protein, 11 aa, Tick-borne encephalitis virus
PEPGQQRSIQD

SEQ ID NO: 248805 - protein, 11 aa, Tick-borne encephalitis virus
EPGQQRSIQDN

SEQ ID NO: 248806 - protein, 11 aa, Tick-borne encephalitis virus
PGQQRSIQDNQ

SEQ ID NO: 248807 - protein, 11 aa, Tick-borne encephalitis virus
GQQRSIQDNQV

SEQ ID NO: 248808 - protein, 11 aa, Tick-borne encephalitis virus
PGAAWTVYVGI

SEQ ID NO: 248809 - protein, 11 aa, Tick-borne encephalitis virus
GAAWTVYVGIV

SEQ ID NO: 248810 - protein, 11 aa, Tick-borne encephalitis virus
AAWTVYVGIVT

SEQ ID NO: 248811 - protein, 11 aa, Tick-borne encephalitis virus
HWSLILPGIKA

SEQ ID NO: 248812 - protein, 11 aa, Tick-borne encephalitis virus
WSLILPGIKAQ

SEQ ID NO: 248813 - protein, 11 aa, Tick-borne encephalitis virus
SLILPGIKAQQ

SEQ ID NO: 248814 - protein, 11 aa, Tick-borne encephalitis virus
LILPGIKAQQS

SEQ ID NO: 248815 - protein, 11 aa, Tick-borne encephalitis virus
ILPGIKAQQSK

SEQ ID NO: 248816 - protein, 11 aa, Tick-borne encephalitis virus
LPGIKAQQSKL

SEQ ID NO: 248817 - protein, 11 aa, Tick-borne encephalitis virus
PGIKAQQSKLA

SEQ ID NO: 248818 - protein, 11 aa, Tick-borne encephalitis virus
GIKAQQSKLAQ

SEQ ID NO: 248819 - protein, 11 aa, Tick-borne encephalitis virus
IKAQQSKLAQR

SEQ ID NO: 248820 - protein, 11 aa, Tick-borne encephalitis virus
KAQQSKLAQRR

SEQ ID NO: 248821 - protein, 11 aa, Tick-borne encephalitis virus
AQRRVFHGVAK

SEQ ID NO: 248822 - protein, 11 aa, Tick-borne encephalitis virus
QRRVFHGVAKN

SEQ ID NO: 248823 - protein, 11 aa, Tick-borne encephalitis virus
RRVFHGVAKNP

SEQ ID NO: 248824 - protein, 11 aa, Tick-borne encephalitis virus
RVFHGVAKNPV

SEQ ID NO: 248825 - protein, 11 aa, Tick-borne encephalitis virus
FHGVAKNPVVD

SEQ ID NO: 248826 - protein, 11 aa, Tick-borne encephalitis virus
HGVAKNPVVDG

SEQ ID NO: 248827 - protein, 11 aa, Tick-borne encephalitis virus
DTLWTMPVACG

SEQ ID NO: 248828 - protein, 11 aa, Tick-borne encephalitis virus
TGVMRGNHYAF

SEQ ID NO: 248829 - protein, 11 aa, Tick-borne encephalitis virus
GVMRGNHYAFV

SEQ ID NO: 248830 - protein, 11 aa, Tick-borne encephalitis virus
MRGNHYAFVGV

SEQ ID NO: 248831 - protein, 11 aa, Tick-borne encephalitis virus
GKVMDLGCGRG

SEQ ID NO: 248832 - protein, 11 aa, Tick-borne encephalitis virus
KVMDLGCGRGG

SEQ ID NO: 248833 - protein, 11 aa, Tick-borne encephalitis virus
GCGRGGWCYYA

SEQ ID NO: 248834 - protein, 11 aa, Tick-borne encephalitis virus
SDTLLCDIGES

SEQ ID NO: 248835 - protein, 11 aa, Tick-borne encephalitis virus
VIRNPLSRNST

SEQ ID NO: 248836 - protein, 11 aa, Tick-borne encephalitis virus
IRNPLSRNSTH

SEQ ID NO: 248837 - protein, 11 aa, Tick-borne encephalitis virus
SRNSTHEMYYV

SEQ ID NO: 248838 - protein, 11 aa, Tick-borne encephalitis virus
RNSTHEMYYVS

SEQ ID NO: 248839 - protein, 11 aa, Tick-borne encephalitis virus
PYRTWQYWGSY

SEQ ID NO: 248840 - protein, 11 aa, Tick-borne encephalitis virus
GSAASMVNGVI

SEQ ID NO: 248841 - protein, 11 aa, Tick-borne encephalitis virus
NGVVKLLSWPW

SEQ ID NO: 248842 - protein, 11 aa, Tick-borne encephalitis virus
GVVKLLSWPWN

SEQ ID NO: 248843 - protein, 11 aa, Tick-borne encephalitis virus
VFKEKVDTKAQ

SEQ ID NO: 248844 - protein, 11 aa, Tick-borne encephalitis virus
KREKKLSEFGK

SEQ ID NO: 248845 - protein, 11 aa, Tick-borne encephalitis virus
REKKLSEFGKA

SEQ ID NO: 248846 - protein, 11 aa, Tick-borne encephalitis virus
EKKLSEFGKAK

SEQ ID NO: 248847 - protein, 11 aa, Tick-borne encephalitis virus
KKLSEFGKAKG

SEQ ID NO: 248848 - protein, 11 aa, Tick-borne encephalitis virus
KLSEFGKAKGS

SEQ ID NO: 248849 - protein, 11 aa, Tick-borne encephalitis virus
LSEFGKAKGSR

SEQ ID NO: 248850 - protein, 11 aa, Tick-borne encephalitis virus
AIWYMWLGSRF

SEQ ID NO: 248851 - protein, 11 aa, Tick-borne encephalitis virus
IWYMWLGSRFL

SEQ ID NO: 248852 - protein, 11 aa, Tick-borne encephalitis virus
WYMWLGSRFLE

SEQ ID NO: 248853 - protein, 11 aa, Tick-borne encephalitis virus
YMWLGSRFLEF

SEQ ID NO: 248854 - protein, 11 aa, Tick-borne encephalitis virus
MEMTYKNKVVK

SEQ ID NO: 248855 - protein, 11 aa, Tick-borne encephalitis virus
EMTYKNKVVKV

SEQ ID NO: 248856 - protein, 11 aa, Tick-borne encephalitis virus
MDVITRRDQRG

SEQ ID NO: 248857 - protein, 11 aa, Tick-borne encephalitis virus
DVITRRDQRGS

SEQ ID NO: 248858 - protein, 11 aa, Tick-borne encephalitis virus
VITRRDQRGSG

SEQ ID NO: 248859 - protein, 11 aa, Tick-borne encephalitis virus
LNDMGKVRKDV

SEQ ID NO: 248860 - protein, 11 aa, Tick-borne encephalitis virus
VPFCSNHFQEI

SEQ ID NO: 248861 - protein, 11 aa, Tick-borne encephalitis virus
GRARVSPGCGW

SEQ ID NO: 248862 - protein, 11 aa, Tick-borne encephalitis virus
RARVSPGCGWS

SEQ ID NO: 248863 - protein, 11 aa, Tick-borne encephalitis virus
ARVSPGCGWSV

SEQ ID NO: 248864 - protein, 11 aa, Tick-borne encephalitis virus
TACLSKAYGQM

SEQ ID NO: 248865 - protein, 11 aa, Tick-borne encephalitis virus
YFHKRDMRLLS

SEQ ID NO: 248866 - protein, 11 aa, Tick-borne encephalitis virus
PKSHDMLCSSL

SEQ ID NO: 248867 - protein, 11 aa, Tick-borne encephalitis virus
KSHDMLCSSLV

SEQ ID NO: 248868 - protein, 11 aa, Tick-borne encephalitis virus
SHDMLCSSLVG

SEQ ID NO: 248869 - protein, 11 aa, Tick-borne encephalitis virus
HDMLCSSLVGR

SEQ ID NO: 248870 - protein, 11 aa, Tick-borne encephalitis virus
DKLCGSLIGMT

SEQ ID NO: 248871 - protein, 8 aa, Flavivirus
VDRGWGNG

SEQ ID NO: 248872 - protein, 8 aa, Flavivirus
DRGWGNGC

SEQ ID NO: 248873 - protein, 8 aa, Flavivirus
RGWGNGCG

SEQ ID NO: 248874 - protein, 8 aa, Flavivirus
GWGNGCGL

SEQ ID NO: 248875 - protein, 8 aa, Flavivirus
WGNGCGLF

SEQ ID NO: 248876 - protein, 8 aa, Flavivirus
GNGCGLFG

SEQ ID NO: 248877 - protein, 8 aa, Flavivirus
NGCGLFGK

SEQ ID NO: 248878 - protein, 8 aa, Flavivirus
GCGLFGKG

SEQ ID NO: 248879 - protein, 8 aa, Flavivirus
CGLFGKGS

SEQ ID NO: 248880 - protein, 8 aa, Flavivirus
GLFGKGSL

SEQ ID NO: 248881 - protein, 8 aa, Flavivirus
VFHTMWHV

SEQ ID NO: 248882 - protein, 8 aa, Flavivirus
FHTMWHVT

SEQ ID NO: 248883 - protein, 8 aa, Flavivirus
HTMWHVTR

SEQ ID NO: 248884 - protein, 8 aa, Flavivirus
TMWHVTRG

SEQ ID NO: 248885 - protein, 8 aa, Flavivirus
MWHVTRGA

SEQ ID NO: 248886 - protein, 8 aa, Flavivirus
VVGLYGNG

SEQ ID NO: 248887 - protein, 8 aa, Flavivirus
DLHPGSGK

SEQ ID NO: 248888 - protein, 8 aa, Flavivirus
LHPGSGKT

SEQ ID NO: 248889 - protein, 8 aa, Flavivirus
HPGSGKTR

SEQ ID NO: 248890 - protein, 8 aa, Flavivirus
TLILAPTR

SEQ ID NO: 248891 - protein, 8 aa, Flavivirus
LILAPTRV

SEQ ID NO: 248892 - protein, 8 aa, Flavivirus
ILAPTRVV

SEQ ID NO: 248893 - protein, 8 aa, Flavivirus
LAPTRVVA

SEQ ID NO: 248894 - protein, 8 aa, Flavivirus
PTRVVAAE

SEQ ID NO: 248895 - protein, 8 aa, Flavivirus
VDLMCHAT

SEQ ID NO: 248896 - protein, 8 aa, Flavivirus
DLMCHATF

SEQ ID NO: 248897 - protein, 8 aa, Flavivirus
IMDEAHFT

SEQ ID NO: 248898 - protein, 8 aa, Flavivirus
MDEAHFTD

SEQ ID NO: 248899 - protein, 8 aa, Flavivirus
DEAHFTDP

SEQ ID NO: 248900 - protein, 8 aa, Flavivirus
SIAARGYI

SEQ ID NO: 248901 - protein, 8 aa, Flavivirus
IFMTATPP

SEQ ID NO: 248902 - protein, 8 aa, Flavivirus
FMTATPPG

SEQ ID NO: 248903 - protein, 8 aa, Flavivirus
MTATPPGS

SEQ ID NO: 248904 - protein, 8 aa, Flavivirus
GKTVWFVP

SEQ ID NO: 248905 - protein, 8 aa, Flavivirus
KTVWFVPS

SEQ ID NO: 248906 - protein, 8 aa, Flavivirus
WDFVVTTD

SEQ ID NO: 248907 - protein, 8 aa, Flavivirus
DFVVTTDI

SEQ ID NO: 248908 - protein, 8 aa, Flavivirus
FVVTTDIS

SEQ ID NO: 248909 - protein, 8 aa, Flavivirus
VVTTDISE

SEQ ID NO: 248910 - protein, 8 aa, Flavivirus
VTTDISEM

SEQ ID NO: 248911 - protein, 8 aa, Flavivirus
TTDISEMG

SEQ ID NO: 248912 - protein, 8 aa, Flavivirus
TDISEMGA

SEQ ID NO: 248913 - protein, 8 aa, Flavivirus
DISEMGAN

SEQ ID NO: 248914 - protein, 8 aa, Flavivirus
ISEMGANF

SEQ ID NO: 248915 - protein, 8 aa, Flavivirus
ASAAQRRG

SEQ ID NO: 248916 - protein, 8 aa, Flavivirus
SAAQRRGR

SEQ ID NO: 248917 - protein, 8 aa, Flavivirus
AAQRRGRI

SEQ ID NO: 248918 - protein, 8 aa, Flavivirus
AQRRGRIG

SEQ ID NO: 248919 - protein, 8 aa, Flavivirus
QRRGRIGR

SEQ ID NO: 248920 - protein, 8 aa, Flavivirus
VSRGTAKL

SEQ ID NO: 248921 - protein, 8 aa, Flavivirus
VIDLGCGR

SEQ ID NO: 248922 - protein, 8 aa, Flavivirus
IDLGCGRG

SEQ ID NO: 248923 - protein, 8 aa, Flavivirus
DLGCGRGG

SEQ ID NO: 248924 - protein, 8 aa, Flavivirus
LGCGRGGW

SEQ ID NO: 248925 - protein, 8 aa, Flavivirus
GCGRGGWS

SEQ ID NO: 248926 - protein, 8 aa, Flavivirus
CGRGGWSY

SEQ ID NO: 248927 - protein, 8 aa, Flavivirus
GRGGWSYY

SEQ ID NO: 248928 - protein, 8 aa, Flavivirus
TLLCDIGE

SEQ ID NO: 248929 - protein, 8 aa, Flavivirus
LLCDIGES

SEQ ID NO: 248930 - protein, 8 aa, Flavivirus
LCDIGESS

SEQ ID NO: 248931 - protein, 8 aa, Flavivirus
CDIGESSP

SEQ ID NO: 248932 - protein, 8 aa, Flavivirus
PLSRNSTH

SEQ ID NO: 248933 - protein, 8 aa, Flavivirus
LSRNSTHE

SEQ ID NO: 248934 - protein, 8 aa, Flavivirus
SRNSTHEM

SEQ ID NO: 248935 - protein, 8 aa, Flavivirus
RNSTHEMY

SEQ ID NO: 248936 - protein, 8 aa, Flavivirus
NSTHEMYW

SEQ ID NO: 248937 - protein, 8 aa, Flavivirus
MAMTDTTP

SEQ ID NO: 248938 - protein, 8 aa, Flavivirus
AMTDTTPF

SEQ ID NO: 248939 - protein, 8 aa, Flavivirus
MTDTTPFG

SEQ ID NO: 248940 - protein, 8 aa, Flavivirus
TDTTPFGQ

SEQ ID NO: 248941 - protein, 8 aa, Flavivirus
DTTPFGQQ

SEQ ID NO: 248942 - protein, 8 aa, Flavivirus
TTPFGQQR

SEQ ID NO: 248943 - protein, 8 aa, Flavivirus
TPFGQQRV

SEQ ID NO: 248944 - protein, 8 aa, Flavivirus
PFGQQRVF

SEQ ID NO: 248945 - protein, 8 aa, Flavivirus
FGQQRVFK

SEQ ID NO: 248946 - protein, 8 aa, Flavivirus
GQQRVFKE

SEQ ID NO: 248947 - protein, 8 aa, Flavivirus
QQRVFKEK

SEQ ID NO: 248948 - protein, 8 aa, Flavivirus
QRVFKEKV

SEQ ID NO: 248949 - protein, 8 aa, Flavivirus
RVFKEKVD

SEQ ID NO: 248950 - protein, 8 aa, Flavivirus
VFKEKVDT

SEQ ID NO: 248951 - protein, 8 aa, Flavivirus
FKEKVDTR

SEQ ID NO: 248952 - protein, 8 aa, Flavivirus
KEKVDTRT

SEQ ID NO: 248953 - protein, 8 aa, Flavivirus
CVYNMMGK

SEQ ID NO: 248954 - protein, 8 aa, Flavivirus
VYNMMGKR

SEQ ID NO: 248955 - protein, 8 aa, Flavivirus
YNMMGKRE

SEQ ID NO: 248956 - protein, 8 aa, Flavivirus
NMMGKREK

SEQ ID NO: 248957 - protein, 8 aa, Flavivirus
MMGKREKK

SEQ ID NO: 248958 - protein, 8 aa, Flavivirus
MGKREKKL

SEQ ID NO: 248959 - protein, 8 aa, Flavivirus
GEFGKAKG

SEQ ID NO: 248960 - protein, 8 aa, Flavivirus
EFGKAKGS

SEQ ID NO: 248961 - protein, 8 aa, Flavivirus
FGKAKGSR

SEQ ID NO: 248962 - protein, 8 aa, Flavivirus
GKAKGSRA

SEQ ID NO: 248963 - protein, 8 aa, Flavivirus
KAKGSRAI

SEQ ID NO: 248964 - protein, 8 aa, Flavivirus
AKGSRAIW

SEQ ID NO: 248965 - protein, 8 aa, Flavivirus
KGSRAIWY

SEQ ID NO: 248966 - protein, 8 aa, Flavivirus
GSRAIWYM

SEQ ID NO: 248967 - protein, 8 aa, Flavivirus
SRAIWYMW

SEQ ID NO: 248968 - protein, 8 aa, Flavivirus
RAIWYMWL

SEQ ID NO: 248969 - protein, 8 aa, Flavivirus
AIWYMWLG

SEQ ID NO: 248970 - protein, 8 aa, Flavivirus
IWYMWLGA

SEQ ID NO: 248971 - protein, 8 aa, Flavivirus
WYMWLGAR

SEQ ID NO: 248972 - protein, 8 aa, Flavivirus
YMWLGARF

SEQ ID NO: 248973 - protein, 8 aa, Flavivirus
MWLGARFL

SEQ ID NO: 248974 - protein, 8 aa, Flavivirus
WLGARFLE

SEQ ID NO: 248975 - protein, 8 aa, Flavivirus
LGARFLEF

SEQ ID NO: 248976 - protein, 8 aa, Flavivirus
GARFLEFE

SEQ ID NO: 248977 - protein, 8 aa, Flavivirus
ARFLEFEA

SEQ ID NO: 248978 - protein, 8 aa, Flavivirus
RFLEFEAL

SEQ ID NO: 248979 - protein, 8 aa, Flavivirus
FLEFEALG

SEQ ID NO: 248980 - protein, 8 aa, Flavivirus
LEFEALGF

SEQ ID NO: 248981 - protein, 8 aa, Flavivirus
EFEALGFL

SEQ ID NO: 248982 - protein, 8 aa, Flavivirus
FEALGFLN

SEQ ID NO: 248983 - protein, 8 aa, Flavivirus
EALGFLNE

SEQ ID NO: 248984 - protein, 8 aa, Flavivirus
ALGFLNED

SEQ ID NO: 248985 - protein, 8 aa, Flavivirus
LGFLNEDH

SEQ ID NO: 248986 - protein, 8 aa, Flavivirus
GFLNEDHW

SEQ ID NO: 248987 - protein, 8 aa, Flavivirus
MYADDTAG

SEQ ID NO: 248988 - protein, 8 aa, Flavivirus
YADDTAGW

SEQ ID NO: 248989 - protein, 8 aa, Flavivirus
ADDTAGWD

SEQ ID NO: 248990 - protein, 8 aa, Flavivirus
DDTAGWDT

SEQ ID NO: 248991 - protein, 8 aa, Flavivirus
DTAGWDTR

SEQ ID NO: 248992 - protein, 8 aa, Flavivirus
TAGWDTRI

SEQ ID NO: 248993 - protein, 8 aa, Flavivirus
AGWDTRIT

SEQ ID NO: 248994 - protein, 8 aa, Flavivirus
QRGSGQVG

SEQ ID NO: 248995 - protein, 8 aa, Flavivirus
RGSGQVGT

SEQ ID NO: 248996 - protein, 8 aa, Flavivirus
GSGQVGTY

SEQ ID NO: 248997 - protein, 8 aa, Flavivirus
SGQVGTYG

SEQ ID NO: 248998 - protein, 8 aa, Flavivirus
GQVGTYGL

SEQ ID NO: 248999 - protein, 8 aa, Flavivirus
QVGTYGLN

SEQ ID NO: 249000 - protein, 8 aa, Flavivirus
VGTYGLNT

SEQ ID NO: 249001 - protein, 8 aa, Flavivirus
RMAISGDD

SEQ ID NO: 249002 - protein, 8 aa, Flavivirus
MAISGDDC

SEQ ID NO: 249003 - protein, 8 aa, Flavivirus
VPFCSHHF

SEQ ID NO: 249004 - protein, 8 aa, Flavivirus
PFCSHHFH

SEQ ID NO: 249005 - protein, 8 aa, Flavivirus
QDELIGRA

SEQ ID NO: 249006 - protein, 8 aa, Flavivirus
DELIGRAR

SEQ ID NO: 249007 - protein, 8 aa, Flavivirus
ELIGRARI

SEQ ID NO: 249008 - protein, 8 aa, Flavivirus
LIGRARIS

SEQ ID NO: 249009 - protein, 8 aa, Flavivirus
GRARISQG

SEQ ID NO: 249010 - protein, 8 aa, Flavivirus
LMYFHRRD

SEQ ID NO: 249011 - protein, 8 aa, Flavivirus
MYFHRRDL

SEQ ID NO: 249012 - protein, 8 aa, Flavivirus
YFHRRDLR

SEQ ID NO: 249013 - protein, 8 aa, Flavivirus
FHRRDLRL

SEQ ID NO: 249014 - protein, 8 aa, Flavivirus
HRRDLRLA

SEQ ID NO: 249015 - protein, 8 aa, Flavivirus
PTSRTTWS

SEQ ID NO: 249016 - protein, 8 aa, Flavivirus
SRTTWSIH

SEQ ID NO: 249017 - protein, 8 aa, Flavivirus
TDRGWGNG

SEQ ID NO: 249018 - protein, 8 aa, Flavivirus
DRGWGNHC

SEQ ID NO: 249019 - protein, 8 aa, Flavivirus
RGWGNHCG

SEQ ID NO: 249020 - protein, 8 aa, Flavivirus
GWGNHCGL

SEQ ID NO: 249021 - protein, 8 aa, Flavivirus
WGNHCGLF

SEQ ID NO: 249022 - protein, 8 aa, Flavivirus
GNHCGLFG

SEQ ID NO: 249023 - protein, 8 aa, Flavivirus
NHCGLFGK

SEQ ID NO: 249024 - protein, 8 aa, Flavivirus
HCGLFGKG

SEQ ID NO: 249025 - protein, 8 aa, Flavivirus
CGLFGKGG

SEQ ID NO: 249026 - protein, 8 aa, Flavivirus
GLFGKGGI

SEQ ID NO: 249027 - protein, 8 aa, Flavivirus
TFHTMWHV

SEQ ID NO: 249028 - protein, 8 aa, Flavivirus
FHTLWHTT

SEQ ID NO: 249029 - protein, 8 aa, Flavivirus
HTLWHTTK

SEQ ID NO: 249030 - protein, 8 aa, Flavivirus
TLWHTTKG

SEQ ID NO: 249031 - protein, 8 aa, Flavivirus
LWHTTKGA

SEQ ID NO: 249032 - protein, 8 aa, Flavivirus
IVGLYGNG

SEQ ID NO: 249033 - protein, 8 aa, Flavivirus
DLHPGAGK

SEQ ID NO: 249034 - protein, 8 aa, Flavivirus
LHPGAGKT

SEQ ID NO: 249035 - protein, 8 aa, Flavivirus
HPGAGKTK

SEQ ID NO: 249036 - protein, 8 aa, Flavivirus
TAVLAPTR

SEQ ID NO: 249037 - protein, 8 aa, Flavivirus
AVLAPTRV

SEQ ID NO: 249038 - protein, 8 aa, Flavivirus
VLAPTRVV

SEQ ID NO: 249039 - protein, 8 aa, Flavivirus
LAPTRVVL

SEQ ID NO: 249040 - protein, 8 aa, Flavivirus
PTRVVASE

SEQ ID NO: 249041 - protein, 8 aa, Flavivirus
VDVMCHAT

SEQ ID NO: 249042 - protein, 8 aa, Flavivirus
DVMCHATL

SEQ ID NO: 249043 - protein, 8 aa, Flavivirus
VMDEAHFT

SEQ ID NO: 249044 - protein, 8 aa, Flavivirus
MDEAHWTD

SEQ ID NO: 249045 - protein, 8 aa, Flavivirus
DEAHWTDP

SEQ ID NO: 249046 - protein, 8 aa, Flavivirus
SVAARGYI

SEQ ID NO: 249047 - protein, 8 aa, Flavivirus
VLMTATPP

SEQ ID NO: 249048 - protein, 8 aa, Flavivirus
LMTATPPG

SEQ ID NO: 249049 - protein, 8 aa, Flavivirus
MTATPPGT

SEQ ID NO: 249050 - protein, 8 aa, Flavivirus
GKTVWFVA

SEQ ID NO: 249051 - protein, 8 aa, Flavivirus
KTVWFVAS

SEQ ID NO: 249052 - protein, 8 aa, Flavivirus
WDYVVTTD

SEQ ID NO: 249053 - protein, 8 aa, Flavivirus
DYVVTTDI

SEQ ID NO: 249054 - protein, 8 aa, Flavivirus
YVVTTDIS

SEQ ID NO: 249055 - protein, 8 aa, Flavivirus
VITTDISE

SEQ ID NO: 249056 - protein, 8 aa, Flavivirus
ITTDISEM

SEQ ID NO: 249057 - protein, 8 aa, Flavivirus
ATDIAEMG

SEQ ID NO: 249058 - protein, 8 aa, Flavivirus
TDIAEMGA

SEQ ID NO: 249059 - protein, 8 aa, Flavivirus
DIAEMGAN

SEQ ID NO: 249060 - protein, 8 aa, Flavivirus
ISEMGANL

SEQ ID NO: 249061 - protein, 8 aa, Flavivirus
SSAAQRRG

SEQ ID NO: 249062 - protein, 8 aa, Flavivirus
AAQRRGRV

SEQ ID NO: 249063 - protein, 8 aa, Flavivirus
AQRRGRVG

SEQ ID NO: 249064 - protein, 8 aa, Flavivirus
QRRGRVGR

SEQ ID NO: 249065 - protein, 8 aa, Flavivirus
VSRGSAKL

SEQ ID NO: 249066 - protein, 8 aa, Flavivirus
VVDLGCGR

SEQ ID NO: 249067 - protein, 8 aa, Flavivirus
VDLGCGRG

SEQ ID NO: 249068 - protein, 8 aa, Flavivirus
GCGRGGWC

SEQ ID NO: 249069 - protein, 8 aa, Flavivirus
CGRGGWCY

SEQ ID NO: 249070 - protein, 8 aa, Flavivirus
GRGGWCYY

SEQ ID NO: 249071 - protein, 8 aa, Flavivirus
TLFCDIGE

SEQ ID NO: 249072 - protein, 8 aa, Flavivirus
LFCDIGES

SEQ ID NO: 249073 - protein, 8 aa, Flavivirus
FCDIGESS

SEQ ID NO: 249074 - protein, 8 aa, Flavivirus
CDIGESSS

SEQ ID NO: 249075 - protein, 8 aa, Flavivirus
PLSRNSNH

SEQ ID NO: 249076 - protein, 8 aa, Flavivirus
LSRNSNHE

SEQ ID NO: 249077 - protein, 8 aa, Flavivirus
SRNSNHEM

SEQ ID NO: 249078 - protein, 8 aa, Flavivirus
RNSNHEMY

SEQ ID NO: 249079 - protein, 8 aa, Flavivirus
NSTHEMYY

SEQ ID NO: 249080 - protein, 8 aa, Flavivirus
IAMTDTTP

SEQ ID NO: 249081 - protein, 8 aa, Flavivirus
AMTDTTAF

SEQ ID NO: 249082 - protein, 8 aa, Flavivirus
MTDTTAFG

SEQ ID NO: 249083 - protein, 8 aa, Flavivirus
TDTTAFGQ

SEQ ID NO: 249084 - protein, 8 aa, Flavivirus
DTTAFGQQ

SEQ ID NO: 249085 - protein, 8 aa, Flavivirus
TTAFGQQR

SEQ ID NO: 249086 - protein, 8 aa, Flavivirus
TAFGQQRV

SEQ ID NO: 249087 - protein, 8 aa, Flavivirus
AFGQQRVF

SEQ ID NO: 249088 - protein, 8 aa, Flavivirus
GQQRVFKD

SEQ ID NO: 249089 - protein, 8 aa, Flavivirus
QQRVFKDK

SEQ ID NO: 249090 - protein, 8 aa, Flavivirus
QRVFKDKV

SEQ ID NO: 249091 - protein, 8 aa, Flavivirus
RVFKDKVD

SEQ ID NO: 249092 - protein, 8 aa, Flavivirus
VFKDKVDT

SEQ ID NO: 249093 - protein, 8 aa, Flavivirus
FKEKVDTK

SEQ ID NO: 249094 - protein, 8 aa, Flavivirus
KEKVDTKA

SEQ ID NO: 249095 - protein, 8 aa, Flavivirus
CIYNMMGK

SEQ ID NO: 249096 - protein, 8 aa, Flavivirus
IYNMMGKR

SEQ ID NO: 249097 - protein, 8 aa, Flavivirus
MGKREKKP

SEQ ID NO: 249098 - protein, 8 aa, Flavivirus
GEFGRAKG

SEQ ID NO: 249099 - protein, 8 aa, Flavivirus
EFGRAKGS

SEQ ID NO: 249100 - protein, 8 aa, Flavivirus
FGRAKGSR

SEQ ID NO: 249101 - protein, 8 aa, Flavivirus
GRAKGSRA

SEQ ID NO: 249102 - protein, 8 aa, Flavivirus
RAKGSRAI

SEQ ID NO: 249103 - protein, 8 aa, Flavivirus
KGSRAIWF

SEQ ID NO: 249104 - protein, 8 aa, Flavivirus
GSRAIWFM

SEQ ID NO: 249105 - protein, 8 aa, Flavivirus
SRAIWFMW

SEQ ID NO: 249106 - protein, 8 aa, Flavivirus
RAIWFMWL

SEQ ID NO: 249107 - protein, 8 aa, Flavivirus
AIWFMWLG

SEQ ID NO: 249108 - protein, 8 aa, Flavivirus
IWFMWLGA

SEQ ID NO: 249109 - protein, 8 aa, Flavivirus
WFMWLGAR

SEQ ID NO: 249110 - protein, 8 aa, Flavivirus
YMWLGARY

SEQ ID NO: 249111 - protein, 8 aa, Flavivirus
MWLGARYL

SEQ ID NO: 249112 - protein, 8 aa, Flavivirus
WLGARYLE

SEQ ID NO: 249113 - protein, 8 aa, Flavivirus
LGARYLEF

SEQ ID NO: 249114 - protein, 8 aa, Flavivirus
GARYLEFE

SEQ ID NO: 249115 - protein, 8 aa, Flavivirus
ARYLEFEA

SEQ ID NO: 249116 - protein, 8 aa, Flavivirus
RYLEFEAL

SEQ ID NO: 249117 - protein, 8 aa, Flavivirus
YLEFEALG

SEQ ID NO: 249118 - protein, 8 aa, Flavivirus
EFEALGFM

SEQ ID NO: 249119 - protein, 8 aa, Flavivirus
FEALGFMN

SEQ ID NO: 249120 - protein, 8 aa, Flavivirus
EALGFMNE

SEQ ID NO: 249121 - protein, 8 aa, Flavivirus
ALGFMNED

SEQ ID NO: 249122 - protein, 8 aa, Flavivirus
LGFMNEDH

SEQ ID NO: 249123 - protein, 8 aa, Flavivirus
GFMNEDHW

SEQ ID NO: 249124 - protein, 8 aa, Flavivirus
IYADDTAG

SEQ ID NO: 249125 - protein, 8 aa, Flavivirus
DTAGWDTK

SEQ ID NO: 249126 - protein, 8 aa, Flavivirus
TAGWDTKV

SEQ ID NO: 249127 - protein, 8 aa, Flavivirus
AGWDTKVT

SEQ ID NO: 249128 - protein, 8 aa, Flavivirus
QRGSGQVV

SEQ ID NO: 249129 - protein, 8 aa, Flavivirus
RGSGQVVT

SEQ ID NO: 249130 - protein, 8 aa, Flavivirus
GSGQVVTY

SEQ ID NO: 249131 - protein, 8 aa, Flavivirus
SGQVVTYA

SEQ ID NO: 249132 - protein, 8 aa, Flavivirus
GQVVTYAL

SEQ ID NO: 249133 - protein, 8 aa, Flavivirus
QVVTYALN

SEQ ID NO: 249134 - protein, 8 aa, Flavivirus
VVTYALNT

SEQ ID NO: 249135 - protein, 8 aa, Flavivirus
RMAVSGDD

SEQ ID NO: 249136 - protein, 8 aa, Flavivirus
MAVSGDDC

SEQ ID NO: 249137 - protein, 8 aa, Flavivirus
VPFCSNHF

SEQ ID NO: 249138 - protein, 8 aa, Flavivirus
PFCSNHFT

SEQ ID NO: 249139 - protein, 8 aa, Flavivirus
QDELVGRA

SEQ ID NO: 249140 - protein, 8 aa, Flavivirus
DELVGRAR

SEQ ID NO: 249141 - protein, 8 aa, Flavivirus
ELVGRARV

SEQ ID NO: 249142 - protein, 8 aa, Flavivirus
LVGRARVS

SEQ ID NO: 249143 - protein, 8 aa, Flavivirus
GRARVSQG

SEQ ID NO: 249144 - protein, 8 aa, Flavivirus
LLYFHRRD

SEQ ID NO: 249145 - protein, 8 aa, Flavivirus
LYFHRRDL

SEQ ID NO: 249146 - protein, 8 aa, Flavivirus
YFHKRDMR

SEQ ID NO: 249147 - protein, 8 aa, Flavivirus
FHRRDLRT

SEQ ID NO: 249148 - protein, 8 aa, Flavivirus
HRRDLRLM

SEQ ID NO: 249149 - protein, 8 aa, Flavivirus
PTGRTTWS

SEQ ID NO: 249150 - protein, 8 aa, Flavivirus
GRTTWSIH

SEQ ID NO: 249151 - protein, 8 aa, Flavivirus
SDRGWGNH

SEQ ID NO: 249152 - protein, 8 aa, Flavivirus
GLFGKGSI

SEQ ID NO: 249153 - protein, 8 aa, Flavivirus
VFHTLWHT

SEQ ID NO: 249154 - protein, 8 aa, Flavivirus
LHTMWHVT

SEQ ID NO: 249155 - protein, 8 aa, Flavivirus
HTLWHTTR

SEQ ID NO: 249156 - protein, 8 aa, Flavivirus
TLWHTTRG

SEQ ID NO: 249157 - protein, 8 aa, Flavivirus
MWHVTRGS

SEQ ID NO: 249158 - protein, 8 aa, Flavivirus
VIGLYGNG

SEQ ID NO: 249159 - protein, 8 aa, Flavivirus
DMHPGSGK

SEQ ID NO: 249160 - protein, 8 aa, Flavivirus
MHPGSGKT

SEQ ID NO: 249161 - protein, 8 aa, Flavivirus
HPGAGKTR

SEQ ID NO: 249162 - protein, 8 aa, Flavivirus
TLVLAPTR

SEQ ID NO: 249163 - protein, 8 aa, Flavivirus
LVLAPTRV

SEQ ID NO: 249164 - protein, 8 aa, Flavivirus
PTRVVLKE

SEQ ID NO: 249165 - protein, 8 aa, Flavivirus
IDAMCHAT

SEQ ID NO: 249166 - protein, 8 aa, Flavivirus
DVMCHATY

SEQ ID NO: 249167 - protein, 8 aa, Flavivirus
IMDEAHWT

SEQ ID NO: 249168 - protein, 8 aa, Flavivirus
MDEAHFLD

SEQ ID NO: 249169 - protein, 8 aa, Flavivirus
DEAHFLDP

SEQ ID NO: 249170 - protein, 8 aa, Flavivirus
SIAARGHL

SEQ ID NO: 249171 - protein, 8 aa, Flavivirus
ILMTATPP

SEQ ID NO: 249172 - protein, 8 aa, Flavivirus
MTATPPGA

SEQ ID NO: 249173 - protein, 8 aa, Flavivirus
GRTAWFVP

SEQ ID NO: 249174 - protein, 8 aa, Flavivirus
RTAWFVPS

SEQ ID NO: 249175 - protein, 8 aa, Flavivirus
WDFVITTD

SEQ ID NO: 249176 - protein, 8 aa, Flavivirus
DFVITTDI

SEQ ID NO: 249177 - protein, 8 aa, Flavivirus
FVITTDIS

SEQ ID NO: 249178 - protein, 8 aa, Flavivirus
ILATDIAE

SEQ ID NO: 249179 - protein, 8 aa, Flavivirus
LATDIAEM

SEQ ID NO: 249180 - protein, 8 aa, Flavivirus
IAEMGANL

SEQ ID NO: 249181 - protein, 8 aa, Flavivirus
VSRGSSKI

SEQ ID NO: 249182 - protein, 8 aa, Flavivirus
VMDLGCGR

SEQ ID NO: 249183 - protein, 8 aa, Flavivirus
MDLGCGRG

SEQ ID NO: 249184 - protein, 8 aa, Flavivirus
TIMCDIGE

SEQ ID NO: 249185 - protein, 8 aa, Flavivirus
IMCDIGES

SEQ ID NO: 249186 - protein, 8 aa, Flavivirus
MCDIGESN

SEQ ID NO: 249187 - protein, 8 aa, Flavivirus
CDIGESNP

SEQ ID NO: 249188 - protein, 8 aa, Flavivirus
PFSRNSTH

SEQ ID NO: 249189 - protein, 8 aa, Flavivirus
FSRNSTHE

SEQ ID NO: 249190 - protein, 8 aa, Flavivirus
NSNHEMYW

SEQ ID NO: 249191 - protein, 8 aa, Flavivirus
LAMTDTTP

SEQ ID NO: 249192 - protein, 8 aa, Flavivirus
FKDKVDTK

SEQ ID NO: 249193 - protein, 8 aa, Flavivirus
KEKVDTRA

SEQ ID NO: 249194 - protein, 8 aa, Flavivirus
MGKREKKT

SEQ ID NO: 249195 - protein, 8 aa, Flavivirus
GEFGVAKG

SEQ ID NO: 249196 - protein, 8 aa, Flavivirus
EFGVAKGS

SEQ ID NO: 249197 - protein, 8 aa, Flavivirus
FGVAKGSR

SEQ ID NO: 249198 - protein, 8 aa, Flavivirus
GVAKGSRA

SEQ ID NO: 249199 - protein, 8 aa, Flavivirus
VAKGSRAI

SEQ ID NO: 249200 - protein, 8 aa, Flavivirus
IWYMWLGS

SEQ ID NO: 249201 - protein, 8 aa, Flavivirus
WYMWLGSR

SEQ ID NO: 249202 - protein, 8 aa, Flavivirus
FMWLGARF

SEQ ID NO: 249203 - protein, 8 aa, Flavivirus
MWLGSRFL

SEQ ID NO: 249204 - protein, 8 aa, Flavivirus
WLGSRFLE

SEQ ID NO: 249205 - protein, 8 aa, Flavivirus
LGSRFLEF

SEQ ID NO: 249206 - protein, 8 aa, Flavivirus
GSRFLEFE

SEQ ID NO: 249207 - protein, 8 aa, Flavivirus
SRFLEFEA

SEQ ID NO: 249208 - protein, 8 aa, Flavivirus
FYADDTAG

SEQ ID NO: 249209 - protein, 8 aa, Flavivirus
TAGWDTRV

SEQ ID NO: 249210 - protein, 8 aa, Flavivirus
AGWDTRVT

SEQ ID NO: 249211 - protein, 8 aa, Flavivirus
SGQVVTYG

SEQ ID NO: 249212 - protein, 8 aa, Flavivirus
GQVVTYGL

SEQ ID NO: 249213 - protein, 8 aa, Flavivirus
QVVTYGLN

SEQ ID NO: 249214 - protein, 8 aa, Flavivirus
VVTYGLNT

SEQ ID NO: 249215 - protein, 8 aa, Flavivirus
RMLVSGDD

SEQ ID NO: 249216 - protein, 8 aa, Flavivirus
MLVSGDDC

SEQ ID NO: 249217 - protein, 8 aa, Flavivirus
VEFCSNHF

SEQ ID NO: 249218 - protein, 8 aa, Flavivirus
PFCSNHFQ

SEQ ID NO: 249219 - protein, 8 aa, Flavivirus
QDELIGRG

SEQ ID NO: 249220 - protein, 8 aa, Flavivirus
DELIGRGR

SEQ ID NO: 249221 - protein, 8 aa, Flavivirus
ELVGRARI

SEQ ID NO: 249222 - protein, 8 aa, Flavivirus
LVGRARIS

SEQ ID NO: 249223 - protein, 8 aa, Flavivirus
GRARISPG

SEQ ID NO: 249224 - protein, 8 aa, Flavivirus
LSYFHRRD

SEQ ID NO: 249225 - protein, 8 aa, Flavivirus
SYFHRRDL

SEQ ID NO: 249226 - protein, 8 aa, Flavivirus
FHKRDMRL

SEQ ID NO: 249227 - protein, 8 aa, Flavivirus
HRRDLRTL

SEQ ID NO: 249228 - protein, 8 aa, Flavivirus
PTGRTSWS

SEQ ID NO: 249229 - protein, 8 aa, Flavivirus
GRTSWSIH

SEQ ID NO: 249230 - protein, 8 aa, Flavivirus
SDRGWGNG

SEQ ID NO: 249231 - protein, 8 aa, Flavivirus
GLFGKGGV

SEQ ID NO: 249232 - protein, 8 aa, Flavivirus
VLHTMWHV

SEQ ID NO: 249233 - protein, 8 aa, Flavivirus
HTMWHVTK

SEQ ID NO: 249234 - protein, 8 aa, Flavivirus
TMWHVTKG

SEQ ID NO: 249235 - protein, 8 aa, Flavivirus
LWHTTRGA

SEQ ID NO: 249236 - protein, 8 aa, Flavivirus
IIGLYGNG

SEQ ID NO: 249237 - protein, 8 aa, Flavivirus
DFHPGAGK

SEQ ID NO: 249238 - protein, 8 aa, Flavivirus
FHPGAGKT

SEQ ID NO: 249239 - protein, 8 aa, Flavivirus
HPGSGKTH

SEQ ID NO: 249240 - protein, 8 aa, Flavivirus
TVILAPTR

SEQ ID NO: 249241 - protein, 8 aa, Flavivirus
VILAPTRV

SEQ ID NO: 249242 - protein, 8 aa, Flavivirus
PTRVVLSE

SEQ ID NO: 249243 - protein, 8 aa, Flavivirus
IDVMCHAT

SEQ ID NO: 249244 - protein, 8 aa, Flavivirus
DAMCHATL

SEQ ID NO: 249245 - protein, 8 aa, Flavivirus
IMDEAHFL

SEQ ID NO: 249246 - protein, 8 aa, Flavivirus
MDEGHWTD

SEQ ID NO: 249247 - protein, 8 aa, Flavivirus
SIAARGWA

SEQ ID NO: 249248 - protein, 8 aa, Flavivirus
MTATPPGK

SEQ ID NO: 249249 - protein, 8 aa, Flavivirus
RPTAWFLP

SEQ ID NO: 249250 - protein, 8 aa, Flavivirus
PTAWFLPS

SEQ ID NO: 249251 - protein, 8 aa, Flavivirus
PDFVVTTD

SEQ ID NO: 249252 - protein, 8 aa, Flavivirus
DFILATDI

SEQ ID NO: 249253 - protein, 8 aa, Flavivirus
FILATDIA

SEQ ID NO: 249254 - protein, 8 aa, Flavivirus
VSRGTSKL

SEQ ID NO: 249255 - protein, 8 aa, Flavivirus
TILCDIGE

SEQ ID NO: 249256 - protein, 8 aa, Flavivirus
ILCDIGES

SEQ ID NO: 249257 - protein, 8 aa, Flavivirus
MCDIGESS

SEQ ID NO: 249258 - protein, 8 aa, Flavivirus
NSTHEMYF

SEQ ID NO: 249259 - protein, 8 aa, Flavivirus
MAMTDTTA

SEQ ID NO: 249260 - protein, 8 aa, Flavivirus
KDKVDTKA

SEQ ID NO: 249261 - protein, 8 aa, Flavivirus
SEFGKAKG

SEQ ID NO: 249262 - protein, 8 aa, Flavivirus
YMWLGSRF

SEQ ID NO: 249263 - protein, 8 aa, Flavivirus
LYADDTAG

SEQ ID NO: 249264 - protein, 8 aa, Flavivirus
RLLVSGDD

SEQ ID NO: 249265 - protein, 8 aa, Flavivirus
PFCSHHFN

SEQ ID NO: 249266 - protein, 8 aa, Flavivirus
ELIGRARV

SEQ ID NO: 249267 - protein, 8 aa, Flavivirus
LIGRGRVS

SEQ ID NO: 249268 - protein, 8 aa, Flavivirus
GRARVSPG

SEQ ID NO: 249269 - protein, 8 aa, Flavivirus
LMYFHKRD

SEQ ID NO: 249270 - protein, 8 aa, Flavivirus
MYFHKRDM

SEQ ID NO: 249271 - protein, 8 aa, Flavivirus
HKRDMRLL

SEQ ID NO: 249272 - protein, 8 aa, Flavivirus
PQGRTTWS

SEQ ID NO: 249273 - protein, 8 aa, Flavivirus
GRTTWSVH

SEQ ID NO: 249274 - protein, 8 aa, Flavivirus
GFFGKGSI

SEQ ID NO: 249275 - protein, 8 aa, Flavivirus
MWHVTQGA

SEQ ID NO: 249276 - protein, 8 aa, Flavivirus
DAHPGSGK

SEQ ID NO: 249277 - protein, 8 aa, Flavivirus
AHPGSGKT

SEQ ID NO: 249278 - protein, 8 aa, Flavivirus
TAILAPTR

SEQ ID NO: 249279 - protein, 8 aa, Flavivirus
VVLAPTRV

SEQ ID NO: 249280 - protein, 8 aa, Flavivirus
PTRVVLRE

SEQ ID NO: 249281 - protein, 8 aa, Flavivirus
IMDEGHWT

SEQ ID NO: 249282 - protein, 8 aa, Flavivirus
MSATPPGT

SEQ ID NO: 249283 - protein, 8 aa, Flavivirus
GRTVWFVP

SEQ ID NO: 249284 - protein, 8 aa, Flavivirus
RTVWFVPS

SEQ ID NO: 249285 - protein, 8 aa, Flavivirus
PDFILATD

SEQ ID NO: 249286 - protein, 8 aa, Flavivirus
VSRGCAKL

SEQ ID NO: 249287 - protein, 8 aa, Flavivirus
TVMCDIGE

SEQ ID NO: 249288 - protein, 8 aa, Flavivirus
VMCDIGES

SEQ ID NO: 249289 - protein, 8 aa, Flavivirus
LCDIGESN

SEQ ID NO: 249290 - protein, 8 aa, Flavivirus
AEFGKAKG

SEQ ID NO: 249291 - protein, 8 aa, Flavivirus
FMWLGARY

SEQ ID NO: 249292 - protein, 8 aa, Flavivirus
NMVIAGDD

SEQ ID NO: 249293 - protein, 8 aa, Flavivirus
EFCSNHFH

SEQ ID NO: 249294 - protein, 8 aa, Flavivirus
ELIGRGRV

SEQ ID NO: 249295 - protein, 8 aa, Flavivirus
LIGRARVS

SEQ ID NO: 249296 - protein, 8 aa, Flavivirus
GRGRVSPG

SEQ ID NO: 249297 - protein, 8 aa, Flavivirus
NYFHRRDL

SEQ ID NO: 249298 - protein, 8 aa, Flavivirus
HRRDLRVM

SEQ ID NO: 249299 - protein, 9 aa, Flavivirus
VDRGWGNGC

SEQ ID NO: 249300 - protein, 9 aa, Flavivirus
DRGWGNGCG

SEQ ID NO: 249301 - protein, 9 aa, Flavivirus
RGWGNGCGL

SEQ ID NO: 249302 - protein, 9 aa, Flavivirus
GWGNGCGLF

SEQ ID NO: 249303 - protein, 9 aa, Flavivirus
WGNGCGLFG

SEQ ID NO: 249304 - protein, 9 aa, Flavivirus
GNGCGLFGK

SEQ ID NO: 249305 - protein, 9 aa, Flavivirus
NGCGLFGKG

SEQ ID NO: 249306 - protein, 9 aa, Flavivirus
GCGLFGKGS

SEQ ID NO: 249307 - protein, 9 aa, Flavivirus
CGLFGKGSL

SEQ ID NO: 249308 - protein, 9 aa, Flavivirus
VFHTMWHVT

SEQ ID NO: 249309 - protein, 9 aa, Flavivirus
HTMWHVTRG

SEQ ID NO: 249310 - protein, 9 aa, Flavivirus
TMWHVTRGA

SEQ ID NO: 249311 - protein, 9 aa, Flavivirus
TLILAPTRV

SEQ ID NO: 249312 - protein, 9 aa, Flavivirus
LILAPTRVV

SEQ ID NO: 249313 - protein, 9 aa, Flavivirus
ILAPTRVVA

SEQ ID NO: 249314 - protein, 9 aa, Flavivirus
IMDEAHFTD

SEQ ID NO: 249315 - protein, 9 aa, Flavivirus
MDEAHFTDP

SEQ ID NO: 249316 - protein, 9 aa, Flavivirus
IFMTATPPG

SEQ ID NO: 249317 - protein, 9 aa, Flavivirus
GKTVWFVPS

SEQ ID NO: 249318 - protein, 9 aa, Flavivirus
WDFVVTTDI

SEQ ID NO: 249319 - protein, 9 aa, Flavivirus
DFVVTTDIS

SEQ ID NO: 249320 - protein, 9 aa, Flavivirus
FVVTTDISE

SEQ ID NO: 249321 - protein, 9 aa, Flavivirus
VVTTDISEM

SEQ ID NO: 249322 - protein, 9 aa, Flavivirus
VTTDISEMG

SEQ ID NO: 249323 - protein, 9 aa, Flavivirus
TTDISEMGA

SEQ ID NO: 249324 - protein, 9 aa, Flavivirus
TDISEMGAN

SEQ ID NO: 249325 - protein, 9 aa, Flavivirus
DISEMGANF

SEQ ID NO: 249326 - protein, 9 aa, Flavivirus
ASAAQRRGR

SEQ ID NO: 249327 - protein, 9 aa, Flavivirus
SAAQRRGRI

SEQ ID NO: 249328 - protein, 9 aa, Flavivirus
AAQRRGRIG

SEQ ID NO: 249329 - protein, 9 aa, Flavivirus
AQRRGRIGR

SEQ ID NO: 249330 - protein, 9 aa, Flavivirus
VIDLGCGRG

SEQ ID NO: 249331 - protein, 9 aa, Flavivirus
IDLGCGRGG

SEQ ID NO: 249332 - protein, 9 aa, Flavivirus
DLGCGRGGW

SEQ ID NO: 249333 - protein, 9 aa, Flavivirus
LGCGRGGWS

SEQ ID NO: 249334 - protein, 9 aa, Flavivirus
GCGRGGWSY

SEQ ID NO: 249335 - protein, 9 aa, Flavivirus
CGRGGWSYY

SEQ ID NO: 249336 - protein, 9 aa, Flavivirus
TLLCDIGES

SEQ ID NO: 249337 - protein, 9 aa, Flavivirus
PLSRNSTHE

SEQ ID NO: 249338 - protein, 9 aa, Flavivirus
LSRNSTHEM

SEQ ID NO: 249339 - protein, 9 aa, Flavivirus
SRNSTHEMY

SEQ ID NO: 249340 - protein, 9 aa, Flavivirus
RNSTHEMYW

SEQ ID NO: 249341 - protein, 9 aa, Flavivirus
MAMTDTTPF

SEQ ID NO: 249342 - protein, 9 aa, Flavivirus
AMTDTTPFG

SEQ ID NO: 249343 - protein, 9 aa, Flavivirus
MTDTTPFGQ

SEQ ID NO: 249344 - protein, 9 aa, Flavivirus
TDTTPFGQQ

SEQ ID NO: 249345 - protein, 9 aa, Flavivirus
DTTPFGQQR

SEQ ID NO: 249346 - protein, 9 aa, Flavivirus
TTPFGQQRV

SEQ ID NO: 249347 - protein, 9 aa, Flavivirus
TPFGQQRVF

SEQ ID NO: 249348 - protein, 9 aa, Flavivirus
PFGQQRVFK

SEQ ID NO: 249349 - protein, 9 aa, Flavivirus
FGQQRVFKE

SEQ ID NO: 249350 - protein, 9 aa, Flavivirus
GQQRVFKEK

SEQ ID NO: 249351 - protein, 9 aa, Flavivirus
QQRVFKEKV

SEQ ID NO: 249352 - protein, 9 aa, Flavivirus
QRVFKEKVD

SEQ ID NO: 249353 - protein, 9 aa, Flavivirus
RVFKEKVDT

SEQ ID NO: 249354 - protein, 9 aa, Flavivirus
VFKEKVDTR

SEQ ID NO: 249355 - protein, 9 aa, Flavivirus
FKEKVDTRT

SEQ ID NO: 249356 - protein, 9 aa, Flavivirus
CVYNMMGKR

SEQ ID NO: 249357 - protein, 9 aa, Flavivirus
VYNMMGKRE

SEQ ID NO: 249358 - protein, 9 aa, Flavivirus
YNMMGKREK

SEQ ID NO: 249359 - protein, 9 aa, Flavivirus
NMMGKREKK

SEQ ID NO: 249360 - protein, 9 aa, Flavivirus
MMGKREKKL

SEQ ID NO: 249361 - protein, 9 aa, Flavivirus
GEFGKAKGS

SEQ ID NO: 249362 - protein, 9 aa, Flavivirus
EFGKAKGSR

SEQ ID NO: 249363 - protein, 9 aa, Flavivirus
FGKAKGSRA

SEQ ID NO: 249364 - protein, 9 aa, Flavivirus
GKAKGSRAI

SEQ ID NO: 249365 - protein, 9 aa, Flavivirus
KAKGSRAIW

SEQ ID NO: 249366 - protein, 9 aa, Flavivirus
AKGSRAIWY

SEQ ID NO: 249367 - protein, 9 aa, Flavivirus
KGSRAIWYM

SEQ ID NO: 249368 - protein, 9 aa, Flavivirus
GSRAIWYMW

SEQ ID NO: 249369 - protein, 9 aa, Flavivirus
SRAIWYMWL

SEQ ID NO: 249370 - protein, 9 aa, Flavivirus
RAIWYMWLG

SEQ ID NO: 249371 - protein, 9 aa, Flavivirus
AIWYMWLGA

SEQ ID NO: 249372 - protein, 9 aa, Flavivirus
IWYMWLGAR

SEQ ID NO: 249373 - protein, 9 aa, Flavivirus
WYMWLGARF

SEQ ID NO: 249374 - protein, 9 aa, Flavivirus
YMWLGARFL

SEQ ID NO: 249375 - protein, 9 aa, Flavivirus
MWLGARFLE

SEQ ID NO: 249376 - protein, 9 aa, Flavivirus
WLGARFLEF

SEQ ID NO: 249377 - protein, 9 aa, Flavivirus
LGARFLEFE

SEQ ID NO: 249378 - protein, 9 aa, Flavivirus
GARFLEFEA

SEQ ID NO: 249379 - protein, 9 aa, Flavivirus
ARFLEFEAL

SEQ ID NO: 249380 - protein, 9 aa, Flavivirus
RFLEFEALG

SEQ ID NO: 249381 - protein, 9 aa, Flavivirus
FLEFEALGF

SEQ ID NO: 249382 - protein, 9 aa, Flavivirus
LEFEALGFL

SEQ ID NO: 249383 - protein, 9 aa, Flavivirus
EFEALGFLN

SEQ ID NO: 249384 - protein, 9 aa, Flavivirus
FEALGFLNE

SEQ ID NO: 249385 - protein, 9 aa, Flavivirus
EALGFLNED

SEQ ID NO: 249386 - protein, 9 aa, Flavivirus
ALGFLNEDH

SEQ ID NO: 249387 - protein, 9 aa, Flavivirus
LGFLNEDHW

SEQ ID NO: 249388 - protein, 9 aa, Flavivirus
MYADDTAGW

SEQ ID NO: 249389 - protein, 9 aa, Flavivirus
YADDTAGWD

SEQ ID NO: 249390 - protein, 9 aa, Flavivirus
ADDTAGWDT

SEQ ID NO: 249391 - protein, 9 aa, Flavivirus
DDTAGWDTR

SEQ ID NO: 249392 - protein, 9 aa, Flavivirus
DTAGWDTRI

SEQ ID NO: 249393 - protein, 9 aa, Flavivirus
TAGWDTRIT

SEQ ID NO: 249394 - protein, 9 aa, Flavivirus
QRGSGQVGT

SEQ ID NO: 249395 - protein, 9 aa, Flavivirus
RGSGQVGTY

SEQ ID NO: 249396 - protein, 9 aa, Flavivirus
GSGQVGTYG

SEQ ID NO: 249397 - protein, 9 aa, Flavivirus
SGQVGTYGL

SEQ ID NO: 249398 - protein, 9 aa, Flavivirus
GQVGTYGLN

SEQ ID NO: 249399 - protein, 9 aa, Flavivirus
QVGTYGLNT

SEQ ID NO: 249400 - protein, 9 aa, Flavivirus
QDELIGRAR

SEQ ID NO: 249401 - protein, 9 aa, Flavivirus
DELIGRARI

SEQ ID NO: 249402 - protein, 9 aa, Flavivirus
ELIGRARIS

SEQ ID NO: 249403 - protein, 9 aa, Flavivirus
LMYFHRRDL

SEQ ID NO: 249404 - protein, 9 aa, Flavivirus
MYFHRRDLR

SEQ ID NO: 249405 - protein, 9 aa, Flavivirus
YFHRRDLRL

SEQ ID NO: 249406 - protein, 9 aa, Flavivirus
FHRRDLRLA

SEQ ID NO: 249407 - protein, 9 aa, Flavivirus
TDRGWGNGC

SEQ ID NO: 249408 - protein, 9 aa, Flavivirus
DRGWGNHCG

SEQ ID NO: 249409 - protein, 9 aa, Flavivirus
RGWGNHCGL

SEQ ID NO: 249410 - protein, 9 aa, Flavivirus
GWGNHCGLF

SEQ ID NO: 249411 - protein, 9 aa, Flavivirus
WGNHCGLFG

SEQ ID NO: 249412 - protein, 9 aa, Flavivirus
GNHCGLFGK

SEQ ID NO: 249413 - protein, 9 aa, Flavivirus
NHCGLFGKG

SEQ ID NO: 249414 - protein, 9 aa, Flavivirus
GCGLFGKGG

SEQ ID NO: 249415 - protein, 9 aa, Flavivirus
CGLFGKGGI

SEQ ID NO: 249416 - protein, 9 aa, Flavivirus
TFHTMWHVT

SEQ ID NO: 249417 - protein, 9 aa, Flavivirus
HTLWHTTKG

SEQ ID NO: 249418 - protein, 9 aa, Flavivirus
TLWHTTKGA

SEQ ID NO: 249419 - protein, 9 aa, Flavivirus
TAVLAPTRV

SEQ ID NO: 249420 - protein, 9 aa, Flavivirus
AVLAPTRVV

SEQ ID NO: 249421 - protein, 9 aa, Flavivirus
VLAPTRVVA

SEQ ID NO: 249422 - protein, 9 aa, Flavivirus
VMDEAHFTD

SEQ ID NO: 249423 - protein, 9 aa, Flavivirus
MDEAHWTDP

SEQ ID NO: 249424 - protein, 9 aa, Flavivirus
VLMTATPPG

SEQ ID NO: 249425 - protein, 9 aa, Flavivirus
GKTVWFVAS

SEQ ID NO: 249426 - protein, 9 aa, Flavivirus
WDYVVTTDI

SEQ ID NO: 249427 - protein, 9 aa, Flavivirus
DYVVTTDIS

SEQ ID NO: 249428 - protein, 9 aa, Flavivirus
YVVTTDISE

SEQ ID NO: 249429 - protein, 9 aa, Flavivirus
VITTDISEM

SEQ ID NO: 249430 - protein, 9 aa, Flavivirus
ITTDISEMG

SEQ ID NO: 249431 - protein, 9 aa, Flavivirus
ATDIAEMGA

SEQ ID NO: 249432 - protein, 9 aa, Flavivirus
TDIAEMGAN

SEQ ID NO: 249433 - protein, 9 aa, Flavivirus
DISEMGANL

SEQ ID NO: 249434 - protein, 9 aa, Flavivirus
SSAAQRRGR

SEQ ID NO: 249435 - protein, 9 aa, Flavivirus
SAAQRRGRV

SEQ ID NO: 249436 - protein, 9 aa, Flavivirus
AAQRRGRVG

SEQ ID NO: 249437 - protein, 9 aa, Flavivirus
AQRRGRVGR

SEQ ID NO: 249438 - protein, 9 aa, Flavivirus
VVDLGCGRG

SEQ ID NO: 249439 - protein, 9 aa, Flavivirus
VDLGCGRGG

SEQ ID NO: 249440 - protein, 9 aa, Flavivirus
LGCGRGGWC

SEQ ID NO: 249441 - protein, 9 aa, Flavivirus
GCGRGGWCY

SEQ ID NO: 249442 - protein, 9 aa, Flavivirus
CGRGGWCYY

SEQ ID NO: 249443 - protein, 9 aa, Flavivirus
TLFCDIGES

SEQ ID NO: 249444 - protein, 9 aa, Flavivirus
PLSRNSNHE

SEQ ID NO: 249445 - protein, 9 aa, Flavivirus
LSRNSNHEM

SEQ ID NO: 249446 - protein, 9 aa, Flavivirus
SRNSNHEMY

SEQ ID NO: 249447 - protein, 9 aa, Flavivirus
RNSTHEMYY

SEQ ID NO: 249448 - protein, 9 aa, Flavivirus
IAMTDTTPF

SEQ ID NO: 249449 - protein, 9 aa, Flavivirus
AMTDTTAFG

SEQ ID NO: 249450 - protein, 9 aa, Flavivirus
MTDTTAFGQ

SEQ ID NO: 249451 - protein, 9 aa, Flavivirus
TDTTAFGQQ

SEQ ID NO: 249452 - protein, 9 aa, Flavivirus
DTTAFGQQR

SEQ ID NO: 249453 - protein, 9 aa, Flavivirus
TTAFGQQRV

SEQ ID NO: 249454 - protein, 9 aa, Flavivirus
TAFGQQRVF

SEQ ID NO: 249455 - protein, 9 aa, Flavivirus
AFGQQRVFK

SEQ ID NO: 249456 - protein, 9 aa, Flavivirus
FGQQRVFKD

SEQ ID NO: 249457 - protein, 9 aa, Flavivirus
GQQRVFKDK

SEQ ID NO: 249458 - protein, 9 aa, Flavivirus
QQRVFKDKV

SEQ ID NO: 249459 - protein, 9 aa, Flavivirus
QRVFKDKVD

SEQ ID NO: 249460 - protein, 9 aa, Flavivirus
RVFKDKVDT

SEQ ID NO: 249461 - protein, 9 aa, Flavivirus
VFKEKVDTK

SEQ ID NO: 249462 - protein, 9 aa, Flavivirus
FKEKVDTKA

SEQ ID NO: 249463 - protein, 9 aa, Flavivirus
CIYNMMGKR

SEQ ID NO: 249464 - protein, 9 aa, Flavivirus
IYNMMGKRE

SEQ ID NO: 249465 - protein, 9 aa, Flavivirus
MMGKREKKP

SEQ ID NO: 249466 - protein, 9 aa, Flavivirus
GEFGRAKGS

SEQ ID NO: 249467 - protein, 9 aa, Flavivirus
EFGRAKGSR

SEQ ID NO: 249468 - protein, 9 aa, Flavivirus
FGRAKGSRA

SEQ ID NO: 249469 - protein, 9 aa, Flavivirus
GRAKGSRAI

SEQ ID NO: 249470 - protein, 9 aa, Flavivirus
RAKGSRAIW

SEQ ID NO: 249471 - protein, 9 aa, Flavivirus
AKGSRAIWF

SEQ ID NO: 249472 - protein, 9 aa, Flavivirus
KGSRAIWFM

SEQ ID NO: 249473 - protein, 9 aa, Flavivirus
GSRAIWFMW

SEQ ID NO: 249474 - protein, 9 aa, Flavivirus
SRAIWFMWL

SEQ ID NO: 249475 - protein, 9 aa, Flavivirus
RAIWFMWLG

SEQ ID NO: 249476 - protein, 9 aa, Flavivirus
AIWFMWLGA

SEQ ID NO: 249477 - protein, 9 aa, Flavivirus
IWFMWLGAR

SEQ ID NO: 249478 - protein, 9 aa, Flavivirus
WYMWLGARY

SEQ ID NO: 249479 - protein, 9 aa, Flavivirus
YMWLGARYL

SEQ ID NO: 249480 - protein, 9 aa, Flavivirus
MWLGARYLE

SEQ ID NO: 249481 - protein, 9 aa, Flavivirus
WLGARYLEF

SEQ ID NO: 249482 - protein, 9 aa, Flavivirus
LGARYLEFE

SEQ ID NO: 249483 - protein, 9 aa, Flavivirus
GARYLEFEA

SEQ ID NO: 249484 - protein, 9 aa, Flavivirus
ARYLEFEAL

SEQ ID NO: 249485 - protein, 9 aa, Flavivirus
RYLEFEALG

SEQ ID NO: 249486 - protein, 9 aa, Flavivirus
YLEFEALGF

SEQ ID NO: 249487 - protein, 9 aa, Flavivirus
LEFEALGFM

SEQ ID NO: 249488 - protein, 9 aa, Flavivirus
EFEALGFMN

SEQ ID NO: 249489 - protein, 9 aa, Flavivirus
FEALGFMNE

SEQ ID NO: 249490 - protein, 9 aa, Flavivirus
EALGFMNED

SEQ ID NO: 249491 - protein, 9 aa, Flavivirus
ALGFMNEDH

SEQ ID NO: 249492 - protein, 9 aa, Flavivirus
LGFMNEDHW

SEQ ID NO: 249493 - protein, 9 aa, Flavivirus
IYADDTAGW

SEQ ID NO: 249494 - protein, 9 aa, Flavivirus
DDTAGWDTK

SEQ ID NO: 249495 - protein, 9 aa, Flavivirus
DTAGWDTKV

SEQ ID NO: 249496 - protein, 9 aa, Flavivirus
TAGWDTKVT

SEQ ID NO: 249497 - protein, 9 aa, Flavivirus
QRGSGQVVT

SEQ ID NO: 249498 - protein, 9 aa, Flavivirus
RGSGQVVTY

SEQ ID NO: 249499 - protein, 9 aa, Flavivirus
GSGQVVTYA

SEQ ID NO: 249500 - protein, 9 aa, Flavivirus
SGQVVTYAL

SEQ ID NO: 249501 - protein, 9 aa, Flavivirus
GQVVTYALN

SEQ ID NO: 249502 - protein, 9 aa, Flavivirus
QVVTYALNT

SEQ ID NO: 249503 - protein, 9 aa, Flavivirus
QDELVGRAR

SEQ ID NO: 249504 - protein, 9 aa, Flavivirus
DELVGRARV

SEQ ID NO: 249505 - protein, 9 aa, Flavivirus
ELVGRARVS

SEQ ID NO: 249506 - protein, 9 aa, Flavivirus
LLYFHRRDL

SEQ ID NO: 249507 - protein, 9 aa, Flavivirus
LYFHRRDLR

SEQ ID NO: 249508 - protein, 9 aa, Flavivirus
YFHRRDLRT

SEQ ID NO: 249509 - protein, 9 aa, Flavivirus
FHRRDLRLM

SEQ ID NO: 249510 - protein, 9 aa, Flavivirus
SDRGWGNHC

SEQ ID NO: 249511 - protein, 9 aa, Flavivirus
HCGLFGKGS

SEQ ID NO: 249512 - protein, 9 aa, Flavivirus
CGLFGKGSI

SEQ ID NO: 249513 - protein, 9 aa, Flavivirus
VFHTLWHTT

SEQ ID NO: 249514 - protein, 9 aa, Flavivirus
HTLWHTTRG

SEQ ID NO: 249515 - protein, 9 aa, Flavivirus
TMWHVTRGS

SEQ ID NO: 249516 - protein, 9 aa, Flavivirus
TLVLAPTRV

SEQ ID NO: 249517 - protein, 9 aa, Flavivirus
LVLAPTRVV

SEQ ID NO: 249518 - protein, 9 aa, Flavivirus
VLAPTRVVL

SEQ ID NO: 249519 - protein, 9 aa, Flavivirus
IMDEAHWTD

SEQ ID NO: 249520 - protein, 9 aa, Flavivirus
MDEAHFLDP

SEQ ID NO: 249521 - protein, 9 aa, Flavivirus
ILMTATPPG

SEQ ID NO: 249522 - protein, 9 aa, Flavivirus
GRTAWFVPS

SEQ ID NO: 249523 - protein, 9 aa, Flavivirus
WDFVITTDI

SEQ ID NO: 249524 - protein, 9 aa, Flavivirus
DFVITTDIS

SEQ ID NO: 249525 - protein, 9 aa, Flavivirus
FVITTDISE

SEQ ID NO: 249526 - protein, 9 aa, Flavivirus
ILATDIAEM

SEQ ID NO: 249527 - protein, 9 aa, Flavivirus
LATDIAEMG

SEQ ID NO: 249528 - protein, 9 aa, Flavivirus
DIAEMGANL

SEQ ID NO: 249529 - protein, 9 aa, Flavivirus
VMDLGCGRG

SEQ ID NO: 249530 - protein, 9 aa, Flavivirus
MDLGCGRGG

SEQ ID NO: 249531 - protein, 9 aa, Flavivirus
TIMCDIGES

SEQ ID NO: 249532 - protein, 9 aa, Flavivirus
PFSRNSTHE

SEQ ID NO: 249533 - protein, 9 aa, Flavivirus
FSRNSTHEM

SEQ ID NO: 249534 - protein, 9 aa, Flavivirus
RNSNHEMYW

SEQ ID NO: 249535 - protein, 9 aa, Flavivirus
LAMTDTTPF

SEQ ID NO: 249536 - protein, 9 aa, Flavivirus
VFKDKVDTK

SEQ ID NO: 249537 - protein, 9 aa, Flavivirus
FKEKVDTRA

SEQ ID NO: 249538 - protein, 9 aa, Flavivirus
MMGKREKKT

SEQ ID NO: 249539 - protein, 9 aa, Flavivirus
GEFGVAKGS

SEQ ID NO: 249540 - protein, 9 aa, Flavivirus
EFGVAKGSR

SEQ ID NO: 249541 - protein, 9 aa, Flavivirus
FGVAKGSRA

SEQ ID NO: 249542 - protein, 9 aa, Flavivirus
GVAKGSRAI

SEQ ID NO: 249543 - protein, 9 aa, Flavivirus
VAKGSRAIW

SEQ ID NO: 249544 - protein, 9 aa, Flavivirus
AIWYMWLGS

SEQ ID NO: 249545 - protein, 9 aa, Flavivirus
IWYMWLGSR

SEQ ID NO: 249546 - protein, 9 aa, Flavivirus
WFMWLGARF

SEQ ID NO: 249547 - protein, 9 aa, Flavivirus
FMWLGARFL

SEQ ID NO: 249548 - protein, 9 aa, Flavivirus
MWLGSRFLE

SEQ ID NO: 249549 - protein, 9 aa, Flavivirus
WLGSRFLEF

SEQ ID NO: 249550 - protein, 9 aa, Flavivirus
LGSRFLEFE

SEQ ID NO: 249551 - protein, 9 aa, Flavivirus
GSRFLEFEA

SEQ ID NO: 249552 - protein, 9 aa, Flavivirus
SRFLEFEAL

SEQ ID NO: 249553 - protein, 9 aa, Flavivirus
FYADDTAGW

SEQ ID NO: 249554 - protein, 9 aa, Flavivirus
DTAGWDTRV

SEQ ID NO: 249555 - protein, 9 aa, Flavivirus
TAGWDTRVT

SEQ ID NO: 249556 - protein, 9 aa, Flavivirus
GSGQVVTYG

SEQ ID NO: 249557 - protein, 9 aa, Flavivirus
SGQVVTYGL

SEQ ID NO: 249558 - protein, 9 aa, Flavivirus
GQVVTYGLN

SEQ ID NO: 249559 - protein, 9 aa, Flavivirus
QVVTYGLNT

SEQ ID NO: 249560 - protein, 9 aa, Flavivirus
QDELIGRGR

SEQ ID NO: 249561 - protein, 9 aa, Flavivirus
DELVGRARI

SEQ ID NO: 249562 - protein, 9 aa, Flavivirus
ELVGRARIS

SEQ ID NO: 249563 - protein, 9 aa, Flavivirus
LSYFHRRDL

SEQ ID NO: 249564 - protein, 9 aa, Flavivirus
SYFHRRDLR

SEQ ID NO: 249565 - protein, 9 aa, Flavivirus
YFHKRDMRL

SEQ ID NO: 249566 - protein, 9 aa, Flavivirus
FHRRDLRTL

SEQ ID NO: 249567 - protein, 9 aa, Flavivirus
SDRGWGNGC

SEQ ID NO: 249568 - protein, 9 aa, Flavivirus
CGLFGKGGV

SEQ ID NO: 249569 - protein, 9 aa, Flavivirus
VLHTMWHVT

SEQ ID NO: 249570 - protein, 9 aa, Flavivirus
HTMWHVTKG

SEQ ID NO: 249571 - protein, 9 aa, Flavivirus
TLWHTTRGA

SEQ ID NO: 249572 - protein, 9 aa, Flavivirus
TVILAPTRV

SEQ ID NO: 249573 - protein, 9 aa, Flavivirus
VILAPTRVV

SEQ ID NO: 249574 - protein, 9 aa, Flavivirus
IMDEAHFLD

SEQ ID NO: 249575 - protein, 9 aa, Flavivirus
MDEGHWTDP

SEQ ID NO: 249576 - protein, 9 aa, Flavivirus
RPTAWFLPS

SEQ ID NO: 249577 - protein, 9 aa, Flavivirus
PDFVVTTDI

SEQ ID NO: 249578 - protein, 9 aa, Flavivirus
DFILATDIA

SEQ ID NO: 249579 - protein, 9 aa, Flavivirus
FILATDIAE

SEQ ID NO: 249580 - protein, 9 aa, Flavivirus
TILCDIGES

SEQ ID NO: 249581 - protein, 9 aa, Flavivirus
RNSTHEMYF

SEQ ID NO: 249582 - protein, 9 aa, Flavivirus
MAMTDTTAF

SEQ ID NO: 249583 - protein, 9 aa, Flavivirus
FKDKVDTKA

SEQ ID NO: 249584 - protein, 9 aa, Flavivirus
MMGKREKKI

SEQ ID NO: 249585 - protein, 9 aa, Flavivirus
SEFGKAKGS

SEQ ID NO: 249586 - protein, 9 aa, Flavivirus
WYMWLGSRF

SEQ ID NO: 249587 - protein, 9 aa, Flavivirus
YMWLGSRFL

SEQ ID NO: 249588 - protein, 9 aa, Flavivirus
LYADDTAGW

SEQ ID NO: 249589 - protein, 9 aa, Flavivirus
TAGWDTKIT

SEQ ID NO: 249590 - protein, 9 aa, Flavivirus
DELIGRGRV

SEQ ID NO: 249591 - protein, 9 aa, Flavivirus
ELIGRGRVS

SEQ ID NO: 249592 - protein, 9 aa, Flavivirus
LMYFHKRDM

SEQ ID NO: 249593 - protein, 9 aa, Flavivirus
MYFHKRDMR

SEQ ID NO: 249594 - protein, 9 aa, Flavivirus
YFHRRDLRV

SEQ ID NO: 249595 - protein, 9 aa, Flavivirus
FHKRDMRLL

SEQ ID NO: 249596 - protein, 9 aa, Flavivirus
CGFFGKGSI

SEQ ID NO: 249597 - protein, 9 aa, Flavivirus
TMWHATEGA

SEQ ID NO: 249598 - protein, 9 aa, Flavivirus
TAILAPTRV

SEQ ID NO: 249599 - protein, 9 aa, Flavivirus
VVLAPTRVV

SEQ ID NO: 249600 - protein, 9 aa, Flavivirus
IMDEAHFMD

SEQ ID NO: 249601 - protein, 9 aa, Flavivirus
GRTVWFVPS

SEQ ID NO: 249602 - protein, 9 aa, Flavivirus
PDFILATDI

SEQ ID NO: 249603 - protein, 9 aa, Flavivirus
TVMCDIGES

SEQ ID NO: 249604 - protein, 9 aa, Flavivirus
FLMTDVSTY

SEQ ID NO: 249605 - protein, 9 aa, Flavivirus
TMGKKEKKP

SEQ ID NO: 249606 - protein, 9 aa, Flavivirus
AEFGKAKGS

SEQ ID NO: 249607 - protein, 9 aa, Flavivirus
WFMWLGARY

SEQ ID NO: 249608 - protein, 9 aa, Flavivirus
FMWLGARYL

SEQ ID NO: 249609 - protein, 9 aa, Flavivirus
DELIGRARV

SEQ ID NO: 249610 - protein, 9 aa, Flavivirus
ELIGRARVS

SEQ ID NO: 249611 - protein, 9 aa, Flavivirus
LNYFHRRDL

SEQ ID NO: 249612 - protein, 9 aa, Flavivirus
NYFHRRDLR

SEQ ID NO: 249613 - protein, 9 aa, Flavivirus
FHRRDLRVM

SEQ ID NO: 249614 - protein, 10 aa, Flavivirus
VDRGWGNGCG

SEQ ID NO: 249615 - protein, 10 aa, Flavivirus
DRGWGNGCGL

SEQ ID NO: 249616 - protein, 10 aa, Flavivirus
RGWGNGCGLF

SEQ ID NO: 249617 - protein, 10 aa, Flavivirus
GWGNGCGLFG

SEQ ID NO: 249618 - protein, 10 aa, Flavivirus
WGNGCGLFGK

SEQ ID NO: 249619 - protein, 10 aa, Flavivirus
GNGCGLFGKG

SEQ ID NO: 249620 - protein, 10 aa, Flavivirus
NGCGLFGKGS

SEQ ID NO: 249621 - protein, 10 aa, Flavivirus
HTMWHVTRGA

SEQ ID NO: 249622 - protein, 10 aa, Flavivirus
TLILAPTRVV

SEQ ID NO: 249623 - protein, 10 aa, Flavivirus
IMDEAHFTDP

SEQ ID NO: 249624 - protein, 10 aa, Flavivirus
WDFVVTTDIS

SEQ ID NO: 249625 - protein, 10 aa, Flavivirus
DFVVTTDISE

SEQ ID NO: 249626 - protein, 10 aa, Flavivirus
FVVTTDISEM

SEQ ID NO: 249627 - protein, 10 aa, Flavivirus
VVTTDISEMG

SEQ ID NO: 249628 - protein, 10 aa, Flavivirus
VTTDISEMGA

SEQ ID NO: 249629 - protein, 10 aa, Flavivirus
TTDISEMGAN

SEQ ID NO: 249630 - protein, 10 aa, Flavivirus
TDISEMGANF

SEQ ID NO: 249631 - protein, 10 aa, Flavivirus
ASAAQRRGRI

SEQ ID NO: 249632 - protein, 10 aa, Flavivirus
SAAQRRGRIG

SEQ ID NO: 249633 - protein, 10 aa, Flavivirus
AAQRRGRIGR

SEQ ID NO: 249634 - protein, 10 aa, Flavivirus
VIDLGCGRGG

SEQ ID NO: 249635 - protein, 10 aa, Flavivirus
IDLGCGRGGW

SEQ ID NO: 249636 - protein, 10 aa, Flavivirus
DLGCGRGGWS

SEQ ID NO: 249637 - protein, 10 aa, Flavivirus
LGCGRGGWSY

SEQ ID NO: 249638 - protein, 10 aa, Flavivirus
GCGRGGWSYY

SEQ ID NO: 249639 - protein, 10 aa, Flavivirus
PLSRNSTHEM

SEQ ID NO: 249640 - protein, 10 aa, Flavivirus
LSRNSTHEMY

SEQ ID NO: 249641 - protein, 10 aa, Flavivirus
SRNSTHEMYW

SEQ ID NO: 249642 - protein, 10 aa, Flavivirus
MAMTDTTPFG

SEQ ID NO: 249643 - protein, 10 aa, Flavivirus
AMTDTTPFGQ

SEQ ID NO: 249644 - protein, 10 aa, Flavivirus
MTDTTPFGQQ

SEQ ID NO: 249645 - protein, 10 aa, Flavivirus
TDTTPFGQQR

SEQ ID NO: 249646 - protein, 10 aa, Flavivirus
DTTPFGQQRV

SEQ ID NO: 249647 - protein, 10 aa, Flavivirus
TTPFGQQRVF

SEQ ID NO: 249648 - protein, 10 aa, Flavivirus
TPFGQQRVFK

SEQ ID NO: 249649 - protein, 10 aa, Flavivirus
PFGQQRVFKE

SEQ ID NO: 249650 - protein, 10 aa, Flavivirus
FGQQRVFKEK

SEQ ID NO: 249651 - protein, 10 aa, Flavivirus
GQQRVFKEKV

SEQ ID NO: 249652 - protein, 10 aa, Flavivirus
QQRVFKEKVD

SEQ ID NO: 249653 - protein, 10 aa, Flavivirus
QRVFKEKVDT

SEQ ID NO: 249654 - protein, 10 aa, Flavivirus
RVFKEKVDTR

SEQ ID NO: 249655 - protein, 10 aa, Flavivirus
VFKEKVDTRT

SEQ ID NO: 249656 - protein, 10 aa, Flavivirus
CVYNMMGKRE

SEQ ID NO: 249657 - protein, 10 aa, Flavivirus
VYNMMGKREK

SEQ ID NO: 249658 - protein, 10 aa, Flavivirus
YNMMGKREKK

SEQ ID NO: 249659 - protein, 10 aa, Flavivirus
NMMGKREKKL

SEQ ID NO: 249660 - protein, 10 aa, Flavivirus
GEFGKAKGSR

SEQ ID NO: 249661 - protein, 10 aa, Flavivirus
EFGKAKGSRA

SEQ ID NO: 249662 - protein, 10 aa, Flavivirus
FGKAKGSRAI

SEQ ID NO: 249663 - protein, 10 aa, Flavivirus
GKAKGSRAIW

SEQ ID NO: 249664 - protein, 10 aa, Flavivirus
KAKGSRAIWY

SEQ ID NO: 249665 - protein, 10 aa, Flavivirus
AKGSRAIWYM

SEQ ID NO: 249666 - protein, 10 aa, Flavivirus
KGSRAIWYMW

SEQ ID NO: 249667 - protein, 10 aa, Flavivirus
GSRAIWYMWL

SEQ ID NO: 249668 - protein, 10 aa, Flavivirus
SRAIWYMWLG

SEQ ID NO: 249669 - protein, 10 aa, Flavivirus
RAIWYMWLGA

SEQ ID NO: 249670 - protein, 10 aa, Flavivirus
AIWYMWLGAR

SEQ ID NO: 249671 - protein, 10 aa, Flavivirus
IWYMWLGARF

SEQ ID NO: 249672 - protein, 10 aa, Flavivirus
WYMWLGARFL

SEQ ID NO: 249673 - protein, 10 aa, Flavivirus
YMWLGARFLE

SEQ ID NO: 249674 - protein, 10 aa, Flavivirus
MWLGARFLEF

SEQ ID NO: 249675 - protein, 10 aa, Flavivirus
WLGARFLEFE

SEQ ID NO: 249676 - protein, 10 aa, Flavivirus
LGARFLEFEA

SEQ ID NO: 249677 - protein, 10 aa, Flavivirus
GARFLEFEAL

SEQ ID NO: 249678 - protein, 10 aa, Flavivirus
ARFLEFEALG

SEQ ID NO: 249679 - protein, 10 aa, Flavivirus
RFLEFEALGF

SEQ ID NO: 249680 - protein, 10 aa, Flavivirus
FLEFEALGFL

SEQ ID NO: 249681 - protein, 10 aa, Flavivirus
LEFEALGFLN

SEQ ID NO: 249682 - protein, 10 aa, Flavivirus
EFEALGFLNE

SEQ ID NO: 249683 - protein, 10 aa, Flavivirus
FEALGFLNED

SEQ ID NO: 249684 - protein, 10 aa, Flavivirus
EALGFLNEDH

SEQ ID NO: 249685 - protein, 10 aa, Flavivirus
ALGFLNEDHW

SEQ ID NO: 249686 - protein, 10 aa, Flavivirus
MYADDTAGWD

SEQ ID NO: 249687 - protein, 10 aa, Flavivirus
YADDTAGWDT

SEQ ID NO: 249688 - protein, 10 aa, Flavivirus
ADDTAGWDTR

SEQ ID NO: 249689 - protein, 10 aa, Flavivirus
DDTAGWDTRI

SEQ ID NO: 249690 - protein, 10 aa, Flavivirus
DTAGWDTRIT

SEQ ID NO: 249691 - protein, 10 aa, Flavivirus
QRGSGQVGTY

SEQ ID NO: 249692 - protein, 10 aa, Flavivirus
RGSGQVGTYG

SEQ ID NO: 249693 - protein, 10 aa, Flavivirus
GSGQVGTYGL

SEQ ID NO: 249694 - protein, 10 aa, Flavivirus
SGQVGTYGLN

SEQ ID NO: 249695 - protein, 10 aa, Flavivirus
GQVGTYGLNT

SEQ ID NO: 249696 - protein, 10 aa, Flavivirus
QDELIGRARI

SEQ ID NO: 249697 - protein, 10 aa, Flavivirus
LMYFHRRDLR

SEQ ID NO: 249698 - protein, 10 aa, Flavivirus
YFHRRDLRLA

SEQ ID NO: 249699 - protein, 10 aa, Flavivirus
TDRGWGNGCG

SEQ ID NO: 249700 - protein, 10 aa, Flavivirus
DRGWGNHCGL

SEQ ID NO: 249701 - protein, 10 aa, Flavivirus
RGWGNHCGLF

SEQ ID NO: 249702 - protein, 10 aa, Flavivirus
GWGNHCGLFG

SEQ ID NO: 249703 - protein, 10 aa, Flavivirus
WGNHCGLFGK

SEQ ID NO: 249704 - protein, 10 aa, Flavivirus
GNHCGLFGKG

SEQ ID NO: 249705 - protein, 10 aa, Flavivirus
NGCGLFGKGG

SEQ ID NO: 249706 - protein, 10 aa, Flavivirus
HTLWHTTKGA

SEQ ID NO: 249707 - protein, 10 aa, Flavivirus
TAVLAPTRVV

SEQ ID NO: 249708 - protein, 10 aa, Flavivirus
VMDEAHFTDP

SEQ ID NO: 249709 - protein, 10 aa, Flavivirus
WDYVVTTDIS

SEQ ID NO: 249710 - protein, 10 aa, Flavivirus
DYVVTTDISE

SEQ ID NO: 249711 - protein, 10 aa, Flavivirus
YVVTTDISEM

SEQ ID NO: 249712 - protein, 10 aa, Flavivirus
VITTDISEMG

SEQ ID NO: 249713 - protein, 10 aa, Flavivirus
ITTDISEMGA

SEQ ID NO: 249714 - protein, 10 aa, Flavivirus
ATDIAEMGAN

SEQ ID NO: 249715 - protein, 10 aa, Flavivirus
TDISEMGANL

SEQ ID NO: 249716 - protein, 10 aa, Flavivirus
SSAAQRRGRI

SEQ ID NO: 249717 - protein, 10 aa, Flavivirus
SAAQRRGRVG

SEQ ID NO: 249718 - protein, 10 aa, Flavivirus
AAQRRGRVGR

SEQ ID NO: 249719 - protein, 10 aa, Flavivirus
VVDLGCGRGG

SEQ ID NO: 249720 - protein, 10 aa, Flavivirus
VDLGCGRGGW

SEQ ID NO: 249721 - protein, 10 aa, Flavivirus
DLGCGRGGWC

SEQ ID NO: 249722 - protein, 10 aa, Flavivirus
LGCGRGGWCY

SEQ ID NO: 249723 - protein, 10 aa, Flavivirus
GCGRGGWCYY

SEQ ID NO: 249724 - protein, 10 aa, Flavivirus
PLSRNSNHEM

SEQ ID NO: 249725 - protein, 10 aa, Flavivirus
LSRNSNHEMY

SEQ ID NO: 249726 - protein, 10 aa, Flavivirus
SRNSTHEMYY

SEQ ID NO: 249727 - protein, 10 aa, Flavivirus
IAMTDTTPFG

SEQ ID NO: 249728 - protein, 10 aa, Flavivirus
AMTDTTAFGQ

SEQ ID NO: 249729 - protein, 10 aa, Flavivirus
MTDTTAFGQQ

SEQ ID NO: 249730 - protein, 10 aa, Flavivirus
TDTTAFGQQR

SEQ ID NO: 249731 - protein, 10 aa, Flavivirus
DTTAFGQQRV

SEQ ID NO: 249732 - protein, 10 aa, Flavivirus
TTAFGQQRVF

SEQ ID NO: 249733 - protein, 10 aa, Flavivirus
TAFGQQRVFK

SEQ ID NO: 249734 - protein, 10 aa, Flavivirus
AFGQQRVFKE

SEQ ID NO: 249735 - protein, 10 aa, Flavivirus
FGQQRVFKDK

SEQ ID NO: 249736 - protein, 10 aa, Flavivirus
GQQRVFKDKV

SEQ ID NO: 249737 - protein, 10 aa, Flavivirus
QQRVFKDKVD

SEQ ID NO: 249738 - protein, 10 aa, Flavivirus
QRVFKDKVDT

SEQ ID NO: 249739 - protein, 10 aa, Flavivirus
RVFKEKVDTK

SEQ ID NO: 249740 - protein, 10 aa, Flavivirus
VFKEKVDTKA

SEQ ID NO: 249741 - protein, 10 aa, Flavivirus
CIYNMMGKRE

SEQ ID NO: 249742 - protein, 10 aa, Flavivirus
IYNMMGKREK

SEQ ID NO: 249743 - protein, 10 aa, Flavivirus
NMMGKREKKP

SEQ ID NO: 249744 - protein, 10 aa, Flavivirus
GEFGRAKGSR

SEQ ID NO: 249745 - protein, 10 aa, Flavivirus
EFGRAKGSRA

SEQ ID NO: 249746 - protein, 10 aa, Flavivirus
FGRAKGSRAI

SEQ ID NO: 249747 - protein, 10 aa, Flavivirus
GRAKGSRAIW

SEQ ID NO: 249748 - protein, 10 aa, Flavivirus
KAKGSRAIWF

SEQ ID NO: 249749 - protein, 10 aa, Flavivirus
AKGSRAIWFM

SEQ ID NO: 249750 - protein, 10 aa, Flavivirus
KGSRAIWFMW

SEQ ID NO: 249751 - protein, 10 aa, Flavivirus
GSRAIWFMWL

SEQ ID NO: 249752 - protein, 10 aa, Flavivirus
SRAIWFMWLG

SEQ ID NO: 249753 - protein, 10 aa, Flavivirus
RAIWFMWLGA

SEQ ID NO: 249754 - protein, 10 aa, Flavivirus
AIWFMWLGAR

SEQ ID NO: 249755 - protein, 10 aa, Flavivirus
IWYMWLGARY

SEQ ID NO: 249756 - protein, 10 aa, Flavivirus
WYMWLGARYL

SEQ ID NO: 249757 - protein, 10 aa, Flavivirus
YMWLGARYLE

SEQ ID NO: 249758 - protein, 10 aa, Flavivirus
MWLGARYLEF

SEQ ID NO: 249759 - protein, 10 aa, Flavivirus
WLGARYLEFE

SEQ ID NO: 249760 - protein, 10 aa, Flavivirus
LGARYLEFEA

SEQ ID NO: 249761 - protein, 10 aa, Flavivirus
GARYLEFEAL

SEQ ID NO: 249762 - protein, 10 aa, Flavivirus
ARYLEFEALG

SEQ ID NO: 249763 - protein, 10 aa, Flavivirus
RYLEFEALGF

SEQ ID NO: 249764 - protein, 10 aa, Flavivirus
FLEFEALGFM

SEQ ID NO: 249765 - protein, 10 aa, Flavivirus
LEFEALGFMN

SEQ ID NO: 249766 - protein, 10 aa, Flavivirus
EFEALGFMNE

SEQ ID NO: 249767 - protein, 10 aa, Flavivirus
FEALGFMNED

SEQ ID NO: 249768 - protein, 10 aa, Flavivirus
EALGFMNEDH

SEQ ID NO: 249769 - protein, 10 aa, Flavivirus
ALGFMNEDHW

SEQ ID NO: 249770 - protein, 10 aa, Flavivirus
IYADDTAGWD

SEQ ID NO: 249771 - protein, 10 aa, Flavivirus
ADDTAGWDTK

SEQ ID NO: 249772 - protein, 10 aa, Flavivirus
DDTAGWDTKV

SEQ ID NO: 249773 - protein, 10 aa, Flavivirus
DTAGWDTKVT

SEQ ID NO: 249774 - protein, 10 aa, Flavivirus
QRGSGQVVTY

SEQ ID NO: 249775 - protein, 10 aa, Flavivirus
RGSGQVVTYA

SEQ ID NO: 249776 - protein, 10 aa, Flavivirus
GSGQVVTYAL

SEQ ID NO: 249777 - protein, 10 aa, Flavivirus
SGQVVTYALN

SEQ ID NO: 249778 - protein, 10 aa, Flavivirus
GQVVTYALNT

SEQ ID NO: 249779 - protein, 10 aa, Flavivirus
QDELVGRARV

SEQ ID NO: 249780 - protein, 10 aa, Flavivirus
LLYFHRRDLR

SEQ ID NO: 249781 - protein, 10 aa, Flavivirus
YFHRRDLRLM

SEQ ID NO: 249782 - protein, 10 aa, Flavivirus
SDRGWGNHCG

SEQ ID NO: 249783 - protein, 10 aa, Flavivirus
NHCGLFGKGS

SEQ ID NO: 249784 - protein, 10 aa, Flavivirus
HTMWHVTRGS

SEQ ID NO: 249785 - protein, 10 aa, Flavivirus
TLVLAPTRVV

SEQ ID NO: 249786 - protein, 10 aa, Flavivirus
IMDEAHWTDP

SEQ ID NO: 249787 - protein, 10 aa, Flavivirus
WDFVITTDIS

SEQ ID NO: 249788 - protein, 10 aa, Flavivirus
DFVITTDISE

SEQ ID NO: 249789 - protein, 10 aa, Flavivirus
FVITTDISEM

SEQ ID NO: 249790 - protein, 10 aa, Flavivirus
ILATDIAEMG

SEQ ID NO: 249791 - protein, 10 aa, Flavivirus
LATDIAEMGA

SEQ ID NO: 249792 - protein, 10 aa, Flavivirus
TDIAEMGANL

SEQ ID NO: 249793 - protein, 10 aa, Flavivirus
ASAAQRRGRV

SEQ ID NO: 249794 - protein, 10 aa, Flavivirus
VMDLGCGRGG

SEQ ID NO: 249795 - protein, 10 aa, Flavivirus
MDLGCGRGGW

SEQ ID NO: 249796 - protein, 10 aa, Flavivirus
PFSRNSTHEM

SEQ ID NO: 249797 - protein, 10 aa, Flavivirus
FSRNSTHEMY

SEQ ID NO: 249798 - protein, 10 aa, Flavivirus
SRNSNHEMYW

SEQ ID NO: 249799 - protein, 10 aa, Flavivirus
LAMTDTTPFG

SEQ ID NO: 249800 - protein, 10 aa, Flavivirus
SMTDTTPFGQ

SEQ ID NO: 249801 - protein, 10 aa, Flavivirus
AFGQQRVFKD

SEQ ID NO: 249802 - protein, 10 aa, Flavivirus
RVFKDKVDTK

SEQ ID NO: 249803 - protein, 10 aa, Flavivirus
VFKEKVDTRA

SEQ ID NO: 249804 - protein, 10 aa, Flavivirus
NMMGKREKKT

SEQ ID NO: 249805 - protein, 10 aa, Flavivirus
GEFGVAKGSR

SEQ ID NO: 249806 - protein, 10 aa, Flavivirus
EFGVAKGSRA

SEQ ID NO: 249807 - protein, 10 aa, Flavivirus
FGVAKGSRAI

SEQ ID NO: 249808 - protein, 10 aa, Flavivirus
GVAKGSRAIW

SEQ ID NO: 249809 - protein, 10 aa, Flavivirus
RAKGSRAIWY

SEQ ID NO: 249810 - protein, 10 aa, Flavivirus
RAIWYMWLGS

SEQ ID NO: 249811 - protein, 10 aa, Flavivirus
AIWYMWLGSR

SEQ ID NO: 249812 - protein, 10 aa, Flavivirus
IWFMWLGARF

SEQ ID NO: 249813 - protein, 10 aa, Flavivirus
WFMWLGARFL

SEQ ID NO: 249814 - protein, 10 aa, Flavivirus
FMWLGARFLE

SEQ ID NO: 249815 - protein, 10 aa, Flavivirus
MWLGSRFLEF

SEQ ID NO: 249816 - protein, 10 aa, Flavivirus
WLGSRFLEFE

SEQ ID NO: 249817 - protein, 10 aa, Flavivirus
LGSRFLEFEA

SEQ ID NO: 249818 - protein, 10 aa, Flavivirus
GSRFLEFEAL

SEQ ID NO: 249819 - protein, 10 aa, Flavivirus
SRFLEFEALG

SEQ ID NO: 249820 - protein, 10 aa, Flavivirus
YLEFEALGFL

SEQ ID NO: 249821 - protein, 10 aa, Flavivirus
FYADDTAGWD

SEQ ID NO: 249822 - protein, 10 aa, Flavivirus
DDTAGWDTRV

SEQ ID NO: 249823 - protein, 10 aa, Flavivirus
DTAGWDTRVT

SEQ ID NO: 249824 - protein, 10 aa, Flavivirus
RGSGQVVTYG

SEQ ID NO: 249825 - protein, 10 aa, Flavivirus
GSGQVVTYGL

SEQ ID NO: 249826 - protein, 10 aa, Flavivirus
SGQVVTYGLN

SEQ ID NO: 249827 - protein, 10 aa, Flavivirus
GQVVTYGLNT

SEQ ID NO: 249828 - protein, 10 aa, Flavivirus
QDELVGRARI

SEQ ID NO: 249829 - protein, 10 aa, Flavivirus
LSYFHRRDLR

SEQ ID NO: 249830 - protein, 10 aa, Flavivirus
YFHRRDLRTL

SEQ ID NO: 249831 - protein, 10 aa, Flavivirus
SDRGWGNGCG

SEQ ID NO: 249832 - protein, 10 aa, Flavivirus
HTLWHTTRGA

SEQ ID NO: 249833 - protein, 10 aa, Flavivirus
TVILAPTRVV

SEQ ID NO: 249834 - protein, 10 aa, Flavivirus
IMDEAHFLDP

SEQ ID NO: 249835 - protein, 10 aa, Flavivirus
PDFVVTTDIS

SEQ ID NO: 249836 - protein, 10 aa, Flavivirus
DFILATDIAE

SEQ ID NO: 249837 - protein, 10 aa, Flavivirus
FILATDIAEM

SEQ ID NO: 249838 - protein, 10 aa, Flavivirus
SSAAQRRGRV

SEQ ID NO: 249839 - protein, 10 aa, Flavivirus
LSRNSSHEMY

SEQ ID NO: 249840 - protein, 10 aa, Flavivirus
SRNSTHEMYF

SEQ ID NO: 249841 - protein, 10 aa, Flavivirus
MAMTDTTAFG

SEQ ID NO: 249842 - protein, 10 aa, Flavivirus
VFKDKVDTKA

SEQ ID NO: 249843 - protein, 10 aa, Flavivirus
NMMGKREKKI

SEQ ID NO: 249844 - protein, 10 aa, Flavivirus
SEFGKAKGSR

SEQ ID NO: 249845 - protein, 10 aa, Flavivirus
EFGSAKGSRA

SEQ ID NO: 249846 - protein, 10 aa, Flavivirus
VAKGSRAIWY

SEQ ID NO: 249847 - protein, 10 aa, Flavivirus
IWYMWLGSRF

SEQ ID NO: 249848 - protein, 10 aa, Flavivirus
WYMWLGSRFL

SEQ ID NO: 249849 - protein, 10 aa, Flavivirus
YMWLGSRFLE

SEQ ID NO: 249850 - protein, 10 aa, Flavivirus
LYADDTAGWD

SEQ ID NO: 249851 - protein, 10 aa, Flavivirus
DTAGWDTKIT

SEQ ID NO: 249852 - protein, 10 aa, Flavivirus
QDELIGRGRV

SEQ ID NO: 249853 - protein, 10 aa, Flavivirus
LMYFHKRDMR

SEQ ID NO: 249854 - protein, 10 aa, Flavivirus
YFHKRDMRLL

SEQ ID NO: 249855 - protein, 10 aa, Flavivirus
HTMWHVTQGA

SEQ ID NO: 249856 - protein, 10 aa, Flavivirus
TAILAPTRVV

SEQ ID NO: 249857 - protein, 10 aa, Flavivirus
IMDEAHFMDP

SEQ ID NO: 249858 - protein, 10 aa, Flavivirus
PDFILATDIA

SEQ ID NO: 249859 - protein, 10 aa, Flavivirus
FLMTDVSTYS

SEQ ID NO: 249860 - protein, 10 aa, Flavivirus
NTMGKKEKKP

SEQ ID NO: 249861 - protein, 10 aa, Flavivirus
AEFGKAKGSR

SEQ ID NO: 249862 - protein, 10 aa, Flavivirus
IWFMWLGARY

SEQ ID NO: 249863 - protein, 10 aa, Flavivirus
WFMWLGARYL

SEQ ID NO: 249864 - protein, 10 aa, Flavivirus
FMWLGARYLE

SEQ ID NO: 249865 - protein, 10 aa, Flavivirus
QDELIGRARV

SEQ ID NO: 249866 - protein, 10 aa, Flavivirus
LNYFHRRDLR

SEQ ID NO: 249867 - protein, 10 aa, Flavivirus
YFHRRDLRVM

SEQ ID NO: 249868 - protein, 11 aa, Flavivirus
VDRGWGNGCGL

SEQ ID NO: 249869 - protein, 11 aa, Flavivirus
DRGWGNGCGLF

SEQ ID NO: 249870 - protein, 11 aa, Flavivirus
RGWGNGCGLFG

SEQ ID NO: 249871 - protein, 11 aa, Flavivirus
GWGNGCGLFGK

SEQ ID NO: 249872 - protein, 11 aa, Flavivirus
WGNGCGLFGKG

SEQ ID NO: 249873 - protein, 11 aa, Flavivirus
GNGCGLFGKGS

SEQ ID NO: 249874 - protein, 11 aa, Flavivirus
WDFVVTTDISE

SEQ ID NO: 249875 - protein, 11 aa, Flavivirus
DFVVTTDISEM

SEQ ID NO: 249876 - protein, 11 aa, Flavivirus
FVVTTDISEMG

SEQ ID NO: 249877 - protein, 11 aa, Flavivirus
VVTTDISEMGA

SEQ ID NO: 249878 - protein, 11 aa, Flavivirus
VTTDISEMGAN

SEQ ID NO: 249879 - protein, 11 aa, Flavivirus
TTDISEMGANF

SEQ ID NO: 249880 - protein, 11 aa, Flavivirus
ASAAQRRGRIG

SEQ ID NO: 249881 - protein, 11 aa, Flavivirus
SAAQRRGRIGR

SEQ ID NO: 249882 - protein, 11 aa, Flavivirus
VIDLGCGRGGW

SEQ ID NO: 249883 - protein, 11 aa, Flavivirus
IDLGCGRGGWS

SEQ ID NO: 249884 - protein, 11 aa, Flavivirus
DLGCGRGGWSY

SEQ ID NO: 249885 - protein, 11 aa, Flavivirus
LGCGRGGWSYY

SEQ ID NO: 249886 - protein, 11 aa, Flavivirus
PLSRNSTHEMY

SEQ ID NO: 249887 - protein, 11 aa, Flavivirus
MAMTDTTPFGQ

SEQ ID NO: 249888 - protein, 11 aa, Flavivirus
AMTDTTPFGQQ

SEQ ID NO: 249889 - protein, 11 aa, Flavivirus
MTDTTPFGQQR

SEQ ID NO: 249890 - protein, 11 aa, Flavivirus
TDTTPFGQQRV

SEQ ID NO: 249891 - protein, 11 aa, Flavivirus
DTTPFGQQRVF

SEQ ID NO: 249892 - protein, 11 aa, Flavivirus
TTPFGQQRVFK

SEQ ID NO: 249893 - protein, 11 aa, Flavivirus
TPFGQQRVFKE

SEQ ID NO: 249894 - protein, 11 aa, Flavivirus
PFGQQRVFKEK

SEQ ID NO: 249895 - protein, 11 aa, Flavivirus
FGQQRVFKEKV

SEQ ID NO: 249896 - protein, 11 aa, Flavivirus
GQQRVFKEKVD

SEQ ID NO: 249897 - protein, 11 aa, Flavivirus
QQRVFKEKVDT

SEQ ID NO: 249898 - protein, 11 aa, Flavivirus
QRVFKEKVDTR

SEQ ID NO: 249899 - protein, 11 aa, Flavivirus
RVFKEKVDTRT

SEQ ID NO: 249900 - protein, 11 aa, Flavivirus
CVYNMMGKREK

SEQ ID NO: 249901 - protein, 11 aa, Flavivirus
VYNMMGKREKK

SEQ ID NO: 249902 - protein, 11 aa, Flavivirus
EFGKAKGSRAI

SEQ ID NO: 249903 - protein, 11 aa, Flavivirus
FGKAKGSRAIW

SEQ ID NO: 249904 - protein, 11 aa, Flavivirus
GKAKGSRAIWY

SEQ ID NO: 249905 - protein, 11 aa, Flavivirus
KAKGSRAIWYM

SEQ ID NO: 249906 - protein, 11 aa, Flavivirus
AKGSRAIWYMW

SEQ ID NO: 249907 - protein, 11 aa, Flavivirus
KGSRAIWYMWL

SEQ ID NO: 249908 - protein, 11 aa, Flavivirus
GSRAIWYMWLG

SEQ ID NO: 249909 - protein, 11 aa, Flavivirus
SRAIWYMWLGA

SEQ ID NO: 249910 - protein, 11 aa, Flavivirus
RAIWYMWLGAR

SEQ ID NO: 249911 - protein, 11 aa, Flavivirus
AIWYMWLGARF

SEQ ID NO: 249912 - protein, 11 aa, Flavivirus
IWYMWLGARFL

SEQ ID NO: 249913 - protein, 11 aa, Flavivirus
WYMWLGARFLE

SEQ ID NO: 249914 - protein, 11 aa, Flavivirus
YMWLGARFLEF

SEQ ID NO: 249915 - protein, 11 aa, Flavivirus
MWLGARFLEFE

SEQ ID NO: 249916 - protein, 11 aa, Flavivirus
WLGARFLEFEA

SEQ ID NO: 249917 - protein, 11 aa, Flavivirus
LGARFLEFEAL

SEQ ID NO: 249918 - protein, 11 aa, Flavivirus
GARFLEFEALG

SEQ ID NO: 249919 - protein, 11 aa, Flavivirus
ARFLEFEALGF

SEQ ID NO: 249920 - protein, 11 aa, Flavivirus
RFLEFEALGFL

SEQ ID NO: 249921 - protein, 11 aa, Flavivirus
FLEFEALGFLN

SEQ ID NO: 249922 - protein, 11 aa, Flavivirus
LEFEALGFLNE

SEQ ID NO: 249923 - protein, 11 aa, Flavivirus
EFEALGFLNED

SEQ ID NO: 249924 - protein, 11 aa, Flavivirus
FEALGFLNEDH

SEQ ID NO: 249925 - protein, 11 aa, Flavivirus
EALGFLNEDHW

SEQ ID NO: 249926 - protein, 11 aa, Flavivirus
MYADDTAGWDT

SEQ ID NO: 249927 - protein, 11 aa, Flavivirus
YADDTAGWDTR

SEQ ID NO: 249928 - protein, 11 aa, Flavivirus
ADDTAGWDTRI

SEQ ID NO: 249929 - protein, 11 aa, Flavivirus
DDTAGWDTRIT

SEQ ID NO: 249930 - protein, 11 aa, Flavivirus
QRGSGQVGTYG

SEQ ID NO: 249931 - protein, 11 aa, Flavivirus
RGSGQVGTYGL

SEQ ID NO: 249932 - protein, 11 aa, Flavivirus
GSGQVGTYGLN

SEQ ID NO: 249933 - protein, 11 aa, Flavivirus
SGQVGTYGLNT

SEQ ID NO: 249934 - protein, 11 aa, Flavivirus
TDRGWGNGCGL

SEQ ID NO: 249935 - protein, 11 aa, Flavivirus
DRGWGNHCGLF

SEQ ID NO: 249936 - protein, 11 aa, Flavivirus
RGWGNHCGLFG

SEQ ID NO: 249937 - protein, 11 aa, Flavivirus
GWGNHCGLFGK

SEQ ID NO: 249938 - protein, 11 aa, Flavivirus
WGNHCGLFGKG

SEQ ID NO: 249939 - protein, 11 aa, Flavivirus
GNGCGLFGKGG

SEQ ID NO: 249940 - protein, 11 aa, Flavivirus
WDYVVTTDISE

SEQ ID NO: 249941 - protein, 11 aa, Flavivirus
DYVVTTDISEM

SEQ ID NO: 249942 - protein, 11 aa, Flavivirus
YVVTTDISEMG

SEQ ID NO: 249943 - protein, 11 aa, Flavivirus
VITTDISEMGA

SEQ ID NO: 249944 - protein, 11 aa, Flavivirus
ITTDISEMGAN

SEQ ID NO: 249945 - protein, 11 aa, Flavivirus
TTDISEMGANL

SEQ ID NO: 249946 - protein, 11 aa, Flavivirus
SSAAQRRGRIG

SEQ ID NO: 249947 - protein, 11 aa, Flavivirus
SAAQRRGRVGR

SEQ ID NO: 249948 - protein, 11 aa, Flavivirus
VVDLGCGRGGW

SEQ ID NO: 249949 - protein, 11 aa, Flavivirus
VDLGCGRGGWS

SEQ ID NO: 249950 - protein, 11 aa, Flavivirus
DLGCGRGGWCY

SEQ ID NO: 249951 - protein, 11 aa, Flavivirus
LGCGRGGWCYY

SEQ ID NO: 249952 - protein, 11 aa, Flavivirus
PLSRNSNHEMY

SEQ ID NO: 249953 - protein, 11 aa, Flavivirus
IAMTDTTPFGQ

SEQ ID NO: 249954 - protein, 11 aa, Flavivirus
AMTDTTAFGQQ

SEQ ID NO: 249955 - protein, 11 aa, Flavivirus
MTDTTAFGQQR

SEQ ID NO: 249956 - protein, 11 aa, Flavivirus
TDTTAFGQQRV

SEQ ID NO: 249957 - protein, 11 aa, Flavivirus
DTTAFGQQRVF

SEQ ID NO: 249958 - protein, 11 aa, Flavivirus
TTAFGQQRVFK

SEQ ID NO: 249959 - protein, 11 aa, Flavivirus
TAFGQQRVFKE

SEQ ID NO: 249960 - protein, 11 aa, Flavivirus
AFGQQRVFKEK

SEQ ID NO: 249961 - protein, 11 aa, Flavivirus
FGQQRVFKDKV

SEQ ID NO: 249962 - protein, 11 aa, Flavivirus
GQQRVFKDKVD

SEQ ID NO: 249963 - protein, 11 aa, Flavivirus
QQRVFKDKVDT

SEQ ID NO: 249964 - protein, 11 aa, Flavivirus
QRVFKEKVDTK

SEQ ID NO: 249965 - protein, 11 aa, Flavivirus
RVFKEKVDTKA

SEQ ID NO: 249966 - protein, 11 aa, Flavivirus
CIYNMMGKREK

SEQ ID NO: 249967 - protein, 11 aa, Flavivirus
IYNMMGKREKK

SEQ ID NO: 249968 - protein, 11 aa, Flavivirus
EFGRAKGSRAI

SEQ ID NO: 249969 - protein, 11 aa, Flavivirus
FGRAKGSRAIW

SEQ ID NO: 249970 - protein, 11 aa, Flavivirus
GKAKGSRAIWF

SEQ ID NO: 249971 - protein, 11 aa, Flavivirus
KAKGSRAIWFM

SEQ ID NO: 249972 - protein, 11 aa, Flavivirus
AKGSRAIWFMW

SEQ ID NO: 249973 - protein, 11 aa, Flavivirus
KGSRAIWFMWL

SEQ ID NO: 249974 - protein, 11 aa, Flavivirus
GSRAIWFMWLG

SEQ ID NO: 249975 - protein, 11 aa, Flavivirus
SRAIWFMWLGA

SEQ ID NO: 249976 - protein, 11 aa, Flavivirus
RAIWFMWLGAR

SEQ ID NO: 249977 - protein, 11 aa, Flavivirus
AIWYMWLGARY

SEQ ID NO: 249978 - protein, 11 aa, Flavivirus
IWYMWLGARYL

SEQ ID NO: 249979 - protein, 11 aa, Flavivirus
WYMWLGARYLE

SEQ ID NO: 249980 - protein, 11 aa, Flavivirus
YMWLGARYLEF

SEQ ID NO: 249981 - protein, 11 aa, Flavivirus
MWLGARYLEFE

SEQ ID NO: 249982 - protein, 11 aa, Flavivirus
WLGARYLEFEA

SEQ ID NO: 249983 - protein, 11 aa, Flavivirus
LGARYLEFEAL

SEQ ID NO: 249984 - protein, 11 aa, Flavivirus
GARYLEFEALG

SEQ ID NO: 249985 - protein, 11 aa, Flavivirus
ARYLEFEALGF

SEQ ID NO: 249986 - protein, 11 aa, Flavivirus
RFLEFEALGFM

SEQ ID NO: 249987 - protein, 11 aa, Flavivirus
FLEFEALGFMN

SEQ ID NO: 249988 - protein, 11 aa, Flavivirus
LEFEALGFMNE

SEQ ID NO: 249989 - protein, 11 aa, Flavivirus
EFEALGFMNED

SEQ ID NO: 249990 - protein, 11 aa, Flavivirus
FEALGFMNEDH

SEQ ID NO: 249991 - protein, 11 aa, Flavivirus
EALGFMNEDHW

SEQ ID NO: 249992 - protein, 11 aa, Flavivirus
IYADDTAGWDT

SEQ ID NO: 249993 - protein, 11 aa, Flavivirus
YADDTAGWDTK

SEQ ID NO: 249994 - protein, 11 aa, Flavivirus
ADDTAGWDTKV

SEQ ID NO: 249995 - protein, 11 aa, Flavivirus
DDTAGWDTKVT

SEQ ID NO: 249996 - protein, 11 aa, Flavivirus
QRGSGQVVTYA

SEQ ID NO: 249997 - protein, 11 aa, Flavivirus
RGSGQVVTYAL

SEQ ID NO: 249998 - protein, 11 aa, Flavivirus
GSGQVVTYALN

SEQ ID NO: 249999 - protein, 11 aa, Flavivirus
SGQVVTYALNT

SEQ ID NO: 250000 - protein, 11 aa, Flavivirus
SDRGWGNHCGL

SEQ ID NO: 250001 - protein, 11 aa, Flavivirus
GNHCGLFGKGS

SEQ ID NO: 250002 - protein, 11 aa, Flavivirus
WDFVITTDISE

SEQ ID NO: 250003 - protein, 11 aa, Flavivirus
DFVITTDISEM

SEQ ID NO: 250004 - protein, 11 aa, Flavivirus
FVITTDISEMG

SEQ ID NO: 250005 - protein, 11 aa, Flavivirus
ILATDIAEMGA

SEQ ID NO: 250006 - protein, 11 aa, Flavivirus
LATDIAEMGAN

SEQ ID NO: 250007 - protein, 11 aa, Flavivirus
ATDIAEMGANL

SEQ ID NO: 250008 - protein, 11 aa, Flavivirus
ASAAQRRGRVG

SEQ ID NO: 250009 - protein, 11 aa, Flavivirus
VMDLGCGRGGW

SEQ ID NO: 250010 - protein, 11 aa, Flavivirus
IDLGCGRGGWC

SEQ ID NO: 250011 - protein, 11 aa, Flavivirus
PFSRNSTHEMY

SEQ ID NO: 250012 - protein, 11 aa, Flavivirus
LAMTDTTPFGQ

SEQ ID NO: 250013 - protein, 11 aa, Flavivirus
SMTDTTPFGQQ

SEQ ID NO: 250014 - protein, 11 aa, Flavivirus
TAFGQQRVFKD

SEQ ID NO: 250015 - protein, 11 aa, Flavivirus
AFGQQRVFKDK

SEQ ID NO: 250016 - protein, 11 aa, Flavivirus
QRVFKDKVDTK

SEQ ID NO: 250017 - protein, 11 aa, Flavivirus
RVFKEKVDTRA

SEQ ID NO: 250018 - protein, 11 aa, Flavivirus
EFGVAKGSRAI

SEQ ID NO: 250019 - protein, 11 aa, Flavivirus
FGVAKGSRAIW

SEQ ID NO: 250020 - protein, 11 aa, Flavivirus
GRAKGSRAIWY

SEQ ID NO: 250021 - protein, 11 aa, Flavivirus
RAKGSRAIWYM

SEQ ID NO: 250022 - protein, 11 aa, Flavivirus
SRAIWYMWLGS

SEQ ID NO: 250023 - protein, 11 aa, Flavivirus
RAIWYMWLGSR

SEQ ID NO: 250024 - protein, 11 aa, Flavivirus
AIWFMWLGARF

SEQ ID NO: 250025 - protein, 11 aa, Flavivirus
IWFMWLGARFL

SEQ ID NO: 250026 - protein, 11 aa, Flavivirus
WFMWLGARFLE

SEQ ID NO: 250027 - protein, 11 aa, Flavivirus
FMWLGARFLEF

SEQ ID NO: 250028 - protein, 11 aa, Flavivirus
MWLGSRFLEFE

SEQ ID NO: 250029 - protein, 11 aa, Flavivirus
WLGSRFLEFEA

SEQ ID NO: 250030 - protein, 11 aa, Flavivirus
LGSRFLEFEAL

SEQ ID NO: 250031 - protein, 11 aa, Flavivirus
GSRFLEFEALG

SEQ ID NO: 250032 - protein, 11 aa, Flavivirus
SRFLEFEALGF

SEQ ID NO: 250033 - protein, 11 aa, Flavivirus
RYLEFEALGFL

SEQ ID NO: 250034 - protein, 11 aa, Flavivirus
YLEFEALGFLN

SEQ ID NO: 250035 - protein, 11 aa, Flavivirus
FYADDTAGWDT

SEQ ID NO: 250036 - protein, 11 aa, Flavivirus
ADDTAGWDTRV

SEQ ID NO: 250037 - protein, 11 aa, Flavivirus
DDTAGWDTRVT

SEQ ID NO: 250038 - protein, 11 aa, Flavivirus
QRGSGQVVTYG

SEQ ID NO: 250039 - protein, 11 aa, Flavivirus
RGSGQVVTYGL

SEQ ID NO: 250040 - protein, 11 aa, Flavivirus
GSGQVVTYGLN

SEQ ID NO: 250041 - protein, 11 aa, Flavivirus
SGQVVTYGLNT

SEQ ID NO: 250042 - protein, 11 aa, Flavivirus
SDRGWGNGCGL

SEQ ID NO: 250043 - protein, 11 aa, Flavivirus
GNHCGFFGKGS

SEQ ID NO: 250044 - protein, 11 aa, Flavivirus
PDFVVTTDISE

SEQ ID NO: 250045 - protein, 11 aa, Flavivirus
DFILATDIAEM

SEQ ID NO: 250046 - protein, 11 aa, Flavivirus
FILATDIAEMG

SEQ ID NO: 250047 - protein, 11 aa, Flavivirus
SSAAQRRGRVG

SEQ ID NO: 250048 - protein, 11 aa, Flavivirus
VDLGCGRGGWC

SEQ ID NO: 250049 - protein, 11 aa, Flavivirus
PLSRNSSHEMY

SEQ ID NO: 250050 - protein, 11 aa, Flavivirus
MAMTDTTAFGQ

SEQ ID NO: 250051 - protein, 11 aa, Flavivirus
RVFKDKVDTKA

SEQ ID NO: 250052 - protein, 11 aa, Flavivirus
EFGSAKGSRAI

SEQ ID NO: 250053 - protein, 11 aa, Flavivirus
GVAKGSRAIWY

SEQ ID NO: 250054 - protein, 11 aa, Flavivirus
VAKGSRAIWYM

SEQ ID NO: 250055 - protein, 11 aa, Flavivirus
AIWFMWLGARY

SEQ ID NO: 250056 - protein, 11 aa, Flavivirus
IWYMWLGSRFL

SEQ ID NO: 250057 - protein, 11 aa, Flavivirus
WYMWLGSRFLE

SEQ ID NO: 250058 - protein, 11 aa, Flavivirus
YMWLGSRFLEF

SEQ ID NO: 250059 - protein, 11 aa, Flavivirus
LYADDTAGWDT

SEQ ID NO: 250060 - protein, 11 aa, Flavivirus
DDTAGWDTKIT

SEQ ID NO: 250061 - protein, 11 aa, Flavivirus
SDRGWGNHCGF

SEQ ID NO: 250062 - protein, 11 aa, Flavivirus
PDFILATDIAE

SEQ ID NO: 250063 - protein, 11 aa, Flavivirus
MDLGCGRGGWS

SEQ ID NO: 250064 - protein, 11 aa, Flavivirus
FLMTDVSTYSQ

SEQ ID NO: 250065 - protein, 11 aa, Flavivirus
AIWYMWLGSRF

SEQ ID NO: 250066 - protein, 11 aa, Flavivirus
IWFMWLGARYL

SEQ ID NO: 250067 - protein, 11 aa, Flavivirus
WFMWLGARYLE

SEQ ID NO: 250068 - protein, 11 aa, Flavivirus
FMWLGARYLEF

SEQ ID NO: 250069 - protein, 9 aa, Dengue virus
GTILIRVEY

SEQ ID NO: 250070 - protein, 9 aa, Dengue virus
TVNPIVTEK

SEQ ID NO: 250071 - protein, 9 aa, Dengue virus
LILAGVSLL

SEQ ID NO: 250072 - protein, 9 aa, Dengue virus
KVSCTTLAV

SEQ ID NO: 250073 - protein, 9 aa, Dengue virus
KMDNFTMGI

SEQ ID NO: 250074 - protein, 9 aa, Dengue virus
VVQDDGTMK

SEQ ID NO: 250075 - protein, 9 aa, Dengue virus
ALIFILLAA

SEQ ID NO: 250076 - protein, 9 aa, Dengue virus
FVGKTVWFV

SEQ ID NO: 250077 - protein, 9 aa, Dengue virus
MTTVFSIPR

SEQ ID NO: 250078 - protein, 9 aa, Dengue virus
LAISGVYPM

SEQ ID NO: 250079 - protein, 9 aa, Dengue virus
LPWTSGATA

SEQ ID NO: 250080 - protein, 9 aa, Dengue virus
RSEFQIYKK

SEQ ID NO: 250081 - protein, 9 aa, Dengue virus
AVASSLLWV

SEQ ID NO: 250082 - protein, 9 aa, Dengue virus
HMIAGVLFM

SEQ ID NO: 250083 - protein, 9 aa, Dengue virus
LLMLLPTAL

SEQ ID NO: 250084 - protein, 9 aa, Dengue virus
CWCNATETW

SEQ ID NO: 250085 - protein, 9 aa, Dengue virus
SLGKAVHQV

SEQ ID NO: 250086 - protein, 9 aa, Dengue virus
SILLSSLLK

SEQ ID NO: 250087 - protein, 9 aa, Dengue virus
ITASSLLWY

SEQ ID NO: 250088 - protein, 9 aa, Dengue virus
QLWAALLSL

SEQ ID NO: 250089 - protein, 9 aa, Dengue virus
GTNSRNTPM

SEQ ID NO: 250090 - protein, 9 aa, Dengue virus
LALSLTFIK

SEQ ID NO: 250091 - protein, 9 aa, Dengue virus
WATLLSLTF

SEQ ID NO: 250092 - protein, 9 aa, Dengue virus
KAISVLRGF

SEQ ID NO: 250093 - protein, 9 aa, Dengue virus
KLRIKGMSY

SEQ ID NO: 250094 - protein, 9 aa, Dengue virus
VSWSGRELK

SEQ ID NO: 250095 - protein, 9 aa, Dengue virus
TFIKTTYSL

SEQ ID NO: 250096 - protein, 9 aa, Dengue virus
VTCAMFRCK

SEQ ID NO: 250097 - protein, 9 aa, Dengue virus
TLLSFTFIK

SEQ ID NO: 250098 - protein, 9 aa, Dengue virus
AIKVLKGFK

SEQ ID NO: 250099 - protein, 9 aa, Dengue virus
LALLAAFRV

SEQ ID NO: 250100 - protein, 9 aa, Dengue virus
GIQRTAFFV

SEQ ID NO: 250101 - protein, 9 aa, Dengue virus
VIIMMIPTV

SEQ ID NO: 250102 - protein, 9 aa, Dengue virus
MDLEKRYVL

SEQ ID NO: 250103 - protein, 9 aa, Dengue virus
ITNVTTDSR

SEQ ID NO: 250104 - protein, 9 aa, Dengue virus
AVFKMSPGY

SEQ ID NO: 250105 - protein, 9 aa, Dengue virus
AVQDWLARV

SEQ ID NO: 250106 - protein, 9 aa, Dengue virus
ILNAHKEGV

SEQ ID NO: 250107 - protein, 9 aa, Dengue virus
RTATLILAV

SEQ ID NO: 250108 - protein, 9 aa, Dengue virus
LSRNSTHEM

SEQ ID NO: 250109 - protein, 9 aa, Dengue virus
WGKAKIVTA

SEQ ID NO: 250110 - protein, 9 aa, Dengue virus
LPVCQSSSM

SEQ ID NO: 250111 - protein, 9 aa, Dengue virus
FTILALFLA

SEQ ID NO: 250112 - protein, 9 aa, Dengue virus
LAMGCYSQV

SEQ ID NO: 250113 - protein, 9 aa, Dengue virus
MLIPKSYAG

SEQ ID NO: 250114 - protein, 9 aa, Dengue virus
TTSIWMKFR

SEQ ID NO: 250115 - protein, 9 aa, Dengue virus
IWEVEDYGF

SEQ ID NO: 250116 - protein, 9 aa, Dengue virus
VTEVKGYTK

SEQ ID NO: 250117 - protein, 9 aa, Dengue virus
MCTNTFVLK

SEQ ID NO: 250118 - protein, 9 aa, Dengue virus
YSQIGAGVY

SEQ ID NO: 250119 - protein, 9 aa, Dengue virus
IPLCRTSCL

SEQ ID NO: 250120 - protein, 9 aa, Dengue virus
LVAASFVTL

SEQ ID NO: 250121 - protein, 9 aa, Dengue virus
RTYSDPLAL

SEQ ID NO: 250122 - protein, 9 aa, Dengue virus
IVQPENLEY

SEQ ID NO: 250123 - protein, 9 aa, Dengue virus
SLIPLCLST

SEQ ID NO: 250124 - protein, 9 aa, Dengue virus
LLVAVSFMT

SEQ ID NO: 250125 - protein, 9 aa, Dengue virus
QPKPGTRMI

SEQ ID NO: 250126 - protein, 9 aa, Dengue virus
MQAGRRSLK

SEQ ID NO: 250127 - protein, 9 aa, Dengue virus
AVKNWLVRV

SEQ ID NO: 250128 - protein, 9 aa, Dengue virus
INRRKKTSL

SEQ ID NO: 250129 - protein, 9 aa, Dengue virus
ITASVLLWY

SEQ ID NO: 250130 - protein, 9 aa, Dengue virus
TLTAALLSL

SEQ ID NO: 250131 - protein, 9 aa, Dengue virus
LTQKVVIFV

SEQ ID NO: 250132 - protein, 9 aa, Dengue virus
HLAHRTRNA

SEQ ID NO: 250133 - protein, 9 aa, Dengue virus
ASQLATLRK

SEQ ID NO: 250134 - protein, 9 aa, Dengue virus
LLVAHYAII

SEQ ID NO: 250135 - protein, 9 aa, Dengue virus
VLLGSLGCK

SEQ ID NO: 250136 - protein, 9 aa, Dengue virus
NSKNISMSF

SEQ ID NO: 250137 - protein, 9 aa, Dengue virus
HPGFTVMAL

SEQ ID NO: 250138 - protein, 9 aa, Dengue virus
LAAVSVSPL

SEQ ID NO: 250139 - protein, 9 aa, Dengue virus
ALCEALTLA

SEQ ID NO: 250140 - protein, 9 aa, Dengue virus
LLKTALLIV

SEQ ID NO: 250141 - protein, 9 aa, Dengue virus
TMRHKKATY

SEQ ID NO: 250142 - protein, 9 aa, Dengue virus
LIQKVVIFI

SEQ ID NO: 250143 - protein, 9 aa, Dengue virus
VTRGAVLMY

SEQ ID NO: 250144 - protein, 9 aa, Dengue virus
KKMVRPQPM

SEQ ID NO: 250145 - protein, 9 aa, Dengue virus
MLSIINKRK

SEQ ID NO: 250146 - protein, 9 aa, Dengue virus
AYQHALNEL

SEQ ID NO: 250147 - protein, 9 aa, Dengue virus
TLLSLTFVK

SEQ ID NO: 250148 - protein, 9 aa, Dengue virus
VVLQNAWKV

SEQ ID NO: 250149 - protein, 9 aa, Dengue virus
TVLIKVEYK

SEQ ID NO: 250150 - protein, 9 aa, Dengue virus
AAFRVRPTF

SEQ ID NO: 250151 - protein, 9 aa, Dengue virus
FLAHAIGTS

SEQ ID NO: 250152 - protein, 9 aa, Dengue virus
SKSEFNIYK

SEQ ID NO: 250153 - protein, 9 aa, Dengue virus
QMSGTTTIF

SEQ ID NO: 250154 - protein, 9 aa, Dengue virus
ILLKMVVHF

SEQ ID NO: 250155 - protein, 9 aa, Dengue virus
TRKVRSNAA

SEQ ID NO: 250156 - protein, 9 aa, Dengue virus
CVTTIAQGK

SEQ ID NO: 250157 - protein, 9 aa, Dengue virus
GLICVIASS

SEQ ID NO: 250158 - protein, 9 aa, Dengue virus
KVIGRVISA

SEQ ID NO: 250159 - protein, 9 aa, Dengue virus
RAVHADMGY

SEQ ID NO: 250160 - protein, 9 aa, Dengue virus
KWKSRLNAL

SEQ ID NO: 250161 - protein, 9 aa, Dengue virus
VQDDGTMKI

SEQ ID NO: 250162 - protein, 9 aa, Dengue virus
MLLALIAVL

SEQ ID NO: 250163 - protein, 9 aa, Dengue virus
LVISGLFPI

SEQ ID NO: 250164 - protein, 9 aa, Dengue virus
TTSKMLLNR

SEQ ID NO: 250165 - protein, 9 aa, Dengue virus
KTFVDLMRR

SEQ ID NO: 250166 - protein, 9 aa, Dengue virus
YAQMWALMY

SEQ ID NO: 250167 - protein, 9 aa, Dengue virus
YIGTSLIQK

SEQ ID NO: 250168 - protein, 9 aa, Dengue virus
TFSLHYAWK

SEQ ID NO: 250169 - protein, 9 aa, Dengue virus
LLVAVSFVT

SEQ ID NO: 250170 - protein, 9 aa, Dengue virus
SAVNMTSRM

SEQ ID NO: 250171 - protein, 9 aa, Dengue virus
SGYEWITDF

SEQ ID NO: 250172 - protein, 9 aa, Dengue virus
SLGCKPLPM

SEQ ID NO: 250173 - protein, 9 aa, Dengue virus
IFRKRKLTI

SEQ ID NO: 250174 - protein, 9 aa, Dengue virus
KSEFQTYKK

SEQ ID NO: 250175 - protein, 9 aa, Dengue virus
AMVLSIVSL

SEQ ID NO: 250176 - protein, 9 aa, Dengue virus
TIGETLGEK

SEQ ID NO: 250177 - protein, 9 aa, Dengue virus
LSIINRRKK

SEQ ID NO: 250178 - protein, 9 aa, Dengue virus
TLKGMSYVM

SEQ ID NO: 250179 - protein, 9 aa, Dengue virus
LAMTDTTPF

SEQ ID NO: 250180 - protein, 9 aa, Dengue virus
LILAGISLL

SEQ ID NO: 250181 - protein, 9 aa, Dengue virus
SLIGLTSRA

SEQ ID NO: 250182 - protein, 9 aa, Dengue virus
PLNEAIMAV

SEQ ID NO: 250183 - protein, 9 aa, Dengue virus
LTSRATWAK

SEQ ID NO: 250184 - protein, 9 aa, Dengue virus
WMIRILIGI

SEQ ID NO: 250185 - protein, 9 aa, Dengue virus
CLRRRVTRK

SEQ ID NO: 250186 - protein, 9 aa, Dengue virus
TLTPQPMEL

SEQ ID NO: 250187 - protein, 9 aa, Dengue virus
YILREVGKK

SEQ ID NO: 250188 - protein, 9 aa, Dengue virus
TMLLMLLPT

SEQ ID NO: 250189 - protein, 9 aa, Dengue virus
EVKTCTWPK

SEQ ID NO: 250190 - protein, 9 aa, Dengue virus
WMIRILIGF

SEQ ID NO: 250191 - protein, 9 aa, Dengue virus
FKKRNLTIM

SEQ ID NO: 250192 - protein, 9 aa, Dengue virus
GGRAYRHAM

SEQ ID NO: 250193 - protein, 9 aa, Dengue virus
LLNGQGPMK

SEQ ID NO: 250194 - protein, 9 aa, Dengue virus
GQLTWNDLI

SEQ ID NO: 250195 - protein, 9 aa, Dengue virus
FPQSNAPII

SEQ ID NO: 250196 - protein, 9 aa, Dengue virus
SYEDREWCF

SEQ ID NO: 250197 - protein, 9 aa, Dengue virus
LLLEEMLRT

SEQ ID NO: 250198 - protein, 9 aa, Dengue virus
MVRILIGFL

SEQ ID NO: 250199 - protein, 9 aa, Dengue virus
WMTTEDMLK

SEQ ID NO: 250200 - protein, 9 aa, Dengue virus
YMDYMPVMK

SEQ ID NO: 250201 - protein, 9 aa, Dengue virus
VTCAMFTCK

SEQ ID NO: 250202 - protein, 9 aa, Dengue virus
AVASGLFWV

SEQ ID NO: 250203 - protein, 9 aa, Dengue virus
KTMAMILSI

SEQ ID NO: 250204 - protein, 9 aa, Dengue virus
WMVRILIGL

SEQ ID NO: 250205 - protein, 9 aa, Dengue virus
LIASLVMLL

SEQ ID NO: 250206 - protein, 9 aa, Dengue virus
SYKVASAGI

SEQ ID NO: 250207 - protein, 9 aa, Dengue virus
IPMVTQLAM

SEQ ID NO: 250208 - protein, 9 aa, Dengue virus
SVIEKMEAL

SEQ ID NO: 250209 - protein, 9 aa, Dengue virus
VLTLATGPV

SEQ ID NO: 250210 - protein, 9 aa, Dengue virus
TLITGNMSF

SEQ ID NO: 250211 - protein, 9 aa, Dengue virus
WLKLRDSYT

SEQ ID NO: 250212 - protein, 9 aa, Dengue virus
GMIIMLTPT

SEQ ID NO: 250213 - protein, 9 aa, Dengue virus
KAIKILTGF

SEQ ID NO: 250214 - protein, 9 aa, Dengue virus
RTIMVVLFV

SEQ ID NO: 250215 - protein, 9 aa, Dengue virus
MIIMLTPTV

SEQ ID NO: 250216 - protein, 9 aa, Dengue virus
IKKVRTNAA

SEQ ID NO: 250217 - protein, 9 aa, Dengue virus
KLASAIQKA

SEQ ID NO: 250218 - protein, 9 aa, Dengue virus
VMLFLISGK

SEQ ID NO: 250219 - protein, 9 aa, Dengue virus
KLALDNIVM

SEQ ID NO: 250220 - protein, 9 aa, Dengue virus
ATVLMGLGK

SEQ ID NO: 250221 - protein, 9 aa, Dengue virus
RFANALFAL

SEQ ID NO: 250222 - protein, 9 aa, Dengue virus
ASHNILVEV

SEQ ID NO: 250223 - protein, 9 aa, Dengue virus
TLLYLIPTV

SEQ ID NO: 250224 - protein, 9 aa, Dengue virus
RMLLNRFTM

SEQ ID NO: 250225 - protein, 9 aa, Dengue virus
IPRSYAGPF

SEQ ID NO: 250226 - protein, 9 aa, Dengue virus
IVIEKDSPV

SEQ ID NO: 250227 - protein, 9 aa, Dengue virus
IMAWRTIMV

SEQ ID NO: 250228 - protein, 9 aa, Dengue virus
SLSVMCIAV

SEQ ID NO: 250229 - protein, 9 aa, Dengue virus
VTTWENVPY

SEQ ID NO: 250230 - protein, 9 aa, Dengue virus
WTLMYFHRR

SEQ ID NO: 250231 - protein, 9 aa, Dengue virus
MGYWIESSK

SEQ ID NO: 250232 - protein, 9 aa, Dengue virus
RTIMAVLFA

SEQ ID NO: 250233 - protein, 9 aa, Dengue virus
ITETPTWNR

SEQ ID NO: 250234 - protein, 9 aa, Dengue virus
SSADLSLEK

SEQ ID NO: 250235 - protein, 9 aa, Dengue virus
FAAGLFLRK

SEQ ID NO: 250236 - protein, 9 aa, Dengue virus
VTYECPLLV

SEQ ID NO: 250237 - protein, 9 aa, Dengue virus
FAAGLLLRK

SEQ ID NO: 250238 - protein, 9 aa, Dengue virus
GPMPVTHSS

SEQ ID NO: 250239 - protein, 9 aa, Dengue virus
KQGSNWIQK

SEQ ID NO: 250240 - protein, 9 aa, Dengue virus
FQSHQLWAA

SEQ ID NO: 250241 - protein, 9 aa, Dengue virus
ITASILLWY

SEQ ID NO: 250242 - protein, 9 aa, Dengue virus
TIMAVLFAV

SEQ ID NO: 250243 - protein, 9 aa, Dengue virus
RPGYHTQTA

SEQ ID NO: 250244 - protein, 9 aa, Dengue virus
MILVVVTTL

SEQ ID NO: 250245 - protein, 9 aa, Dengue virus
LPWTSGATT

SEQ ID NO: 250246 - protein, 9 aa, Dengue virus
SNMLSIINK

SEQ ID NO: 250247 - protein, 9 aa, Dengue virus
LVMLFVHYA

SEQ ID NO: 250248 - protein, 9 aa, Dengue virus
RQMESEGIF

SEQ ID NO: 250249 - protein, 9 aa, Dengue virus
AMCLNTFVL

SEQ ID NO: 250250 - protein, 9 aa, Dengue virus
MAYMIGQTR

SEQ ID NO: 250251 - protein, 9 aa, Dengue virus
MTATPPGSR

SEQ ID NO: 250252 - protein, 9 aa, Dengue virus
TLTAAVLML

SEQ ID NO: 250253 - protein, 9 aa, Dengue virus
QLWITLLSL

SEQ ID NO: 250254 - protein, 9 aa, Dengue virus
MILLTMKNK

SEQ ID NO: 250255 - protein, 9 aa, Dengue virus
VLARWGTFK

SEQ ID NO: 250256 - protein, 9 aa, Dengue virus
QIANELNYI

SEQ ID NO: 250257 - protein, 9 aa, Dengue virus
KMLLDNIYT

SEQ ID NO: 250258 - protein, 9 aa, Dengue virus
LLFLNDMGK

SEQ ID NO: 250259 - protein, 9 aa, Dengue virus
GMIIMLIPT

SEQ ID NO: 250260 - protein, 9 aa, Dengue virus
LGRNKRPRL

SEQ ID NO: 250261 - protein, 9 aa, Dengue virus
SGSPIVDRK

SEQ ID NO: 250262 - protein, 9 aa, Dengue virus
TLTASLAML

SEQ ID NO: 250263 - protein, 9 aa, Dengue virus
KTRRYLPAM

SEQ ID NO: 250264 - protein, 9 aa, Dengue virus
ALWEGGHDL

SEQ ID NO: 250265 - protein, 9 aa, Dengue virus
ALFTFVLLL

SEQ ID NO: 250266 - protein, 9 aa, Dengue virus
SLIGLSSRA

SEQ ID NO: 250267 - protein, 9 aa, Dengue virus
FIKTTMPLI

SEQ ID NO: 250268 - protein, 9 aa, Dengue virus
RIISSTPFA

SEQ ID NO: 250269 - protein, 9 aa, Dengue virus
LGAMTAGIF

SEQ ID NO: 250270 - protein, 9 aa, Dengue virus
NIHTAIAQV

SEQ ID NO: 250271 - protein, 9 aa, Dengue virus
GLNSRSTSF

SEQ ID NO: 250272 - protein, 9 aa, Dengue virus
VIVMLIPTV

SEQ ID NO: 250273 - protein, 9 aa, Dengue virus
CIMVGANAF

SEQ ID NO: 250274 - protein, 9 aa, Dengue virus
HWFGRENSW

SEQ ID NO: 250275 - protein, 9 aa, Dengue virus
MIIMLIPTA

SEQ ID NO: 250276 - protein, 9 aa, Dengue virus
MALWYMWQV

SEQ ID NO: 250277 - protein, 9 aa, Dengue virus
TTGETLGEK

SEQ ID NO: 250278 - protein, 9 aa, Dengue virus
TLGAQALPV

SEQ ID NO: 250279 - protein, 9 aa, Dengue virus
YYMATLKNV

SEQ ID NO: 250280 - protein, 9 aa, Dengue virus
LLFKTEVGV

SEQ ID NO: 250281 - protein, 9 aa, Dengue virus
LLVAVSFLT

SEQ ID NO: 250282 - protein, 9 aa, Dengue virus
MILSIVSLF

SEQ ID NO: 250283 - protein, 9 aa, Dengue virus
RMVTFKVPH

SEQ ID NO: 250284 - protein, 9 aa, Dengue virus
LLATVTGGI

SEQ ID NO: 250285 - protein, 9 aa, Dengue virus
SVIEKMETL

SEQ ID NO: 250286 - protein, 9 aa, Dengue virus
LLIAHYAII

SEQ ID NO: 250287 - protein, 9 aa, Dengue virus
TQHGTTVVK

SEQ ID NO: 250288 - protein, 9 aa, Dengue virus
MTTEDMLAV

SEQ ID NO: 250289 - protein, 9 aa, Dengue virus
AMILSIVSL

SEQ ID NO: 250290 - protein, 9 aa, Dengue virus
RQGYATQTM

SEQ ID NO: 250291 - protein, 9 aa, Dengue virus
ALLLLVAHY

SEQ ID NO: 250292 - protein, 9 aa, Dengue virus
WAYHGSYEV

SEQ ID NO: 250293 - protein, 9 aa, Dengue virus
NKRRRTAGV

SEQ ID NO: 250294 - protein, 9 aa, Dengue virus
VGRERLSRM

SEQ ID NO: 250295 - protein, 9 aa, Dengue virus
VSGILAQGK

SEQ ID NO: 250296 - protein, 9 aa, Dengue virus
NLIGKEEYV

SEQ ID NO: 250297 - protein, 9 aa, Dengue virus
KMKTKTWLV

SEQ ID NO: 250298 - protein, 9 aa, Dengue virus
KIAQYENLK

SEQ ID NO: 250299 - protein, 9 aa, Dengue virus
IMAIGIVSI

SEQ ID NO: 250300 - protein, 9 aa, Dengue virus
ALWDVPSPA

SEQ ID NO: 250301 - protein, 9 aa, Dengue virus
QYIFTGQPL

SEQ ID NO: 250302 - protein, 9 aa, Dengue virus
GLAMGIMML

SEQ ID NO: 250303 - protein, 9 aa, Dengue virus
ILLAAVAPS

SEQ ID NO: 250304 - protein, 9 aa, Dengue virus
LVISGVFPV

SEQ ID NO: 250305 - protein, 9 aa, Dengue virus
KARSTPFNM

SEQ ID NO: 250306 - protein, 9 aa, Dengue virus
ITWIGMNSR

SEQ ID NO: 250307 - protein, 9 aa, Dengue virus
SLTFIRTSL

SEQ ID NO: 250308 - protein, 9 aa, Dengue virus
HILLENDMK

SEQ ID NO: 250309 - protein, 9 aa, Dengue virus
ARGARRMAI

SEQ ID NO: 250310 - protein, 9 aa, Dengue virus
GLAMGIMIL

SEQ ID NO: 250311 - protein, 9 aa, Dengue virus
WMKLREGSS

SEQ ID NO: 250312 - protein, 9 aa, Dengue virus
AGLAFSLMK

SEQ ID NO: 250313 - protein, 9 aa, Dengue virus
ILARWSSFK

SEQ ID NO: 250314 - protein, 9 aa, Dengue virus
GILARWSSF

SEQ ID NO: 250315 - protein, 9 aa, Dengue virus
ALLLLIAHY

SEQ ID NO: 250316 - protein, 9 aa, Dengue virus
LMYADDTAG

SEQ ID NO: 250317 - protein, 9 aa, Dengue virus
SPSELETPI

SEQ ID NO: 250318 - protein, 9 aa, Dengue virus
KLRDKQDVF

SEQ ID NO: 250319 - protein, 9 aa, Dengue virus
LTLAAIVTA

SEQ ID NO: 250320 - protein, 9 aa, Dengue virus
TISKMLLNR

SEQ ID NO: 250321 - protein, 9 aa, Dengue virus
SILELTDAL

SEQ ID NO: 250322 - protein, 9 aa, Dengue virus
HALGRLITV

SEQ ID NO: 250323 - protein, 9 aa, Dengue virus
RLLLNRFTM

SEQ ID NO: 250324 - protein, 9 aa, Dengue virus
CTGSFKLEK

SEQ ID NO: 250325 - protein, 9 aa, Dengue virus
LVLVGVVTL

SEQ ID NO: 250326 - protein, 9 aa, Dengue virus
CTREEFTRK

SEQ ID NO: 250327 - protein, 9 aa, Dengue virus
FLAHYIGTS

SEQ ID NO: 250328 - protein, 9 aa, Dengue virus
SYVMCTGSF

SEQ ID NO: 250329 - protein, 9 aa, Dengue virus
LLFKTENGV

SEQ ID NO: 250330 - protein, 9 aa, Dengue virus
SLLRNDVPM

SEQ ID NO: 250331 - protein, 9 aa, Dengue virus
YADYMPVMK

SEQ ID NO: 250332 - protein, 9 aa, Dengue virus
AVLLLITHY

SEQ ID NO: 250333 - protein, 9 aa, Dengue virus
CVYNMMGKR

SEQ ID NO: 250334 - protein, 9 aa, Dengue virus
YTDYMPSMK

SEQ ID NO: 250335 - protein, 9 aa, Dengue virus
MLAVGLLFR

SEQ ID NO: 250336 - protein, 9 aa, Dengue virus
KMVMAFIAF

SEQ ID NO: 250337 - protein, 9 aa, Dengue virus
NWYRKGSSI

SEQ ID NO: 250338 - protein, 9 aa, Dengue virus
NWYKKGSSI

SEQ ID NO: 250339 - protein, 9 aa, Dengue virus
MVAGGLLLA

SEQ ID NO: 250340 - protein, 9 aa, Dengue virus
HPGFTILAL

SEQ ID NO: 250341 - protein, 9 aa, Dengue virus
KVVIFTLLM

SEQ ID NO: 250342 - protein, 9 aa, Dengue virus
KLGYILRDV

SEQ ID NO: 250343 - protein, 9 aa, Dengue virus
VASAGISYK

SEQ ID NO: 250344 - protein, 9 aa, Dengue virus
ISYDPKFEK

SEQ ID NO: 250345 - protein, 9 aa, Dengue virus
CTKTFVLKK

SEQ ID NO: 250346 - protein, 9 aa, Dengue virus
AMGVPSLPL

SEQ ID NO: 250347 - protein, 9 aa, Dengue virus
IQTSGTTTI

SEQ ID NO: 250348 - protein, 9 aa, Dengue virus
NSLKINWYK

SEQ ID NO: 250349 - protein, 9 aa, Dengue virus
WFVERNMVI

SEQ ID NO: 250350 - protein, 9 aa, Dengue virus
KSAAIDGEY

SEQ ID NO: 250351 - protein, 9 aa, Dengue virus
KLLTDFQPH

SEQ ID NO: 250352 - protein, 9 aa, Dengue virus
LNGRRRSTM

SEQ ID NO: 250353 - protein, 9 aa, Dengue virus
GPLKLFMAL

SEQ ID NO: 250354 - protein, 9 aa, Dengue virus
SVGKLIHQV

SEQ ID NO: 250355 - protein, 9 aa, Dengue virus
TPQASTVEA

SEQ ID NO: 250356 - protein, 9 aa, Dengue virus
LMKRGDLPV

SEQ ID NO: 250357 - protein, 9 aa, Dengue virus
INKRKKTSL

SEQ ID NO: 250358 - protein, 9 aa, Dengue virus
ALLSLVAHY

SEQ ID NO: 250359 - protein, 9 aa, Dengue virus
KVASEGIKY

SEQ ID NO: 250360 - protein, 9 aa, Dengue virus
ILSENEVKL

SEQ ID NO: 250361 - protein, 9 aa, Dengue virus
GIQRTVFFV

SEQ ID NO: 250362 - protein, 9 aa, Dengue virus
MVLSIVSLI

SEQ ID NO: 250363 - protein, 9 aa, Dengue virus
CTRAEFCNK

SEQ ID NO: 250364 - protein, 9 aa, Dengue virus
SQLAKRFSK

SEQ ID NO: 250365 - protein, 9 aa, Dengue virus
SLSMTCVAV

SEQ ID NO: 250366 - protein, 9 aa, Dengue virus
MLIPKTYAG

SEQ ID NO: 250367 - protein, 9 aa, Dengue virus
FLNEDHWFS

SEQ ID NO: 250368 - protein, 9 aa, Dengue virus
RKMIRPQPM

SEQ ID NO: 250369 - protein, 9 aa, Dengue virus
EQGKRTLTL

SEQ ID NO: 250370 - protein, 9 aa, Dengue virus
VMASSVLLW

SEQ ID NO: 250371 - protein, 9 aa, Dengue virus
GMALLLEEM

SEQ ID NO: 250372 - protein, 9 aa, Dengue virus
AILLVTVSF

SEQ ID NO: 250373 - protein, 9 aa, Dengue virus
MPVTVASAA

SEQ ID NO: 250374 - protein, 9 aa, Dengue virus
AAWYLWEVK

SEQ ID NO: 250375 - protein, 9 aa, Dengue virus
AQWQKGEEV

SEQ ID NO: 250376 - protein, 9 aa, Dengue virus
YVVIAILTL

SEQ ID NO: 250377 - protein, 9 aa, Dengue virus
IAIGIITLY

SEQ ID NO: 250378 - protein, 9 aa, Dengue virus
KSYAGPFSH

SEQ ID NO: 250379 - protein, 9 aa, Dengue virus
SVGKLVHQV

SEQ ID NO: 250380 - protein, 9 aa, Dengue virus
SPATAQKAT

SEQ ID NO: 250381 - protein, 9 aa, Dengue virus
TMFGGVSWM

SEQ ID NO: 250382 - protein, 9 aa, Dengue virus
CVTTMAEDK

SEQ ID NO: 250383 - protein, 9 aa, Dengue virus
ALFSGVSWI

SEQ ID NO: 250384 - protein, 9 aa, Dengue virus
NRRKRSTIT

SEQ ID NO: 250385 - protein, 9 aa, Dengue virus
MMVLKMVRK

SEQ ID NO: 250386 - protein, 9 aa, Dengue virus
YVLGVFLRR

SEQ ID NO: 250387 - protein, 9 aa, Dengue virus
TLTAALLLL

SEQ ID NO: 250388 - protein, 9 aa, Dengue virus
TMKIGIGAL

SEQ ID NO: 250389 - protein, 9 aa, Dengue virus
RPGYYTQTA

SEQ ID NO: 250390 - protein, 9 aa, Dengue virus
MGYWIESEK

SEQ ID NO: 250391 - protein, 9 aa, Dengue virus
YMPSVIEKM

SEQ ID NO: 250392 - protein, 9 aa, Dengue virus
KMVVHFDNA

SEQ ID NO: 250393 - protein, 9 aa, Dengue virus
LAYRTRNAL

SEQ ID NO: 250394 - protein, 9 aa, Dengue virus
ASEMAEALK

SEQ ID NO: 250395 - protein, 9 aa, Dengue virus
LLTKPWDVV

SEQ ID NO: 250396 - protein, 9 aa, Dengue virus
AIGTSITQK

SEQ ID NO: 250397 - protein, 9 aa, Dengue virus
SGMLWMAEV

SEQ ID NO: 250398 - protein, 9 aa, Dengue virus
IMMIPTVVA

SEQ ID NO: 250399 - protein, 9 aa, Dengue virus
MVLLTMKKK

SEQ ID NO: 250400 - protein, 9 aa, Dengue virus
KLTLKGTSY

SEQ ID NO: 250401 - protein, 9 aa, Dengue virus
MISYGGGWR

SEQ ID NO: 250402 - protein, 9 aa, Dengue virus
SSMVNGVVK

SEQ ID NO: 250403 - protein, 9 aa, Dengue virus
MDLEKRHVL

SEQ ID NO: 250404 - protein, 9 aa, Dengue virus
GTFHTMWHV

SEQ ID NO: 250405 - protein, 9 aa, Dengue virus
CWCNLTSTW

SEQ ID NO: 250406 - protein, 9 aa, Dengue virus
FNIYKRSGI

SEQ ID NO: 250407 - protein, 9 aa, Dengue virus
AAGPWHLGK

SEQ ID NO: 250408 - protein, 9 aa, Dengue virus
GLSSRATWA

SEQ ID NO: 250409 - protein, 9 aa, Dengue virus
NLVSSLVTA

SEQ ID NO: 250410 - protein, 9 aa, Dengue virus
SLQPQPTEL

SEQ ID NO: 250411 - protein, 9 aa, Dengue virus
VIFTLLMLV

SEQ ID NO: 250412 - protein, 9 aa, Dengue virus
VIIMLIPTV

SEQ ID NO: 250413 - protein, 9 aa, Dengue virus
YMPSVVETL

SEQ ID NO: 250414 - protein, 9 aa, Dengue virus
ILMMLVAPS

SEQ ID NO: 250415 - protein, 9 aa, Dengue virus
VSSWGDVPY

SEQ ID NO: 250416 - protein, 9 aa, Dengue virus
RPTPKGAVM

SEQ ID NO: 250417 - protein, 9 aa, Dengue virus
VLNPYMPTV

SEQ ID NO: 250418 - protein, 9 aa, Dengue virus
INRRKRTSL

SEQ ID NO: 250419 - protein, 9 aa, Dengue virus
LMLVAHYAI

SEQ ID NO: 250420 - protein, 9 aa, Dengue virus
KSYAQMWSL

SEQ ID NO: 250421 - protein, 9 aa, Dengue virus
ALLAGFMAY

SEQ ID NO: 250422 - protein, 9 aa, Dengue virus
VMAAILAYT

SEQ ID NO: 250423 - protein, 9 aa, Dengue virus
SLTQKVVIF

SEQ ID NO: 250424 - protein, 9 aa, Dengue virus
TSGSPIIDK

SEQ ID NO: 250425 - protein, 9 aa, Dengue virus
MLNIMNRRK

SEQ ID NO: 250426 - protein, 9 aa, Dengue virus
GVLARWGTF

SEQ ID NO: 250427 - protein, 9 aa, Dengue virus
AVKNWLARV

SEQ ID NO: 250428 - protein, 9 aa, Dengue virus
ILLVAVSLV

SEQ ID NO: 250429 - protein, 9 aa, Dengue virus
LVMKDGRVL

SEQ ID NO: 250430 - protein, 9 aa, Dengue virus
IAFLRFLAI

SEQ ID NO: 250431 - protein, 9 aa, Dengue virus
LINRFTMRY

SEQ ID NO: 250432 - protein, 9 aa, Dengue virus
RIISSIPFA

SEQ ID NO: 250433 - protein, 9 aa, Dengue virus
RPGYHTQIT

SEQ ID NO: 250434 - protein, 9 aa, Dengue virus
SGSPIINRK

SEQ ID NO: 250435 - protein, 9 aa, Dengue virus
IVAEKDSPV

SEQ ID NO: 250436 - protein, 9 aa, Dengue virus
VPNYNLIIM

SEQ ID NO: 250437 - protein, 9 aa, Dengue virus
SVKKDLISY

SEQ ID NO: 250438 - protein, 9 aa, Dengue virus
EMILMKMEK

SEQ ID NO: 250439 - protein, 9 aa, Dengue virus
FIKSTMPLV

SEQ ID NO: 250440 - protein, 9 aa, Dengue virus
IYSDPLALK

SEQ ID NO: 250441 - protein, 9 aa, Dengue virus
LTTLSRPNK

SEQ ID NO: 250442 - protein, 9 aa, Dengue virus
LPIRYQTPA

SEQ ID NO: 250443 - protein, 9 aa, Dengue virus
KVDNFTMGV

SEQ ID NO: 250444 - protein, 9 aa, Dengue virus
KPEGKVIDL

SEQ ID NO: 250445 - protein, 9 aa, Dengue virus
MVLKMVRNM

SEQ ID NO: 250446 - protein, 9 aa, Dengue virus
VMILQHAWK

SEQ ID NO: 250447 - protein, 9 aa, Dengue virus
FSGVSWTMK

SEQ ID NO: 250448 - protein, 9 aa, Dengue virus
LPWTSGALT

SEQ ID NO: 250449 - protein, 9 aa, Dengue virus
RTEAKEGLK

SEQ ID NO: 250450 - protein, 9 aa, Dengue virus
SMVNGVVKL

SEQ ID NO: 250451 - protein, 9 aa, Dengue virus
YAQMWSLMY

SEQ ID NO: 250452 - protein, 9 aa, Dengue virus
WMSSEGAWK

SEQ ID NO: 250453 - protein, 9 aa, Dengue virus
SWFKKGSSI

SEQ ID NO: 250454 - protein, 9 aa, Dengue virus
ILLTGGVML

SEQ ID NO: 250455 - protein, 9 aa, Dengue virus
SMCTGKFKV

SEQ ID NO: 250456 - protein, 9 aa, Dengue virus
FTVTALFLA

SEQ ID NO: 250457 - protein, 9 aa, Dengue virus
NRRRRTAGV

SEQ ID NO: 250458 - protein, 9 aa, Dengue virus
RTVGVIIML

SEQ ID NO: 250459 - protein, 9 aa, Dengue virus
RPAKNGTVM

SEQ ID NO: 250460 - protein, 9 aa, Dengue virus
TVITPMMRH

SEQ ID NO: 250461 - protein, 9 aa, Dengue virus
GIFTTNIWL

SEQ ID NO: 250462 - protein, 9 aa, Dengue virus
MSSSALLWM

SEQ ID NO: 250463 - protein, 9 aa, Dengue virus
MITPRSPSV

SEQ ID NO: 250464 - protein, 9 aa, Dengue virus
AYVVIGLLF

SEQ ID NO: 250465 - protein, 9 aa, Dengue virus
KLGKCGSCV

SEQ ID NO: 250466 - protein, 9 aa, Dengue virus
MILSIVSLL

SEQ ID NO: 250467 - protein, 9 aa, Dengue virus
MILLTGGVM

SEQ ID NO: 250468 - protein, 9 aa, Dengue virus
WLWALLGRK

SEQ ID NO: 250469 - protein, 9 aa, Dengue virus
AMHTALTGA

SEQ ID NO: 250470 - protein, 9 aa, Dengue virus
KQVANELNY

SEQ ID NO: 250471 - protein, 9 aa, Dengue virus
FLDYMPSMK

SEQ ID NO: 250472 - protein, 9 aa, Dengue virus
TIMAVLFVV

SEQ ID NO: 250473 - protein, 9 aa, Dengue virus
GLFKTNAGT

SEQ ID NO: 250474 - protein, 9 aa, Dengue virus
KLTTQFETY

SEQ ID NO: 250475 - protein, 9 aa, Dengue virus
NWFKKGSSI

SEQ ID NO: 250476 - protein, 9 aa, Dengue virus
MVEPWLSSK

SEQ ID NO: 250477 - protein, 9 aa, Dengue virus
KLTLRGMSY

SEQ ID NO: 250478 - protein, 9 aa, Dengue virus
KVTQWLETK

SEQ ID NO: 250479 - protein, 9 aa, Dengue virus
VIALFLAHA

SEQ ID NO: 250480 - protein, 9 aa, Dengue virus
MDLEKRHAL

SEQ ID NO: 250481 - protein, 9 aa, Dengue virus
NMGMGTTYL

SEQ ID NO: 250482 - protein, 9 aa, Dengue virus
LLAAVAPSM

SEQ ID NO: 250483 - protein, 9 aa, Dengue virus
QTTGTTTIF

SEQ ID NO: 250484 - protein, 9 aa, Dengue virus
NFVCRRTLV

SEQ ID NO: 250485 - protein, 9 aa, Dengue virus
HWPKSHTLW

SEQ ID NO: 250486 - protein, 9 aa, Dengue virus
SVSLVLVGI

SEQ ID NO: 250487 - protein, 9 aa, Dengue virus
YFHRRDLRL

SEQ ID NO: 250488 - protein, 9 aa, Dengue virus
RKKARNTPF

SEQ ID NO: 250489 - protein, 9 aa, Dengue virus
KLREVYTQL

SEQ ID NO: 250490 - protein, 9 aa, Dengue virus
KMKAKTWLV

SEQ ID NO: 250491 - protein, 9 aa, Dengue virus
SIGKALHQV

SEQ ID NO: 250492 - protein, 9 aa, Dengue virus
ITASGLLWY

SEQ ID NO: 250493 - protein, 9 aa, Dengue virus
SQMLIPKSY

SEQ ID NO: 250494 - protein, 9 aa, Dengue virus
AVSTANIFR

SEQ ID NO: 250495 - protein, 9 aa, Dengue virus
VSWKSKELK

SEQ ID NO: 250496 - protein, 9 aa, Dengue virus
GPMVAGGLL

SEQ ID NO: 250497 - protein, 9 aa, Dengue virus
ALLTIISLI

SEQ ID NO: 250498 - protein, 9 aa, Dengue virus
AIRRGLRTL

SEQ ID NO: 250499 - protein, 9 aa, Dengue virus
IPKAYAGPF

SEQ ID NO: 250500 - protein, 9 aa, Dengue virus
TFKMRPMLA

SEQ ID NO: 250501 - protein, 9 aa, Dengue virus
RVTRKHMIL

SEQ ID NO: 250502 - protein, 9 aa, Dengue virus
ASWSGKELK

SEQ ID NO: 250503 - protein, 9 aa, Dengue virus
SQSTIPETV

SEQ ID NO: 250504 - protein, 9 aa, Dengue virus
WTTLLSLTF

SEQ ID NO: 250505 - protein, 9 aa, Dengue virus
KATGSASSM

SEQ ID NO: 250506 - protein, 9 aa, Dengue virus
YLDFMTSMK

SEQ ID NO: 250507 - protein, 9 aa, Dengue virus
IALGIMVLK

SEQ ID NO: 250508 - protein, 9 aa, Dengue virus
LVISGLFPV

SEQ ID NO: 250509 - protein, 9 aa, Dengue virus
WQIERASLI

SEQ ID NO: 250510 - protein, 9 aa, Dengue virus
CVTTMAKSK

SEQ ID NO: 250511 - protein, 9 aa, Dengue virus
QLASAIFKL

SEQ ID NO: 250512 - protein, 9 aa, Dengue virus
QLKGMSYSM

SEQ ID NO: 250513 - protein, 9 aa, Dengue virus
NVFHTMWHV

SEQ ID NO: 250514 - protein, 9 aa, Dengue virus
TYLSSKAKL

SEQ ID NO: 250515 - protein, 9 aa, Dengue virus
STGSQLAKR

SEQ ID NO: 250516 - protein, 9 aa, Dengue virus
ILKRWGQLK

SEQ ID NO: 250517 - protein, 9 aa, Dengue virus
RQMEGEGVL

SEQ ID NO: 250518 - protein, 9 aa, Dengue virus
RVPSHLAYR

SEQ ID NO: 250519 - protein, 9 aa, Dengue virus
QLWAALVSL

SEQ ID NO: 250520 - protein, 9 aa, Dengue virus
SYYCAGLKK

SEQ ID NO: 250521 - protein, 9 aa, Dengue virus
LNGRKRSTM

SEQ ID NO: 250522 - protein, 9 aa, Dengue virus
IAASIILEF

SEQ ID NO: 250523 - protein, 9 aa, Dengue virus
LTTLSRTNK

SEQ ID NO: 250524 - protein, 9 aa, Dengue virus
KLVHQVFGT

SEQ ID NO: 250525 - protein, 9 aa, Dengue virus
MLLMLLPTA

SEQ ID NO: 250526 - protein, 9 aa, Dengue virus
TLTAAVLLL

SEQ ID NO: 250527 - protein, 9 aa, Dengue virus
WITLLSLTF

SEQ ID NO: 250528 - protein, 9 aa, Dengue virus
AVILQNAWK

SEQ ID NO: 250529 - protein, 9 aa, Dengue virus
CIAVGLITL

SEQ ID NO: 250530 - protein, 9 aa, Dengue virus
KLHSGKDVF

SEQ ID NO: 250531 - protein, 9 aa, Dengue virus
LLILCTSQI

SEQ ID NO: 250532 - protein, 9 aa, Dengue virus
NGRRRSTIT

SEQ ID NO: 250533 - protein, 9 aa, Dengue virus
TQIMEVTAK

SEQ ID NO: 250534 - protein, 9 aa, Dengue virus
YQNKVVKVL

SEQ ID NO: 250535 - protein, 9 aa, Dengue virus
NYADRKWCF

SEQ ID NO: 250536 - protein, 9 aa, Dengue virus
NTGETLGEK

SEQ ID NO: 250537 - protein, 9 aa, Dengue virus
GSSPIVEVK

SEQ ID NO: 250538 - protein, 9 aa, Dengue virus
TLMKGASKR

SEQ ID NO: 250539 - protein, 9 aa, Dengue virus
WPRSHTLWS

SEQ ID NO: 250540 - protein, 9 aa, Dengue virus
LTLKGMSYV

SEQ ID NO: 250541 - protein, 9 aa, Dengue virus
AVILRNAWK

SEQ ID NO: 250542 - protein, 9 aa, Dengue virus
NRRRRSAGM

SEQ ID NO: 250543 - protein, 9 aa, Dengue virus
VMLLVLCAV

SEQ ID NO: 250544 - protein, 9 aa, Dengue virus
TANPIVIDK

SEQ ID NO: 250545 - protein, 9 aa, Dengue virus
MLKRARNRV

SEQ ID NO: 250546 - protein, 9 aa, Dengue virus
ISSWGDVPY

SEQ ID NO: 250547 - protein, 9 aa, Dengue virus
GVVTTSGTY

SEQ ID NO: 250548 - protein, 9 aa, Dengue virus
CPTQGEPTL

SEQ ID NO: 250549 - protein, 9 aa, Dengue virus
TVNPIVAEK

SEQ ID NO: 250550 - protein, 9 aa, Dengue virus
TWRDMTHTL

SEQ ID NO: 250551 - protein, 9 aa, Dengue virus
SMSFSCIVI

SEQ ID NO: 250552 - protein, 9 aa, Dengue virus
FMTATPPGT

SEQ ID NO: 250553 - protein, 9 aa, Dengue virus
PTLDFELIK

SEQ ID NO: 250554 - protein, 9 aa, Dengue virus
ITANPVVIK

SEQ ID NO: 250555 - protein, 9 aa, Dengue virus
VSWNGKELK

SEQ ID NO: 250556 - protein, 9 aa, Dengue virus
LLKATLLAV

SEQ ID NO: 250557 - protein, 9 aa, Dengue virus
SLTFVKTTF

SEQ ID NO: 250558 - protein, 9 aa, Dengue virus
LAAFRVRPT

SEQ ID NO: 250559 - protein, 9 aa, Dengue virus
LMCHATFTT

SEQ ID NO: 250560 - protein, 9 aa, Dengue virus
VLFTFVLLL

SEQ ID NO: 250561 - protein, 9 aa, Dengue virus
TWRDMAHTL

SEQ ID NO: 250562 - protein, 9 aa, Dengue virus
AILAYTIGT

SEQ ID NO: 250563 - protein, 9 aa, Dengue virus
VILRNAWKV

SEQ ID NO: 250564 - protein, 9 aa, Dengue virus
AENHHHAAM

SEQ ID NO: 250565 - protein, 9 aa, Dengue virus
SGYDWITDF

SEQ ID NO: 250566 - protein, 9 aa, Dengue virus
HMIAGVFFT

SEQ ID NO: 250567 - protein, 9 aa, Dengue virus
LWPKTHTLW

SEQ ID NO: 250568 - protein, 9 aa, Dengue virus
ITYKCPLLR

SEQ ID NO: 250569 - protein, 9 aa, Dengue virus
GLVSLLGSA

SEQ ID NO: 250570 - protein, 9 aa, Dengue virus
LMALDLGEL

SEQ ID NO: 250571 - protein, 9 aa, Dengue virus
VSTIQQLTK

SEQ ID NO: 250572 - protein, 9 aa, Dengue virus
SSVNMISRM

SEQ ID NO: 250573 - protein, 9 aa, Dengue virus
KQPATLRKY

SEQ ID NO: 250574 - protein, 9 aa, Dengue virus
WLKLREMYT

SEQ ID NO: 250575 - protein, 9 aa, Dengue virus
LTGGVTLFF

SEQ ID NO: 250576 - protein, 9 aa, Dengue virus
VTAASAAQR

SEQ ID NO: 250577 - protein, 9 aa, Dengue virus
MLLMLVPTA

SEQ ID NO: 250578 - protein, 9 aa, Dengue virus
TSIFAGHLK

SEQ ID NO: 250579 - protein, 9 aa, Dengue virus
AFLAGFMAY

SEQ ID NO: 250580 - protein, 9 aa, Dengue virus
VVTNPAVLR

SEQ ID NO: 250581 - protein, 9 aa, Dengue virus
FVWHFWQKK

SEQ ID NO: 250582 - protein, 9 aa, Dengue virus
QLTYVVIAI

SEQ ID NO: 250583 - protein, 9 aa, Dengue virus
TSGSPIVDK

SEQ ID NO: 250584 - protein, 9 aa, Dengue virus
ASAILNAHK

SEQ ID NO: 250585 - protein, 9 aa, Dengue virus
HWFRKGSSI

SEQ ID NO: 250586 - protein, 9 aa, Dengue virus
WIMKIGIGI

SEQ ID NO: 250587 - protein, 9 aa, Dengue virus
LGRKKNPRL

SEQ ID NO: 250588 - protein, 9 aa, Dengue virus
WTMKIGIGV

SEQ ID NO: 250589 - protein, 9 aa, Dengue virus
KTFDSEYVK

SEQ ID NO: 250590 - protein, 9 aa, Dengue virus
ISLGLILLK

SEQ ID NO: 250591 - protein, 9 aa, Dengue virus
LQKTEATQL

SEQ ID NO: 250592 - protein, 9 aa, Dengue virus
FIFSLKDTL

SEQ ID NO: 250593 - protein, 9 aa, Dengue virus
KADNFTMGV

SEQ ID NO: 250594 - protein, 9 aa, Dengue virus
QVLALEPGK

SEQ ID NO: 250595 - protein, 9 aa, Dengue virus
EMILMRMKK

SEQ ID NO: 250596 - protein, 9 aa, Dengue virus
EMVLLTMKK

SEQ ID NO: 250597 - protein, 9 aa, Dengue virus
VVIAILTVV

SEQ ID NO: 250598 - protein, 9 aa, Dengue virus
GTAVVKVKY

SEQ ID NO: 250599 - protein, 9 aa, Dengue virus
VTFKNAHAK

SEQ ID NO: 250600 - protein, 9 aa, Dengue virus
VTASILLWY

SEQ ID NO: 250601 - protein, 9 aa, Dengue virus
MLIPRSYAG

SEQ ID NO: 250602 - protein, 9 aa, Dengue virus
LLMLLPTVL

SEQ ID NO: 250603 - protein, 9 aa, Dengue virus
TERLKRMAI

SEQ ID NO: 250604 - protein, 9 aa, Dengue virus
CTATGEHRR

SEQ ID NO: 250605 - protein, 9 aa, Dengue virus
LTAALLLLV

SEQ ID NO: 250606 - protein, 9 aa, Dengue virus
MLLVAVSFV

SEQ ID NO: 250607 - protein, 9 aa, Dengue virus
VSTVQQLTK

SEQ ID NO: 250608 - protein, 9 aa, Dengue virus
RLEPNWASV

SEQ ID NO: 250609 - protein, 9 aa, Dengue virus
KLKEKQDAF

SEQ ID NO: 250610 - protein, 9 aa, Dengue virus
TTNIWLKLR

SEQ ID NO: 250611 - protein, 9 aa, Dengue virus
KLVDREREL

SEQ ID NO: 250612 - protein, 9 aa, Dengue virus
VIDPRRCLK

SEQ ID NO: 250613 - protein, 9 aa, Dengue virus
CLWPKTHTL

SEQ ID NO: 250614 - protein, 9 aa, Dengue virus
NYILWENNI

SEQ ID NO: 250615 - protein, 9 aa, Dengue virus
YAMCLNAFV

SEQ ID NO: 250616 - protein, 9 aa, Dengue virus
TTETPTWNK

SEQ ID NO: 250617 - protein, 9 aa, Dengue virus
NMEKYQLAV

SEQ ID NO: 250618 - protein, 9 aa, Dengue virus
KWKRQLNSL

SEQ ID NO: 250619 - protein, 9 aa, Dengue virus
TLYAVATTV

SEQ ID NO: 250620 - protein, 9 aa, Dengue virus
SILASSLLR

SEQ ID NO: 250621 - protein, 9 aa, Dengue virus
IPVTPASAA

SEQ ID NO: 250622 - protein, 9 aa, Dengue virus
AINVLRGFR

SEQ ID NO: 250623 - protein, 9 aa, Dengue virus
SLMCANTIF

SEQ ID NO: 250624 - protein, 9 aa, Dengue virus
WLKLREVHT

SEQ ID NO: 250625 - protein, 9 aa, Dengue virus
LAHRTRNAL

SEQ ID NO: 250626 - protein, 9 aa, Dengue virus
GMGTTYLAL

SEQ ID NO: 250627 - protein, 9 aa, Dengue virus
KNQTWQIEK

SEQ ID NO: 250628 - protein, 9 aa, Dengue virus
GLLIACYVI

SEQ ID NO: 250629 - protein, 9 aa, Dengue virus
MMLVVVITL

SEQ ID NO: 250630 - protein, 9 aa, Dengue virus
SKIPGGAMY

SEQ ID NO: 250631 - protein, 9 aa, Dengue virus
GLNSRSASL

SEQ ID NO: 250632 - protein, 9 aa, Dengue virus
RVYADPMAL

SEQ ID NO: 250633 - protein, 9 aa, Dengue virus
VSSVNMVSR

SEQ ID NO: 250634 - protein, 9 aa, Dengue virus
FMAYMVGQT

SEQ ID NO: 250635 - protein, 9 aa, Dengue virus
LIAAVLMLV

SEQ ID NO: 250636 - protein, 9 aa, Dengue virus
ILGAQALPV

SEQ ID NO: 250637 - protein, 9 aa, Dengue virus
ITIAEDGSM

SEQ ID NO: 250638 - protein, 9 aa, Dengue virus
LAIPVTMTL

SEQ ID NO: 250639 - protein, 9 aa, Dengue virus
CAKFSCSEK

SEQ ID NO: 250640 - protein, 9 aa, Dengue virus
TVTEEVAVK

SEQ ID NO: 250641 - protein, 9 aa, Dengue virus
IVMLHTTEK

SEQ ID NO: 250642 - protein, 9 aa, Dengue virus
PLNEGIMAI

SEQ ID NO: 250643 - protein, 9 aa, Dengue virus
GLKKVTEVK

SEQ ID NO: 250644 - protein, 9 aa, Dengue virus
SQMLIPKAY

SEQ ID NO: 250645 - protein, 9 aa, Dengue virus
SQASTAEAI

SEQ ID NO: 250646 - protein, 9 aa, Dengue virus
IPMTGPLVA

SEQ ID NO: 250647 - protein, 9 aa, Dengue virus
MLRTRIGTK

SEQ ID NO: 250648 - protein, 9 aa, Dengue virus
QLSKSEFNI

SEQ ID NO: 250649 - protein, 9 aa, Dengue virus
TMFTLTVAW

SEQ ID NO: 250650 - protein, 9 aa, Dengue virus
EMKKKTWLV

SEQ ID NO: 250651 - protein, 9 aa, Dengue virus
AYMIGQTRI

SEQ ID NO: 250652 - protein, 9 aa, Dengue virus
KLYSGKDVF

SEQ ID NO: 250653 - protein, 9 aa, Dengue virus
VLLLITHYA

SEQ ID NO: 250654 - protein, 9 aa, Dengue virus
APFESEGVL

SEQ ID NO: 250655 - protein, 9 aa, Dengue virus
MVLSIVSLL

SEQ ID NO: 250656 - protein, 9 aa, Dengue virus
SPGYVLGIF

SEQ ID NO: 250657 - protein, 9 aa, Dengue virus
LLIACYVIT

SEQ ID NO: 250658 - protein, 9 aa, Dengue virus
MALFLAHAI

SEQ ID NO: 250659 - protein, 9 aa, Dengue virus
KLTSRETAL

SEQ ID NO: 250660 - protein, 9 aa, Dengue virus
KMLMTGILA

SEQ ID NO: 250661 - protein, 9 aa, Dengue virus
IQTTGTTTI

SEQ ID NO: 250662 - protein, 9 aa, Dengue virus
MTLKLITQF

SEQ ID NO: 250663 - protein, 9 aa, Dengue virus
KAVHADMGY

SEQ ID NO: 250664 - protein, 9 aa, Dengue virus
SYLAGAGLL

SEQ ID NO: 250665 - protein, 9 aa, Dengue virus
ALMATFRMR

SEQ ID NO: 250666 - protein, 9 aa, Dengue virus
FSIGLFSGK

SEQ ID NO: 250667 - protein, 9 aa, Dengue virus
ALSEGVYRI

SEQ ID NO: 250668 - protein, 9 aa, Dengue virus
YVFSGDPLR

SEQ ID NO: 250669 - protein, 9 aa, Dengue virus
YVLGIFLRR

SEQ ID NO: 250670 - protein, 9 aa, Dengue virus
YVDYMPVMK

SEQ ID NO: 250671 - protein, 9 aa, Dengue virus
PVYLMTLMK

SEQ ID NO: 250672 - protein, 9 aa, Dengue virus
KMFESTYRG

SEQ ID NO: 250673 - protein, 9 aa, Dengue virus
LQRQYGGAL

SEQ ID NO: 250674 - protein, 9 aa, Dengue virus
MVLLQMESK

SEQ ID NO: 250675 - protein, 9 aa, Dengue virus
VYADPMALK

SEQ ID NO: 250676 - protein, 9 aa, Dengue virus
FIRSTMSLV

SEQ ID NO: 250677 - protein, 9 aa, Dengue virus
GGKAYRHAV

SEQ ID NO: 250678 - protein, 9 aa, Dengue virus
QLIYVILTI

SEQ ID NO: 250679 - protein, 9 aa, Dengue virus
TMAAILAYT

SEQ ID NO: 250680 - protein, 9 aa, Dengue virus
IQKEMLVTF

SEQ ID NO: 250681 - protein, 9 aa, Dengue virus
NQAVVLMGL

SEQ ID NO: 250682 - protein, 9 aa, Dengue virus
KRKLRTLVL

SEQ ID NO: 250683 - protein, 9 aa, Dengue virus
SLTFVRTTF

SEQ ID NO: 250684 - protein, 9 aa, Dengue virus
AVEPGKNPK

SEQ ID NO: 250685 - protein, 9 aa, Dengue virus
LTASLVMLL

SEQ ID NO: 250686 - protein, 9 aa, Dengue virus
MRGAKRMAI

SEQ ID NO: 250687 - protein, 9 aa, Dengue virus
HMIVGIQEK

SEQ ID NO: 250688 - protein, 9 aa, Dengue virus
MIGQTGIQR

SEQ ID NO: 250689 - protein, 9 aa, Dengue virus
VIGLYGNGV

SEQ ID NO: 250690 - protein, 9 aa, Dengue virus
ILLKIVTQF

SEQ ID NO: 250691 - protein, 9 aa, Dengue virus
SYAMCTNTF

SEQ ID NO: 250692 - protein, 9 aa, Dengue virus
TPIWNRKEL

SEQ ID NO: 250693 - protein, 9 aa, Dengue virus
NLVRLQSGV

SEQ ID NO: 250694 - protein, 9 aa, Dengue virus
LLTAVAPSM

SEQ ID NO: 250695 - protein, 9 aa, Dengue virus
YQLAVTIMT

SEQ ID NO: 250696 - protein, 9 aa, Dengue virus
IVIGIITLY

SEQ ID NO: 250697 - protein, 9 aa, Dengue virus
GLLFMILTV

SEQ ID NO: 250698 - protein, 9 aa, Dengue virus
TVMDIISRK

SEQ ID NO: 250699 - protein, 9 aa, Dengue virus
VARPPFNML

SEQ ID NO: 250700 - protein, 9 aa, Dengue virus
RMGMGVTYL

SEQ ID NO: 250701 - protein, 9 aa, Dengue virus
TIAVASGLF

SEQ ID NO: 250702 - protein, 9 aa, Dengue virus
TTVITPMLR

SEQ ID NO: 250703 - protein, 9 aa, Dengue virus
LLMLLPTAM

SEQ ID NO: 250704 - protein, 9 aa, Dengue virus
KLMRITAEW

SEQ ID NO: 250705 - protein, 9 aa, Dengue virus
WTMKIGIGI

SEQ ID NO: 250706 - protein, 9 aa, Dengue virus
KLHSGVDVF

SEQ ID NO: 250707 - protein, 9 aa, Dengue virus
MTQKTRDAL

SEQ ID NO: 250708 - protein, 9 aa, Dengue virus
TVNPIITEK

SEQ ID NO: 250709 - protein, 9 aa, Dengue virus
MIAGVFLTF

SEQ ID NO: 250710 - protein, 9 aa, Dengue virus
LLVAASFVT

SEQ ID NO: 250711 - protein, 9 aa, Dengue virus
LNGRRRSTI

SEQ ID NO: 250712 - protein, 9 aa, Dengue virus
GLNSKNISM

SEQ ID NO: 250713 - protein, 9 aa, Dengue virus
MTGTLAVFF

SEQ ID NO: 250714 - protein, 9 aa, Dengue virus
LVMILPAAL

SEQ ID NO: 250715 - protein, 9 aa, Dengue virus
KMVRDMEKY

SEQ ID NO: 250716 - protein, 9 aa, Dengue virus
STIQQLTKR

SEQ ID NO: 250717 - protein, 9 aa, Dengue virus
AVLAYTIGT

SEQ ID NO: 250718 - protein, 9 aa, Dengue virus
CLQKQSHWI

SEQ ID NO: 250719 - protein, 9 aa, Dengue virus
EVKSCHWPK

SEQ ID NO: 250720 - protein, 9 aa, Dengue virus
TANPVVIKK

SEQ ID NO: 250721 - protein, 9 aa, Dengue virus
LLFMILTVA

SEQ ID NO: 250722 - protein, 9 aa, Dengue virus
WGKAKMLST

SEQ ID NO: 250723 - protein, 9 aa, Dengue virus
TLLAISGVY

SEQ ID NO: 250724 - protein, 9 aa, Dengue virus
NRRRRTVGM

SEQ ID NO: 250725 - protein, 9 aa, Dengue virus
ISKVRSNAA

SEQ ID NO: 250726 - protein, 9 aa, Dengue virus
TLKLSWFKK

SEQ ID NO: 250727 - protein, 9 aa, Dengue virus
TTWEDVPYL

SEQ ID NO: 250728 - protein, 9 aa, Dengue virus
CYWPRSHTL

SEQ ID NO: 250729 - protein, 9 aa, Dengue virus
VPTVTQMAM

SEQ ID NO: 250730 - protein, 9 aa, Dengue virus
FLSGRGLGK

SEQ ID NO: 250731 - protein, 9 aa, Dengue virus
VMRSRWSRK

SEQ ID NO: 250732 - protein, 9 aa, Dengue virus
TMFKMSPGY

SEQ ID NO: 250733 - protein, 9 aa, Dengue virus
YVVIAILTV

SEQ ID NO: 250734 - protein, 9 aa, Dengue virus
KTFVELMRR

SEQ ID NO: 250735 - protein, 9 aa, Dengue virus
TILIKVEYK

SEQ ID NO: 250736 - protein, 9 aa, Dengue virus
VTFKTAHAK

SEQ ID NO: 250737 - protein, 9 aa, Dengue virus
ILTDGPERV

SEQ ID NO: 250738 - protein, 9 aa, Dengue virus
EVKTCLWPK

SEQ ID NO: 250739 - protein, 9 aa, Dengue virus
KMRDSYTQV

SEQ ID NO: 250740 - protein, 9 aa, Dengue virus
ILNRRRRTV

SEQ ID NO: 250741 - protein, 9 aa, Dengue virus
RPMPGTRRV

SEQ ID NO: 250742 - protein, 9 aa, Dengue virus
SLRPQPTEL

SEQ ID NO: 250743 - protein, 9 aa, Dengue virus
ILCTSQILL

SEQ ID NO: 250744 - protein, 9 aa, Dengue virus
MAMTTVFSI

SEQ ID NO: 250745 - protein, 9 aa, Dengue virus
CLMMMLPAT

SEQ ID NO: 250746 - protein, 9 aa, Dengue virus
LALGMMVLK

SEQ ID NO: 250747 - protein, 9 aa, Dengue virus
FQSHQLWAT

SEQ ID NO: 250748 - protein, 9 aa, Dengue virus
MIIMLIPTV

SEQ ID NO: 250749 - protein, 9 aa, Dengue virus
MILMEMRKK

SEQ ID NO: 250750 - protein, 9 aa, Dengue virus
MILMKMKGK

SEQ ID NO: 250751 - protein, 9 aa, Dengue virus
KLLTEFQPH

SEQ ID NO: 250752 - protein, 9 aa, Dengue virus
TPQAPSTEI

SEQ ID NO: 250753 - protein, 9 aa, Dengue virus
GAVLTHNGK

SEQ ID NO: 250754 - protein, 9 aa, Dengue virus
PLNEAVMAV

SEQ ID NO: 250755 - protein, 9 aa, Dengue virus
VTLFFLSGK

SEQ ID NO: 250756 - protein, 9 aa, Dengue virus
MADDIGMGV

SEQ ID NO: 250757 - protein, 9 aa, Dengue virus
ITYKCPFLR

SEQ ID NO: 250758 - protein, 9 aa, Dengue virus
LMSGKGVGK

SEQ ID NO: 250759 - protein, 9 aa, Dengue virus
TANPVVTKK

SEQ ID NO: 250760 - protein, 9 aa, Dengue virus
RTAGVIIML

SEQ ID NO: 250761 - protein, 9 aa, Dengue virus
WMIRILIGL

SEQ ID NO: 250762 - protein, 9 aa, Dengue virus
LFMALVAFL

SEQ ID NO: 250763 - protein, 9 aa, Dengue virus
TLWEGSPGK

SEQ ID NO: 250764 - protein, 9 aa, Dengue virus
KLMKITAEW

SEQ ID NO: 250765 - protein, 9 aa, Dengue virus
TMAMVLSIV

SEQ ID NO: 250766 - protein, 9 aa, Dengue virus
MVKPKGKVV

SEQ ID NO: 250767 - protein, 9 aa, Dengue virus
MAMTTVLSI

SEQ ID NO: 250768 - protein, 9 aa, Dengue virus
ILARWGTFK

SEQ ID NO: 250769 - protein, 9 aa, Dengue virus
RIKGMSYTM

SEQ ID NO: 250770 - protein, 9 aa, Dengue virus
KLIHQIFGT

SEQ ID NO: 250771 - protein, 9 aa, Dengue virus
AILAGFMAY

SEQ ID NO: 250772 - protein, 9 aa, Dengue virus
QLADYGALT

SEQ ID NO: 250773 - protein, 9 aa, Dengue virus
TYLSSRAKL

SEQ ID NO: 250774 - protein, 9 aa, Dengue virus
GLGKTSIGL

SEQ ID NO: 250775 - protein, 9 aa, Dengue virus
GSCVTTMAK

SEQ ID NO: 250776 - protein, 9 aa, Dengue virus
VLVGVVTLY

SEQ ID NO: 250777 - protein, 9 aa, Dengue virus
LVLVGIVTL

SEQ ID NO: 250778 - protein, 9 aa, Dengue virus
VMLSVHYAI

SEQ ID NO: 250779 - protein, 9 aa, Dengue virus
MWKQITPEL

SEQ ID NO: 250780 - protein, 9 aa, Dengue virus
TKKVRTNAA

SEQ ID NO: 250781 - protein, 9 aa, Dengue virus
LSRKEFDLY

SEQ ID NO: 250782 - protein, 9 aa, Dengue virus
VLSLVENWL

SEQ ID NO: 250783 - protein, 9 aa, Dengue virus
LTDAIALGI

SEQ ID NO: 250784 - protein, 9 aa, Dengue virus
FIKKVRTNA

SEQ ID NO: 250785 - protein, 9 aa, Dengue virus
SPGTSGSPI

SEQ ID NO: 250786 - protein, 9 aa, Dengue virus
TQDDMQNPK

SEQ ID NO: 250787 - protein, 9 aa, Dengue virus
LMAAVLAYT

SEQ ID NO: 250788 - protein, 9 aa, Dengue virus
ASAIFKLTY

SEQ ID NO: 250789 - protein, 9 aa, Dengue virus
RMLINRFTM

SEQ ID NO: 250790 - protein, 9 aa, Dengue virus
SLSLDYAWK

SEQ ID NO: 250791 - protein, 9 aa, Dengue virus
MLLNRFTMA

SEQ ID NO: 250792 - protein, 9 aa, Dengue virus
LLFKTGDGV

SEQ ID NO: 250793 - protein, 9 aa, Dengue virus
LQRKYGGML

SEQ ID NO: 250794 - protein, 9 aa, Dengue virus
TVVEHLERL

SEQ ID NO: 250795 - protein, 9 aa, Dengue virus
MLWMAEVPL

SEQ ID NO: 250796 - protein, 9 aa, Dengue virus
KMGMGTTYL

SEQ ID NO: 250797 - protein, 9 aa, Dengue virus
FSSGLFSGK

SEQ ID NO: 250798 - protein, 9 aa, Dengue virus
MVLKIVRSM

SEQ ID NO: 250799 - protein, 9 aa, Dengue virus
KLQLKGMSY

SEQ ID NO: 250800 - protein, 9 aa, Dengue virus
LTLRGMSYV

SEQ ID NO: 250801 - protein, 9 aa, Dengue virus
LARWGTFKK

SEQ ID NO: 250802 - protein, 9 aa, Dengue virus
KPKGKVVDL

SEQ ID NO: 250803 - protein, 9 aa, Dengue virus
LTALNDMGK

SEQ ID NO: 250804 - protein, 9 aa, Dengue virus
LMLVALLGA

SEQ ID NO: 250805 - protein, 9 aa, Dengue virus
MMTTIGIVL

SEQ ID NO: 250806 - protein, 9 aa, Dengue virus
KTMAMVLSV

SEQ ID NO: 250807 - protein, 9 aa, Dengue virus
ELKGMSYAM

SEQ ID NO: 250808 - protein, 9 aa, Dengue virus
PMFAVGLLF

SEQ ID NO: 250809 - protein, 9 aa, Dengue virus
KSEFQIYKK

SEQ ID NO: 250810 - protein, 9 aa, Dengue virus
ASAWTLYAV

SEQ ID NO: 250811 - protein, 9 aa, Dengue virus
LLGRSQVGV

SEQ ID NO: 250812 - protein, 9 aa, Dengue virus
VENHHHASM

SEQ ID NO: 250813 - protein, 9 aa, Dengue virus
LLGKTQVGV

SEQ ID NO: 250814 - protein, 9 aa, Dengue virus
TMPETILEL

SEQ ID NO: 250815 - protein, 9 aa, Dengue virus
SLGILCASI

SEQ ID NO: 250816 - protein, 9 aa, Dengue virus
IQGSNWIQK

SEQ ID NO: 250817 - protein, 9 aa, Dengue virus
YVILAILTI

SEQ ID NO: 250818 - protein, 9 aa, Dengue virus
LMTGILAVF

SEQ ID NO: 250819 - protein, 9 aa, Dengue virus
KQSATLRKY

SEQ ID NO: 250820 - protein, 9 aa, Dengue virus
TFKMRPMFA

SEQ ID NO: 250821 - protein, 9 aa, Dengue virus
GIFPYSIPA

SEQ ID NO: 250822 - protein, 9 aa, Dengue virus
RLASAILNA

SEQ ID NO: 250823 - protein, 9 aa, Dengue virus
VIIMVGAAM

SEQ ID NO: 250824 - protein, 9 aa, Dengue virus
ILNRRRRSV

SEQ ID NO: 250825 - protein, 9 aa, Dengue virus
SPAATKKAA

SEQ ID NO: 250826 - protein, 9 aa, Dengue virus
LTNTTTDSR

SEQ ID NO: 250827 - protein, 9 aa, Dengue virus
TVLELTDAI

SEQ ID NO: 250828 - protein, 9 aa, Dengue virus
QLGQVMLLV

SEQ ID NO: 250829 - protein, 9 aa, Dengue virus
AAAWYLWEV

SEQ ID NO: 250830 - protein, 9 aa, Dengue virus
LQRKYGGAL

SEQ ID NO: 250831 - protein, 9 aa, Dengue virus
FLIDGPDTS

SEQ ID NO: 250832 - protein, 9 aa, Dengue virus
KPTEQVDTL

SEQ ID NO: 250833 - protein, 9 aa, Dengue virus
IPKSFAGPV

SEQ ID NO: 250834 - protein, 9 aa, Dengue virus
TVIAFFLAH

SEQ ID NO: 250835 - protein, 9 aa, Dengue virus
TMLLMLMPT

SEQ ID NO: 250836 - protein, 9 aa, Dengue virus
TLRGMSYVM

SEQ ID NO: 250837 - protein, 9 aa, Dengue virus
IWPKSHTLW

SEQ ID NO: 250838 - protein, 9 aa, Dengue virus
NGRKRSTMT

SEQ ID NO: 250839 - protein, 9 aa, Dengue virus
TLALALTFI

SEQ ID NO: 250840 - protein, 9 aa, Dengue virus
RFATALSAL

SEQ ID NO: 250841 - protein, 9 aa, Dengue virus
MSAAVKDNR

SEQ ID NO: 250842 - protein, 9 aa, Dengue virus
FMGHLKCRL

SEQ ID NO: 250843 - protein, 9 aa, Dengue virus
ATFTTRLLS

SEQ ID NO: 250844 - protein, 9 aa, Dengue virus
IQISGGTSI

SEQ ID NO: 250845 - protein, 9 aa, Dengue virus
LTLSLITEM

SEQ ID NO: 250846 - protein, 9 aa, Dengue virus
HPGFTVTAL

SEQ ID NO: 250847 - protein, 9 aa, Dengue virus
LLLNRFTMT

SEQ ID NO: 250848 - protein, 9 aa, Dengue virus
ALFSGVSWV

SEQ ID NO: 250849 - protein, 9 aa, Dengue virus
TLALSLTFI

SEQ ID NO: 250850 - protein, 9 aa, Dengue virus
MAMLCIPNV

SEQ ID NO: 250851 - protein, 9 aa, Dengue virus
GTIVVRVQY

SEQ ID NO: 250852 - protein, 9 aa, Dengue virus
KSKAISVLR

SEQ ID NO: 250853 - protein, 9 aa, Dengue virus
IAGVFLTFV

SEQ ID NO: 250854 - protein, 9 aa, Dengue virus
GLVSILASS

SEQ ID NO: 250855 - protein, 9 aa, Dengue virus
QLAVTIMAI

SEQ ID NO: 250856 - protein, 9 aa, Dengue virus
ALLATSIFK

SEQ ID NO: 250857 - protein, 9 aa, Dengue virus
IPMVTQIAM

SEQ ID NO: 250858 - protein, 9 aa, Dengue virus
TWPKSHTLW

SEQ ID NO: 250859 - protein, 9 aa, Dengue virus
WFLNLPLPW

SEQ ID NO: 250860 - protein, 9 aa, Dengue virus
ITANPVVTK

SEQ ID NO: 250861 - protein, 9 aa, Dengue virus
YVMCTGSFK

SEQ ID NO: 250862 - protein, 9 aa, Dengue virus
KLAEAIFKL

SEQ ID NO: 250863 - protein, 9 aa, Dengue virus
GQLKLSWFK

SEQ ID NO: 250864 - protein, 9 aa, Dengue virus
WLVHRQWFL

SEQ ID NO: 250865 - protein, 9 aa, Dengue virus
YWPRSHTLW

SEQ ID NO: 250866 - protein, 9 aa, Dengue virus
SNMLNIMNR

SEQ ID NO: 250867 - protein, 9 aa, Dengue virus
VVVGDVIGV

SEQ ID NO: 250868 - protein, 9 aa, Dengue virus
RLGYILEEI

SEQ ID NO: 250869 - protein, 9 aa, Dengue virus
AVVSVSPLL

SEQ ID NO: 250870 - protein, 9 aa, Dengue virus
GLFPISIPI

SEQ ID NO: 250871 - protein, 9 aa, Dengue virus
MIAGVLFTF

SEQ ID NO: 250872 - protein, 9 aa, Dengue virus
YMTSMKRFK

SEQ ID NO: 250873 - protein, 9 aa, Dengue virus
TQVRNLIGK

SEQ ID NO: 250874 - protein, 9 aa, Dengue virus
RDMARTLIM

SEQ ID NO: 250875 - protein, 9 aa, Dengue virus
TSEVHWNCK

SEQ ID NO: 250876 - protein, 9 aa, Dengue virus
ALLIVSGVF

SEQ ID NO: 250877 - protein, 9 aa, Dengue virus
MCTKTFVLK

SEQ ID NO: 250878 - protein, 9 aa, Dengue virus
DLMEFIDGL

SEQ ID NO: 250879 - protein, 9 aa, Dengue virus
LARASFIEV

SEQ ID NO: 250880 - protein, 9 aa, Dengue virus
SALTLHWFR

SEQ ID NO: 250881 - protein, 9 aa, Dengue virus
TLFGPEREK

SEQ ID NO: 250882 - protein, 9 aa, Dengue virus
KLIHQVFGT

SEQ ID NO: 250883 - protein, 9 aa, Dengue virus
ALTLATGPV

SEQ ID NO: 250884 - protein, 9 aa, Dengue virus
LIAMDLGEF

SEQ ID NO: 250885 - protein, 9 aa, Dengue virus
NQRKKARST

SEQ ID NO: 250886 - protein, 9 aa, Dengue virus
IVGVLFTFV

SEQ ID NO: 250887 - protein, 9 aa, Dengue virus
ALKINWYKK

SEQ ID NO: 250888 - protein, 9 aa, Dengue virus
TVMALFLAH

SEQ ID NO: 250889 - protein, 9 aa, Dengue virus
CLRRKVTRK

SEQ ID NO: 250890 - protein, 9 aa, Dengue virus
ILGKTQVGV

SEQ ID NO: 250891 - protein, 9 aa, Dengue virus
AVLMLVAHY

SEQ ID NO: 250892 - protein, 9 aa, Dengue virus
ALCEVLTLA

SEQ ID NO: 250893 - protein, 9 aa, Dengue virus
TLILAPTRV

SEQ ID NO: 250894 - protein, 9 aa, Dengue virus
AISVLRGFR

SEQ ID NO: 250895 - protein, 9 aa, Dengue virus
KPWDVLPTV

SEQ ID NO: 250896 - protein, 9 aa, Dengue virus
MILMRMKKK

SEQ ID NO: 250897 - protein, 9 aa, Dengue virus
GLNPTAIFL

SEQ ID NO: 250898 - protein, 9 aa, Dengue virus
HAVSRGTAK

SEQ ID NO: 250899 - protein, 9 aa, Dengue virus
AVRNWLARV

SEQ ID NO: 250900 - protein, 9 aa, Dengue virus
CWCNSTSTW

SEQ ID NO: 250901 - protein, 9 aa, Dengue virus
LPSIVREAL

SEQ ID NO: 250902 - protein, 9 aa, Dengue virus
NSRSTSLSM

SEQ ID NO: 250903 - protein, 9 aa, Dengue virus
YILEDIDRK

SEQ ID NO: 250904 - protein, 9 aa, Dengue virus
LLFKTENGI

SEQ ID NO: 250905 - protein, 9 aa, Dengue virus
IAVSTANIF

SEQ ID NO: 250906 - protein, 9 aa, Dengue virus
ITFLRVLSI

SEQ ID NO: 250907 - protein, 9 aa, Dengue virus
CTLPPLRFR

SEQ ID NO: 250908 - protein, 9 aa, Dengue virus
FVWYFWQKK

SEQ ID NO: 250909 - protein, 9 aa, Dengue virus
KIVQYENLK

SEQ ID NO: 250910 - protein, 9 aa, Dengue virus
ITLLSLTFI

SEQ ID NO: 250911 - protein, 9 aa, Dengue virus
LLVLCVTQV

SEQ ID NO: 250912 - protein, 9 aa, Dengue virus
AVKSEHTGK

SEQ ID NO: 250913 - protein, 9 aa, Dengue virus
IIMMIPTVV

SEQ ID NO: 250914 - protein, 9 aa, Dengue virus
IQTSGGTSI

SEQ ID NO: 250915 - protein, 9 aa, Dengue virus
HWFSRGNSL

SEQ ID NO: 250916 - protein, 9 aa, Dengue virus
VMRGKFGKK

SEQ ID NO: 250917 - protein, 9 aa, Dengue virus
GPMKLVMAF

SEQ ID NO: 250918 - protein, 9 aa, Dengue virus
RSADLELEK

SEQ ID NO: 250919 - protein, 9 aa, Dengue virus
YMWLGARYL

SEQ ID NO: 250920 - protein, 9 aa, Dengue virus
ILLVAVSFV

SEQ ID NO: 250921 - protein, 9 aa, Dengue virus
RSQVGVGVF

SEQ ID NO: 250922 - protein, 9 aa, Dengue virus
SLMCSNTIF

SEQ ID NO: 250923 - protein, 9 aa, Dengue virus
ALKRRLRTL

SEQ ID NO: 250924 - protein, 9 aa, Dengue virus
MMAAILAYT

SEQ ID NO: 250925 - protein, 9 aa, Dengue virus
SLAAIANQA

SEQ ID NO: 250926 - protein, 9 aa, Dengue virus
IGMAMTTTF

SEQ ID NO: 250927 - protein, 9 aa, Dengue virus
TVFFILMML

SEQ ID NO: 250928 - protein, 9 aa, Dengue virus
LLLLTLLAT

SEQ ID NO: 250929 - protein, 9 aa, Dengue virus
MLLVHYAII

SEQ ID NO: 250930 - protein, 9 aa, Dengue virus
SIILEFFLI

SEQ ID NO: 250931 - protein, 9 aa, Dengue virus
CPTQGEAAL

SEQ ID NO: 250932 - protein, 9 aa, Dengue virus
YQLAVTIMA

SEQ ID NO: 250933 - protein, 9 aa, Dengue virus
VILAILTII

SEQ ID NO: 250934 - protein, 9 aa, Dengue virus
RMLNILNRR

SEQ ID NO: 250935 - protein, 9 aa, Dengue virus
TYQLWTALI

SEQ ID NO: 250936 - protein, 9 aa, Dengue virus
ITVSGLYPL

SEQ ID NO: 250937 - protein, 9 aa, Dengue virus
ILALFLAHY

SEQ ID NO: 250938 - protein, 9 aa, Dengue virus
ALKLSWFKK

SEQ ID NO: 250939 - protein, 9 aa, Dengue virus
LTAALLSLV

SEQ ID NO: 250940 - protein, 9 aa, Dengue virus
TPQASTTEA

SEQ ID NO: 250941 - protein, 9 aa, Dengue virus
ISSTPFAEY

SEQ ID NO: 250942 - protein, 9 aa, Dengue virus
KMVHQIFGS

SEQ ID NO: 250943 - protein, 9 aa, Dengue virus
LLVAISFVT

SEQ ID NO: 250944 - protein, 9 aa, Dengue virus
ALKGLPIRY

SEQ ID NO: 250945 - protein, 9 aa, Dengue virus
QLIYVILAI

SEQ ID NO: 250946 - protein, 9 aa, Dengue virus
KLNDWDFVV

SEQ ID NO: 250947 - protein, 9 aa, Dengue virus
RNTPFNMLK

SEQ ID NO: 250948 - protein, 9 aa, Dengue virus
VTFKNPHAK

SEQ ID NO: 250949 - protein, 9 aa, Dengue virus
YAMCLNTFV

SEQ ID NO: 250950 - protein, 9 aa, Dengue virus
NQAAVLMGL

SEQ ID NO: 250951 - protein, 9 aa, Dengue virus
YILRDISKI

SEQ ID NO: 250952 - protein, 9 aa, Dengue virus
YAMCSNAFV

SEQ ID NO: 250953 - protein, 9 aa, Dengue virus
VILAGPIPV

SEQ ID NO: 250954 - protein, 9 aa, Dengue virus
HMIVSKNEK

SEQ ID NO: 250955 - protein, 9 aa, Dengue virus
TLLVAVSFV

SEQ ID NO: 250956 - protein, 9 aa, Dengue virus
AVTLIPLCR

SEQ ID NO: 250957 - protein, 9 aa, Dengue virus
TVWNRVWIR

SEQ ID NO: 250958 - protein, 9 aa, Dengue virus
HTWQKQTRR

SEQ ID NO: 250959 - protein, 9 aa, Dengue virus
GIQRTVFFI

SEQ ID NO: 250960 - protein, 9 aa, Dengue virus
KPIDDRFAT

SEQ ID NO: 250961 - protein, 9 aa, Dengue virus
SALLWMANV

SEQ ID NO: 250962 - protein, 9 aa, Dengue virus
TLRKYCVEA

SEQ ID NO: 250963 - protein, 9 aa, Dengue virus
AMCSGTFVL

SEQ ID NO: 250964 - protein, 9 aa, Dengue virus
KMVRKMEKY

SEQ ID NO: 250965 - protein, 9 aa, Dengue virus
SYKDREWCF

SEQ ID NO: 250966 - protein, 9 aa, Dengue virus
KSRLNALGK

SEQ ID NO: 250967 - protein, 9 aa, Dengue virus
IMKDGRTLV

SEQ ID NO: 250968 - protein, 9 aa, Dengue virus
MLLMLLPTT

SEQ ID NO: 250969 - protein, 9 aa, Dengue virus
FQADSPKRL

SEQ ID NO: 250970 - protein, 9 aa, Dengue virus
GILKRWGQL

SEQ ID NO: 250971 - protein, 9 aa, Dengue virus
MDLERRYVL

SEQ ID NO: 250972 - protein, 9 aa, Dengue virus
MVGQTGIQR

SEQ ID NO: 250973 - protein, 9 aa, Dengue virus
LMLLALIAV

SEQ ID NO: 250974 - protein, 9 aa, Dengue virus
LTIMTGDIK

SEQ ID NO: 250975 - protein, 9 aa, Dengue virus
ITLDILTEI

SEQ ID NO: 250976 - protein, 9 aa, Dengue virus
MASSALLWM

SEQ ID NO: 250977 - protein, 9 aa, Dengue virus
IIMDEAHFT

SEQ ID NO: 250978 - protein, 9 aa, Dengue virus
MLRTRVGTK

SEQ ID NO: 250979 - protein, 9 aa, Dengue virus
MSYTMCSGK

SEQ ID NO: 250980 - protein, 9 aa, Dengue virus
FTMGILCLA

SEQ ID NO: 250981 - protein, 9 aa, Dengue virus
EMCEDTVTY

SEQ ID NO: 250982 - protein, 9 aa, Dengue virus
SLSVTLVLV

SEQ ID NO: 250983 - protein, 9 aa, Dengue virus
QPKPGTQMI

SEQ ID NO: 250984 - protein, 9 aa, Dengue virus
FAVGLLLRK

SEQ ID NO: 250985 - protein, 9 aa, Dengue virus
ILARWGSFK

SEQ ID NO: 250986 - protein, 9 aa, Dengue virus
LAIPITMTL

SEQ ID NO: 250987 - protein, 9 aa, Dengue virus
GTLALSLTF

SEQ ID NO: 250988 - protein, 9 aa, Dengue virus
RKKARSTPF

SEQ ID NO: 250989 - protein, 9 aa, Dengue virus
YILRDVSKK

SEQ ID NO: 250990 - protein, 9 aa, Dengue virus
VVVSFVTLI

SEQ ID NO: 250991 - protein, 9 aa, Dengue virus
NYTDRKWCF

SEQ ID NO: 250992 - protein, 9 aa, Dengue virus
VILALLTII

SEQ ID NO: 250993 - protein, 9 aa, Dengue virus
MGLDKGWPI

SEQ ID NO: 250994 - protein, 9 aa, Dengue virus
MTQKARDAL

SEQ ID NO: 250995 - protein, 9 aa, Dengue virus
SLTAIANQA

SEQ ID NO: 250996 - protein, 9 aa, Dengue virus
MSAAIKDSK

SEQ ID NO: 250997 - protein, 9 aa, Dengue virus
SQIGAGVYK

SEQ ID NO: 250998 - protein, 9 aa, Dengue virus
NRRRRTAGI

SEQ ID NO: 250999 - protein, 9 aa, Dengue virus
FSTGLFSGK

SEQ ID NO: 251000 - protein, 9 aa, Dengue virus
GLLFIILTV

SEQ ID NO: 251001 - protein, 9 aa, Dengue virus
SLLKNDIPM

SEQ ID NO: 251002 - protein, 9 aa, Dengue virus
KARNTPFNM

SEQ ID NO: 251003 - protein, 9 aa, Dengue virus
LALGFFLRK

SEQ ID NO: 251004 - protein, 9 aa, Dengue virus
KLITQFETY

SEQ ID NO: 251005 - protein, 9 aa, Dengue virus
RTVGVIVML

SEQ ID NO: 251006 - protein, 9 aa, Dengue virus
TFIRSTMSL

SEQ ID NO: 251007 - protein, 9 aa, Dengue virus
EVKNCHWPK

SEQ ID NO: 251008 - protein, 9 aa, Dengue virus
TIMAVFFVV

SEQ ID NO: 251009 - protein, 9 aa, Dengue virus
VPNYNLIVM

SEQ ID NO: 251010 - protein, 9 aa, Dengue virus
LNRRRRTAG

SEQ ID NO: 251011 - protein, 9 aa, Dengue virus
TVFFVLMML

SEQ ID NO: 251012 - protein, 9 aa, Dengue virus
IQRVETWAL

SEQ ID NO: 251013 - protein, 9 aa, Dengue virus
QLWATLLSL

SEQ ID NO: 251014 - protein, 9 aa, Dengue virus
VMILPAALA

SEQ ID NO: 251015 - protein, 9 aa, Dengue virus
LILAVISLL

SEQ ID NO: 251016 - protein, 9 aa, Dengue virus
GVFPYSIPA

SEQ ID NO: 251017 - protein, 9 aa, Dengue virus
MMATIGIAL

SEQ ID NO: 251018 - protein, 9 aa, Dengue virus
ALIFILLTA

SEQ ID NO: 251019 - protein, 9 aa, Dengue virus
IATFKIQPF

SEQ ID NO: 251020 - protein, 9 aa, Dengue virus
WMDLLRALI

SEQ ID NO: 251021 - protein, 9 aa, Dengue virus
LNRRRRSAG

SEQ ID NO: 251022 - protein, 9 aa, Dengue virus
RPARNGTVM

SEQ ID NO: 251023 - protein, 9 aa, Dengue virus
LMMRTTWAL

SEQ ID NO: 251024 - protein, 9 aa, Dengue virus
YSMCTGKFK

SEQ ID NO: 251025 - protein, 9 aa, Dengue virus
KSKAINILR

SEQ ID NO: 251026 - protein, 9 aa, Dengue virus
LFVWYFWQK

SEQ ID NO: 251027 - protein, 9 aa, Dengue virus
KQDAFCDSK

SEQ ID NO: 251028 - protein, 9 aa, Dengue virus
STYGWNIVK

SEQ ID NO: 251029 - protein, 9 aa, Dengue virus
AQMWSLMYF

SEQ ID NO: 251030 - protein, 9 aa, Dengue virus
SMTCIAVGL

SEQ ID NO: 251031 - protein, 9 aa, Dengue virus
RIEAKEGLK

SEQ ID NO: 251032 - protein, 9 aa, Dengue virus
GMLIACYVI

SEQ ID NO: 251033 - protein, 9 aa, Dengue virus
VFKKRNLTI

SEQ ID NO: 251034 - protein, 9 aa, Dengue virus
IAIAVASSL

SEQ ID NO: 251035 - protein, 9 aa, Dengue virus
LPVYLMTLM

SEQ ID NO: 251036 - protein, 9 aa, Dengue virus
TFVKTTFSL

SEQ ID NO: 251037 - protein, 9 aa, Dengue virus
IALGLMALK

SEQ ID NO: 251038 - protein, 9 aa, Dengue virus
KWKNRLNAL

SEQ ID NO: 251039 - protein, 9 aa, Dengue virus
TMMAAILAY

SEQ ID NO: 251040 - protein, 9 aa, Dengue virus
SLAMLLVHY

SEQ ID NO: 251041 - protein, 9 aa, Dengue virus
MFKMSPGYV

SEQ ID NO: 251042 - protein, 9 aa, Dengue virus
YVGTSLTQK

SEQ ID NO: 251043 - protein, 9 aa, Dengue virus
TSRMLLNRF

SEQ ID NO: 251044 - protein, 9 aa, Dengue virus
ALFLLVAHY

SEQ ID NO: 251045 - protein, 9 aa, Dengue virus
MILLTGGAM

SEQ ID NO: 251046 - protein, 9 aa, Dengue virus
QIFGTAYGV

SEQ ID NO: 251047 - protein, 9 aa, Dengue virus
TVMAAILAY

SEQ ID NO: 251048 - protein, 9 aa, Dengue virus
FTVMALFLA

SEQ ID NO: 251049 - protein, 9 aa, Dengue virus
SYAMCLNAF

SEQ ID NO: 251050 - protein, 9 aa, Dengue virus
MGMGVTYLA

SEQ ID NO: 251051 - protein, 9 aa, Dengue virus
WATLLSMTF

SEQ ID NO: 251052 - protein, 9 aa, Dengue virus
MTFIRTTFS

SEQ ID NO: 251053 - protein, 9 aa, Dengue virus
RLNDWDFVV

SEQ ID NO: 251054 - protein, 9 aa, Dengue virus
LLMATIGVV

SEQ ID NO: 251055 - protein, 9 aa, Dengue virus
QLWVTLLSL

SEQ ID NO: 251056 - protein, 9 aa, Dengue virus
LLYLIPTVM

SEQ ID NO: 251057 - protein, 9 aa, Dengue virus
TPQAPTTEI

SEQ ID NO: 251058 - protein, 9 aa, Dengue virus
GLLCVSIMI

SEQ ID NO: 251059 - protein, 9 aa, Dengue virus
LTIPPTAGI

SEQ ID NO: 251060 - protein, 9 aa, Dengue virus
FRKRRLTIM

SEQ ID NO: 251061 - protein, 9 aa, Dengue virus
LLLMRTSWA

SEQ ID NO: 251062 - protein, 9 aa, Dengue virus
MGVPSLPLF

SEQ ID NO: 251063 - protein, 9 aa, Dengue virus
WFVERNMVA

SEQ ID NO: 251064 - protein, 9 aa, Dengue virus
KTFDTEYTK

SEQ ID NO: 251065 - protein, 9 aa, Dengue virus
FTDPSSIAA

SEQ ID NO: 251066 - protein, 9 aa, Dengue virus
MLMTGILAV

SEQ ID NO: 251067 - protein, 9 aa, Dengue virus
TVGTTHFQR

SEQ ID NO: 251068 - protein, 9 aa, Dengue virus
TLWYMWQVK

SEQ ID NO: 251069 - protein, 9 aa, Dengue virus
SLGKAVHQI

SEQ ID NO: 251070 - protein, 9 aa, Dengue virus
FLLIMGQLT

SEQ ID NO: 251071 - protein, 9 aa, Dengue virus
KSALKDGSK

SEQ ID NO: 251072 - protein, 9 aa, Dengue virus
TLLSLTFIK

SEQ ID NO: 251073 - protein, 9 aa, Dengue virus
MGKLVHQVF

SEQ ID NO: 251074 - protein, 9 aa, Dengue virus
ALAPPASDL

SEQ ID NO: 251075 - protein, 9 aa, Dengue virus
SKIPGGNMY

SEQ ID NO: 251076 - protein, 9 aa, Dengue virus
RLPTFMTQK

SEQ ID NO: 251077 - protein, 9 aa, Dengue virus
GILCVSIMI

SEQ ID NO: 251078 - protein, 9 aa, Dengue virus
MMILPATLA

SEQ ID NO: 251079 - protein, 9 aa, Dengue virus
RSRWSRRML

SEQ ID NO: 251080 - protein, 9 aa, Dengue virus
KLRDSHTQV

SEQ ID NO: 251081 - protein, 9 aa, Dengue virus
KAIKILIGF

SEQ ID NO: 251082 - protein, 9 aa, Dengue virus
LVRVGRERL

SEQ ID NO: 251083-251084 - skipped (2 entries)

SEQ ID NO: 251085 - protein, 9 aa, Dengue virus
AGLAFSIMK

SEQ ID NO: 251086 - protein, 9 aa, Dengue virus
TLYAVATTF

SEQ ID NO: 251087 - protein, 9 aa, Dengue virus
YAWRTMAMV

SEQ ID NO: 251088 - protein, 9 aa, Dengue virus
LVIMDEAHF

SEQ ID NO: 251089 - protein, 9 aa, Dengue virus
WGKAKILST

SEQ ID NO: 251090 - protein, 9 aa, Dengue virus
YGMEIRPLK

SEQ ID NO: 251091 - protein, 9 aa, Dengue virus
TLAVFFLLI

SEQ ID NO: 251092 - protein, 9 aa, Dengue virus
TMSLVMAWR

SEQ ID NO: 251093 - protein, 9 aa, Dengue virus
AQVRNLIGK

SEQ ID NO: 251094 - protein, 9 aa, Dengue virus
NSRSASLSM

SEQ ID NO: 251095 - protein, 9 aa, Dengue virus
TPQASTAEA

SEQ ID NO: 251096 - protein, 9 aa, Dengue virus
MPVTHSSAA

SEQ ID NO: 251097 - protein, 9 aa, Dengue virus
MLNTMNRRK

SEQ ID NO: 251098 - protein, 9 aa, Dengue virus
AVSMANIFR

SEQ ID NO: 251099 - protein, 9 aa, Dengue virus
AMCSNAFVL

SEQ ID NO: 251100 - protein, 9 aa, Dengue virus
AMTAGTFLF

SEQ ID NO: 251101 - protein, 9 aa, Dengue virus
TMILMLLPT

SEQ ID NO: 251102 - protein, 9 aa, Dengue virus
ISEMGANFK

SEQ ID NO: 251103 - protein, 9 aa, Dengue virus
RMDLGVPLL

SEQ ID NO: 251104 - protein, 9 aa, Dengue virus
HVLGRLITV

SEQ ID NO: 251105 - protein, 9 aa, Dengue virus
LLFKTSTGV

SEQ ID NO: 251106 - protein, 9 aa, Dengue virus
IAVGMVTLY

SEQ ID NO: 251107 - protein, 9 aa, Dengue virus
FLTFVLLLS

SEQ ID NO: 251108 - protein, 9 aa, Dengue virus
KYTDRKWCF

SEQ ID NO: 251109 - protein, 9 aa, Dengue virus
SLIGNEEFL

SEQ ID NO: 251110 - protein, 9 aa, Dengue virus
LATVTGGIF

SEQ ID NO: 251111 - protein, 9 aa, Dengue virus
TVNPIVTGK

SEQ ID NO: 251112 - protein, 9 aa, Dengue virus
PLAENTNSV

SEQ ID NO: 251113 - protein, 9 aa, Dengue virus
AQEEGICGI

SEQ ID NO: 251114 - protein, 9 aa, Dengue virus
ATLLVALSF

SEQ ID NO: 251115 - protein, 9 aa, Dengue virus
LVKRFSSGL

SEQ ID NO: 251116 - protein, 9 aa, Dengue virus
LLVWHTWQK

SEQ ID NO: 251117 - protein, 9 aa, Dengue virus
IVVGGITLF

SEQ ID NO: 251118 - protein, 9 aa, Dengue virus
AVLTHNGKR

SEQ ID NO: 251119 - protein, 9 aa, Dengue virus
YAQMWQLMY

SEQ ID NO: 251120 - protein, 9 aa, Dengue virus
ATSIFKLTY

SEQ ID NO: 251121 - protein, 9 aa, Dengue virus
SALAGATEV

SEQ ID NO: 251122 - protein, 9 aa, Dengue virus
SMGLLCLTL

SEQ ID NO: 251123 - protein, 9 aa, Dengue virus
WGKAKIFTL

SEQ ID NO: 251124 - protein, 9 aa, Dengue virus
TLAVFLLLV

SEQ ID NO: 251125 - protein, 9 aa, Dengue virus
ALKINWYRK

SEQ ID NO: 251126 - protein, 9 aa, Dengue virus
LALKEFKEF

SEQ ID NO: 251127 - protein, 9 aa, Dengue virus
TYGWNIVKL

SEQ ID NO: 251128 - protein, 9 aa, Dengue virus
LMRRGDLPV

SEQ ID NO: 251129 - protein, 9 aa, Dengue virus
AMVLSVVSL

SEQ ID NO: 251130 - protein, 9 aa, Dengue virus
YVLGRLITV

SEQ ID NO: 251131 - protein, 9 aa, Dengue virus
LLNRFTMTY

SEQ ID NO: 251132 - protein, 9 aa, Dengue virus
CLNTFVLKK

SEQ ID NO: 251133 - protein, 9 aa, Dengue virus
QITNELNYV

SEQ ID NO: 251134 - protein, 9 aa, Dengue virus
TLMAAVLAY

SEQ ID NO: 251135 - protein, 9 aa, Dengue virus
CVTTMAQGK

SEQ ID NO: 251136 - protein, 9 aa, Dengue virus
FMAYMIGQT

SEQ ID NO: 251137 - protein, 9 aa, Dengue virus
GTLALALTF

SEQ ID NO: 251138 - protein, 9 aa, Dengue virus
QMSSGNILF

SEQ ID NO: 251139 - protein, 9 aa, Dengue virus
NGRKRSTVT

SEQ ID NO: 251140 - protein, 9 aa, Dengue virus
LLLTVGLSL

SEQ ID NO: 251141 - protein, 9 aa, Dengue virus
MTLWYMWQV

SEQ ID NO: 251142 - protein, 9 aa, Dengue virus
YIIVGAGEK

SEQ ID NO: 251143 - protein, 9 aa, Dengue virus
NALKINWYK

SEQ ID NO: 251144 - protein, 9 aa, Dengue virus
WTMKILTGV

SEQ ID NO: 251145 - protein, 9 aa, Dengue virus
TPRAKRGTT

SEQ ID NO: 251146 - protein, 9 aa, Dengue virus
KAKMLSTEL

SEQ ID NO: 251147 - protein, 9 aa, Dengue virus
SITQKGIIF

SEQ ID NO: 251148 - protein, 9 aa, Dengue virus
WLSYKVASA

SEQ ID NO: 251149 - protein, 9 aa, Dengue virus
KPRICTRAE

SEQ ID NO: 251150 - protein, 9 aa, Dengue virus
IAIGVITLY

SEQ ID NO: 251151 - protein, 9 aa, Dengue virus
LLLVTHYAI

SEQ ID NO: 251152 - protein, 9 aa, Dengue virus
VPMVTQMAM

SEQ ID NO: 251153 - protein, 9 aa, Dengue virus
LMATIGVVL

SEQ ID NO: 251154 - protein, 9 aa, Dengue virus
GLVTLYLGV

SEQ ID NO: 251155 - protein, 9 aa, Dengue virus
LAKRFSKGL

SEQ ID NO: 251156 - protein, 9 aa, Dengue virus
GSAKLQWFV

SEQ ID NO: 251157 - protein, 9 aa, Dengue virus
TQHGTILIK

SEQ ID NO: 251158 - protein, 9 aa, Dengue virus
TTLTASLAM

SEQ ID NO: 251159 - protein, 9 aa, Dengue virus
NIYKRSGIM

SEQ ID NO: 251160 - protein, 9 aa, Dengue virus
ILTPQPMEL

SEQ ID NO: 251161 - protein, 9 aa, Dengue virus
AVLFAVTLI

SEQ ID NO: 251162 - protein, 9 aa, Dengue virus
NRRRRTVGV

SEQ ID NO: 251163 - protein, 9 aa, Dengue virus
CLAILFEEV

SEQ ID NO: 251164 - protein, 9 aa, Dengue virus
VSDLKYSWK

SEQ ID NO: 251165 - protein, 9 aa, Dengue virus
MCSNAFVLK

SEQ ID NO: 251166 - protein, 9 aa, Dengue virus
TTLSRTSKK

SEQ ID NO: 251167 - protein, 9 aa, Dengue virus
MGNEGYTDY

SEQ ID NO: 251168 - protein, 9 aa, Dengue virus
ILAKAIFKL

SEQ ID NO: 251169 - protein, 9 aa, Dengue virus
FQPESPARL

SEQ ID NO: 251170 - protein, 9 aa, Dengue virus
NRRKRSTMT

SEQ ID NO: 251171 - protein, 9 aa, Dengue virus
LLLTIGLSL

SEQ ID NO: 251172 - protein, 9 aa, Dengue virus
VQWDEMADI

SEQ ID NO: 251173 - protein, 9 aa, Dengue virus
LISGKGVGK

SEQ ID NO: 251174 - protein, 9 aa, Dengue virus
HMIAGALFT

SEQ ID NO: 251175 - protein, 9 aa, Dengue virus
ATLSEGVYR

SEQ ID NO: 251176 - protein, 9 aa, Dengue virus
MQRKHGGML

SEQ ID NO: 251177 - protein, 9 aa, Dengue virus
IMKSVGTGK

SEQ ID NO: 251178 - protein, 9 aa, Dengue virus
ILKRWGTIK

SEQ ID NO: 251179 - protein, 9 aa, Dengue virus
NIFRGSYLA

SEQ ID NO: 251180 - protein, 9 aa, Dengue virus
GLRRGETTK

SEQ ID NO: 251181 - protein, 9 aa, Dengue virus
AYTHALSEL

SEQ ID NO: 251182 - protein, 9 aa, Dengue virus
RPTFAVGLL

SEQ ID NO: 251183 - protein, 9 aa, Dengue virus
LYAVATTFI

SEQ ID NO: 251184 - protein, 9 aa, Dengue virus
IIMMIPTVM

SEQ ID NO: 251185 - protein, 9 aa, Dengue virus
GQLTWSDLI

SEQ ID NO: 251186 - protein, 9 aa, Dengue virus
VTCAKFTCK

SEQ ID NO: 251187 - protein, 9 aa, Dengue virus
VMAWRTIMA

SEQ ID NO: 251188 - protein, 9 aa, Dengue virus
KQWFLDLPL

SEQ ID NO: 251189 - protein, 9 aa, Dengue virus
LQRKHGGML

SEQ ID NO: 251190 - protein, 9 aa, Dengue virus
GLKRGEITK

SEQ ID NO: 251191 - protein, 9 aa, Dengue virus
LFVWHFWQK

SEQ ID NO: 251192 - protein, 9 aa, Dengue virus
AVASGLLWV

SEQ ID NO: 251193 - protein, 9 aa, Dengue virus
VVVGDITGV

SEQ ID NO: 251194 - protein, 9 aa, Dengue virus
NIHTAITQV

SEQ ID NO: 251195 - protein, 9 aa, Dengue virus
MLQGRGPLK

SEQ ID NO: 251196 - protein, 9 aa, Dengue virus
LLILCVTQV

SEQ ID NO: 251197 - protein, 9 aa, Dengue virus
RLVTANPIV

SEQ ID NO: 251198 - protein, 9 aa, Dengue virus
SPKRLSAAI

SEQ ID NO: 251199 - protein, 9 aa, Dengue virus
SYKVASEGF

SEQ ID NO: 251200 - protein, 9 aa, Dengue virus
NIQAAINQV

SEQ ID NO: 251201 - protein, 9 aa, Dengue virus
YMPTVIEHL

SEQ ID NO: 251202 - protein, 9 aa, Dengue virus
LTYQNKVVR

SEQ ID NO: 251203 - protein, 9 aa, Dengue virus
TSADLTVEK

SEQ ID NO: 251204 - protein, 9 aa, Dengue virus
RPGYFTQTA

SEQ ID NO: 251205 - protein, 9 aa, Dengue virus
KVASEGFQY

SEQ ID NO: 251206 - protein, 9 aa, Dengue virus
QPKPGTRMV

SEQ ID NO: 251207 - protein, 9 aa, Dengue virus
IMIGVGNSA

SEQ ID NO: 251208 - protein, 9 aa, Dengue virus
SMAMTCIAV

SEQ ID NO: 251209 - protein, 9 aa, Dengue virus
MCDDTVTYK

SEQ ID NO: 251210 - protein, 9 aa, Dengue virus
VIALFLAHV

SEQ ID NO: 251211 - protein, 9 aa, Dengue virus
IQRTIFFVL

SEQ ID NO: 251212 - protein, 9 aa, Dengue virus
RVITANPIV

SEQ ID NO: 251213 - protein, 9 aa, Dengue virus
TLSEGVYRI

SEQ ID NO: 251214 - protein, 9 aa, Dengue virus
KQAQRIETW

SEQ ID NO: 251215 - protein, 9 aa, Dengue virus
VSTGSQLAK

SEQ ID NO: 251216 - protein, 9 aa, Dengue virus
TLAVLFLLI

SEQ ID NO: 251217 - protein, 9 aa, Dengue virus
LTGYGTVTM

SEQ ID NO: 251218 - protein, 9 aa, Dengue virus
YVFSGDPLK

SEQ ID NO: 251219 - protein, 9 aa, Dengue virus
MTDDIGMGI

SEQ ID NO: 251220 - protein, 9 aa, Dengue virus
AMALSIVSL

SEQ ID NO: 251221 - protein, 9 aa, Dengue virus
ALISNITTA

SEQ ID NO: 251222 - protein, 9 aa, Dengue virus
MVLAFITFL

SEQ ID NO: 251223 - protein, 9 aa, Dengue virus
NMVKSLASA

SEQ ID NO: 251224 - protein, 9 aa, Dengue virus
GLLCISIMI

SEQ ID NO: 251225 - protein, 9 aa, Dengue virus
RMGMGTTYL

SEQ ID NO: 251226 - protein, 9 aa, Dengue virus
WMADVPLQW

SEQ ID NO: 251227 - protein, 9 aa, Dengue virus
TFSVHYAWK

SEQ ID NO: 251228 - protein, 9 aa, Dengue virus
LSKSEFNTY

SEQ ID NO: 251229 - protein, 9 aa, Dengue virus
AVLDDGIYR

SEQ ID NO: 251230 - protein, 9 aa, Dengue virus
RTMAMVLSI

SEQ ID NO: 251231 - protein, 9 aa, Dengue virus
IMMIPTVMA

SEQ ID NO: 251232 - protein, 9 aa, Dengue virus
LTGYGTITM

SEQ ID NO: 251233 - protein, 9 aa, Dengue virus
RLLTKPWDV

SEQ ID NO: 251234 - protein, 9 aa, Dengue virus
ESRKTFVEL

SEQ ID NO: 251235 - protein, 9 aa, Dengue virus
MWKQITNEL

SEQ ID NO: 251236 - protein, 9 aa, Dengue virus
MIAGVFFTF

SEQ ID NO: 251237 - protein, 9 aa, Dengue virus
VLFMFVLLL

SEQ ID NO: 251238 - protein, 9 aa, Dengue virus
ILDVDLRPA

SEQ ID NO: 251239 - protein, 9 aa, Dengue virus
SQHNYRPGY

SEQ ID NO: 251240 - protein, 9 aa, Dengue virus
LQMENKAWL

SEQ ID NO: 251241 - protein, 9 aa, Dengue virus
VMLLVHYAI

SEQ ID NO: 251242 - protein, 9 aa, Dengue virus
TWAFRHPGF

SEQ ID NO: 251243 - protein, 9 aa, Dengue virus
LMLLPTALA

SEQ ID NO: 251244 - protein, 9 aa, Dengue virus
IPKIYGGPI

SEQ ID NO: 251245 - protein, 9 aa, Dengue virus
TMIALFLAH

SEQ ID NO: 251246 - protein, 9 aa, Dengue virus
FLDLPLPWT

SEQ ID NO: 251247 - protein, 9 aa, Dengue virus
KTMAMVLSI

SEQ ID NO: 251248 - protein, 9 aa, Dengue virus
LLFKTEDGV

SEQ ID NO: 251249 - protein, 9 aa, Dengue virus
TSEVHWNSK

SEQ ID NO: 251250 - protein, 9 aa, Dengue virus
SLPTYLSSK

SEQ ID NO: 251251 - protein, 9 aa, Dengue virus
MILMEMKKK

SEQ ID NO: 251252 - protein, 9 aa, Dengue virus
RIQRTVFFV

SEQ ID NO: 251253 - protein, 9 aa, Dengue virus
IMAVGIVSI

SEQ ID NO: 251254 - protein, 9 aa, Dengue virus
SIPETILEL

SEQ ID NO: 251255 - protein, 9 aa, Dengue virus
TMAMVLSVV

SEQ ID NO: 251256 - protein, 9 aa, Dengue virus
TYGWNLVRL

SEQ ID NO: 251257 - protein, 9 aa, Dengue virus
ATFTMRLLS

SEQ ID NO: 251258 - protein, 9 aa, Dengue virus
RPRWLDARV

SEQ ID NO: 251259 - protein, 9 aa, Dengue virus
LPWTSGAST

SEQ ID NO: 251260 - protein, 9 aa, Dengue virus
GGRAYQHAL

SEQ ID NO: 251261 - protein, 9 aa, Dengue virus
TNMITLLVK

SEQ ID NO: 251262 - protein, 9 aa, Dengue virus
ATFKMRPMF

SEQ ID NO: 251263 - protein, 9 aa, Dengue virus
MPAMKRYSA

SEQ ID NO: 251264 - protein, 9 aa, Dengue virus
HWVEITALI

SEQ ID NO: 251265 - protein, 9 aa, Dengue virus
GSLIGLSSR

SEQ ID NO: 251266 - protein, 9 aa, Dengue virus
LLFRRLTSR

SEQ ID NO: 251267 - protein, 9 aa, Dengue virus
MANIFRGSY

SEQ ID NO: 251268 - protein, 9 aa, Dengue virus
TPRSPSVEI

SEQ ID NO: 251269 - protein, 9 aa, Dengue virus
FPQSNAPIM

SEQ ID NO: 251270 - protein, 9 aa, Dengue virus
GLICVIVSS

SEQ ID NO: 251271 - protein, 9 aa, Dengue virus
LMMATIGIT

SEQ ID NO: 251272 - protein, 9 aa, Dengue virus
IIMLGDTMF

SEQ ID NO: 251273 - protein, 9 aa, Dengue virus
LLLLGLLAT

SEQ ID NO: 251274 - protein, 9 aa, Dengue virus
NQATVLMGL

SEQ ID NO: 251275 - protein, 9 aa, Dengue virus
TVASAAQRR

SEQ ID NO: 251276 - protein, 9 aa, Dengue virus
LLLTLLATV

SEQ ID NO: 251277 - protein, 9 aa, Dengue virus
ISRMLINRF

SEQ ID NO: 251278 - protein, 9 aa, Dengue virus
TVWFVPSIK

SEQ ID NO: 251279 - protein, 9 aa, Dengue virus
SLLGSALLK

SEQ ID NO: 251280 - protein, 9 aa, Dengue virus
MAWRTIMAV

SEQ ID NO: 251281 - protein, 9 aa, Dengue virus
TTETPTWNR

SEQ ID NO: 251282 - protein, 9 aa, Dengue virus
IASAIVLEF

SEQ ID NO: 251283 - protein, 9 aa, Dengue virus
FIDGISLGL

SEQ ID NO: 251284 - protein, 9 aa, Dengue virus
FLNLPLPWT

SEQ ID NO: 251285 - protein, 9 aa, Dengue virus
TLAGEIGAV

SEQ ID NO: 251286 - protein, 9 aa, Dengue virus
MTTEDMLSV

SEQ ID NO: 251287 - protein, 9 aa, Dengue virus
KMDLGVPLL

SEQ ID NO: 251288 - protein, 9 aa, Dengue virus
LPAYLSSKA

SEQ ID NO: 251289 - protein, 9 aa, Dengue virus
MLDVDLHPA

SEQ ID NO: 251290 - protein, 9 aa, Dengue virus
SMGLITIAM

SEQ ID NO: 251291 - protein, 9 aa, Dengue virus
TTFITPMLR

SEQ ID NO: 251292 - protein, 9 aa, Dengue virus
QVLAIEPGK

SEQ ID NO: 251293 - protein, 9 aa, Dengue virus
GSSPVIEVK

SEQ ID NO: 251294 - protein, 9 aa, Dengue virus
TYSLHYAWK

SEQ ID NO: 251295 - protein, 9 aa, Dengue virus
NRRKKSVTM

SEQ ID NO: 251296 - protein, 9 aa, Dengue virus
ILNRRRRSA

SEQ ID NO: 251297 - protein, 9 aa, Dengue virus
RTTWALCEV

SEQ ID NO: 251298 - protein, 9 aa, Dengue virus
TILCVPNAV

SEQ ID NO: 251299 - protein, 9 aa, Dengue virus
SQMLIPRSY

SEQ ID NO: 251300 - protein, 9 aa, Dengue virus
KAIRILIGF

SEQ ID NO: 251301 - protein, 9 aa, Dengue virus
LLFKTTEGI

SEQ ID NO: 251302 - protein, 9 aa, Dengue virus
YQGKTVWFV

SEQ ID NO: 251303 - protein, 9 aa, Dengue virus
TFIRTTFSL

SEQ ID NO: 251304 - protein, 9 aa, Dengue virus
RLSAAIGKA

SEQ ID NO: 251305 - protein, 9 aa, Dengue virus
KVVQYENLK

SEQ ID NO: 251306 - protein, 9 aa, Dengue virus
YIMVGAGEK

SEQ ID NO: 251307 - protein, 9 aa, Dengue virus
CVWPKSHTL

SEQ ID NO: 251308 - protein, 9 aa, Dengue virus
HALLATSIF

SEQ ID NO: 251309 - protein, 9 aa, Dengue virus
LQAKATREA

SEQ ID NO: 251310 - protein, 9 aa, Dengue virus
TQWLETEGV

SEQ ID NO: 251311 - protein, 9 aa, Dengue virus
ITASTLLWY

SEQ ID NO: 251312 - protein, 9 aa, Dengue virus
AVILLNAWK

SEQ ID NO: 251313 - protein, 9 aa, Dengue virus
MLNILNGRK

SEQ ID NO: 251314 - protein, 9 aa, Dengue virus
TQVGVGIHM

SEQ ID NO: 251315 - protein, 9 aa, Dengue virus
MIVGVFFTF

SEQ ID NO: 251316 - protein, 9 aa, Dengue virus
SYVMCTGPF

SEQ ID NO: 251317 - protein, 9 aa, Dengue virus
RLITVNPIV

SEQ ID NO: 251318 - protein, 9 aa, Dengue virus
YVDYMPAMK

SEQ ID NO: 251319 - protein, 9 aa, Dengue virus
CAKFSCLGK

SEQ ID NO: 251320 - protein, 9 aa, Dengue virus
VGRERLTRM

SEQ ID NO: 251321 - protein, 9 aa, Dengue virus
LALGMMILK

SEQ ID NO: 251322 - protein, 9 aa, Dengue virus
MMATIGITL

SEQ ID NO: 251323 - protein, 9 aa, Dengue virus
FLVDGPDTS

SEQ ID NO: 251324 - protein, 9 aa, Dengue virus
FLLIVGQLT

SEQ ID NO: 251325 - protein, 9 aa, Dengue virus
RLPEDIEQM

SEQ ID NO: 251326 - protein, 9 aa, Dengue virus
WIVERGMVK

SEQ ID NO: 251327 - protein, 9 aa, Dengue virus
SSMLNIMNR

SEQ ID NO: 251328 - protein, 9 aa, Dengue virus
TPMAMTCIA

SEQ ID NO: 251329 - protein, 9 aa, Dengue virus
AMGIMILKL

SEQ ID NO: 251330 - protein, 9 aa, Dengue virus
TMKIGIGVL

SEQ ID NO: 251331 - protein, 9 aa, Dengue virus
ILRHPGFTM

SEQ ID NO: 251332 - protein, 9 aa, Dengue virus
AQRIETWVL

SEQ ID NO: 251333 - protein, 9 aa, Dengue virus
LLAKSIFKL

SEQ ID NO: 251334 - protein, 9 aa, Dengue virus
MILMLLPTA

SEQ ID NO: 251335 - protein, 9 aa, Dengue virus
MILVVVIAL

SEQ ID NO: 251336 - protein, 9 aa, Dengue virus
CISIMIEEV

SEQ ID NO: 251337 - protein, 9 aa, Dengue virus
TMTYRRPTI

SEQ ID NO: 251338 - protein, 9 aa, Dengue virus
GGLFTSLGK

SEQ ID NO: 251339 - protein, 9 aa, Dengue virus
RLREKQDVF

SEQ ID NO: 251340 - protein, 9 aa, Dengue virus
KQISNELNY

SEQ ID NO: 251341 - protein, 9 aa, Dengue virus
LLTIGLSLV

SEQ ID NO: 251342 - protein, 9 aa, Dengue virus
VLDDGIYRI

SEQ ID NO: 251343 - protein, 9 aa, Dengue virus
WMKFREGSS

SEQ ID NO: 251344 - protein, 9 aa, Dengue virus
RQWFLDLPL

SEQ ID NO: 251345 - protein, 9 aa, Dengue virus
LMCANTIFT

SEQ ID NO: 251346 - protein, 9 aa, Dengue virus
LLLGVGLAM

SEQ ID NO: 251347 - protein, 9 aa, Dengue virus
AQMWALMYF

SEQ ID NO: 251348 - protein, 9 aa, Dengue virus
QILEENMEV

SEQ ID NO: 251349 - protein, 9 aa, Dengue virus
HYAWKTMAM

SEQ ID NO: 251350 - protein, 9 aa, Dengue virus
GQLKLDWFK

SEQ ID NO: 251351 - protein, 9 aa, Dengue virus
RIYSDPLAL

SEQ ID NO: 251352 - protein, 9 aa, Dengue virus
IVAIDLDPV

SEQ ID NO: 251353 - protein, 9 aa, Dengue virus
MILVVVITL

SEQ ID NO: 251354 - protein, 9 aa, Dengue virus
WLGARYLEF

SEQ ID NO: 251355 - protein, 9 aa, Dengue virus
TCAMFTCLK

SEQ ID NO: 251356 - protein, 9 aa, Dengue virus
MMKIGIGVL

SEQ ID NO: 251357 - protein, 9 aa, Dengue virus
MLDVDLRPA

SEQ ID NO: 251358 - protein, 9 aa, Dengue virus
HAVSRGSAK

SEQ ID NO: 251359 - protein, 9 aa, Dengue virus
KQIANELNY

SEQ ID NO: 251360 - protein, 9 aa, Dengue virus
TMFLMLMPT

SEQ ID NO: 251361 - protein, 9 aa, Dengue virus
SIGGVFTSV

SEQ ID NO: 251362 - protein, 9 aa, Dengue virus
LVMAFIAFL

SEQ ID NO: 251363 - protein, 9 aa, Dengue virus
TFIKTTLSL

SEQ ID NO: 251364 - protein, 9 aa, Dengue virus
YILRDISRK

SEQ ID NO: 251365 - protein, 9 aa, Dengue virus
IIIMMIPTV

SEQ ID NO: 251366 - protein, 9 aa, Dengue virus
LLAAVSFVT

SEQ ID NO: 251367 - protein, 9 aa, Dengue virus
IQPFLALGF

SEQ ID NO: 251368 - protein, 9 aa, Dengue virus
KLREMYSQL

SEQ ID NO: 251369 - protein, 9 aa, Dengue virus
IVMDEAHFT

SEQ ID NO: 251370 - protein, 9 aa, Dengue virus
LVMLLVHYA

SEQ ID NO: 251371 - protein, 9 aa, Dengue virus
KLREVYTQM

SEQ ID NO: 251372 - protein, 9 aa, Dengue virus
KLTDWDFVV

SEQ ID NO: 251373 - protein, 9 aa, Dengue virus
LQMEDKAWL

SEQ ID NO: 251374 - protein, 9 aa, Dengue virus
MKMRKKTWL

SEQ ID NO: 251375 - protein, 9 aa, Dengue virus
AMLCIPNVM

SEQ ID NO: 251376 - protein, 9 aa, Dengue virus
VTNPAVLRK

SEQ ID NO: 251377 - protein, 9 aa, Dengue virus
RSCTMPPLR

SEQ ID NO: 251378 - protein, 9 aa, Dengue virus
IILEFFLIV

SEQ ID NO: 251379 - protein, 9 aa, Dengue virus
TIGTTNFQR

SEQ ID NO: 251380 - protein, 9 aa, Dengue virus
STPFNMLKR

SEQ ID NO: 251381 - protein, 9 aa, Dengue virus
QLKLNWFKK

SEQ ID NO: 251382 - protein, 9 aa, Dengue virus
RTSLDFNEM

SEQ ID NO: 251383 - protein, 9 aa, Dengue virus
MYADDTAGW

SEQ ID NO: 251384 - protein, 9 aa, Dengue virus
GFLNEDHWF

SEQ ID NO: 251385 - protein, 9 aa, Dengue virus
AILAYTVGT

SEQ ID NO: 251386 - protein, 9 aa, Dengue virus
SYQLWATLL

SEQ ID NO: 251387 - protein, 9 aa, Dengue virus
RITAEWLWK

SEQ ID NO: 251388 - protein, 9 aa, Dengue virus
EPHWIAASI

SEQ ID NO: 251389 - protein, 9 aa, Dengue virus
GPMPVTVAS

SEQ ID NO: 251390 - protein, 9 aa, Dengue virus
MTDDIGMGV

SEQ ID NO: 251391 - protein, 9 aa, Dengue virus
GAVLMYQGK

SEQ ID NO: 251392 - protein, 9 aa, Dengue virus
NSRNTSMAM

SEQ ID NO: 251393 - protein, 9 aa, Dengue virus
WTSGATAEV

SEQ ID NO: 251394 - protein, 9 aa, Dengue virus
FQKALIFIL

SEQ ID NO: 251395 - protein, 9 aa, Dengue virus
QQVPFCSHH

SEQ ID NO: 251396 - protein, 9 aa, Dengue virus
ILKRWGTVK

SEQ ID NO: 251397 - protein, 9 aa, Dengue virus
TFAAGLLLR

SEQ ID NO: 251398 - protein, 9 aa, Dengue virus
TLPAYLSSK

SEQ ID NO: 251399 - protein, 9 aa, Dengue virus
MMMLPATLA

SEQ ID NO: 251400 - protein, 9 aa, Dengue virus
SLGKAIHQV

SEQ ID NO: 251401 - protein, 9 aa, Dengue virus
SYAMCLNTF

SEQ ID NO: 251402 - protein, 9 aa, Dengue virus
EIKSCHWPK

SEQ ID NO: 251403 - protein, 9 aa, Dengue virus
TLSLHYAWK

SEQ ID NO: 251404 - protein, 9 aa, Dengue virus
LILCVTQVL

SEQ ID NO: 251405 - protein, 9 aa, Dengue virus
TFIRSTMPL

SEQ ID NO: 251406 - protein, 9 aa, Dengue virus
STGEHRREK

SEQ ID NO: 251407 - protein, 9 aa, Dengue virus
TQVGTLALA

SEQ ID NO: 251408 - protein, 9 aa, Dengue virus
KQLGQVMLL

SEQ ID NO: 251409 - protein, 9 aa, Dengue virus
KQITNELNY

SEQ ID NO: 251410 - protein, 9 aa, Dengue virus
HAVSRGSSK

SEQ ID NO: 251411 - protein, 9 aa, Dengue virus
FMFVLLLSG

SEQ ID NO: 251412 - protein, 9 aa, Dengue virus
TMAHRKPTY

SEQ ID NO: 251413 - protein, 9 aa, Dengue virus
LPTVTQMAM

SEQ ID NO: 251414 - protein, 9 aa, Dengue virus
LSIVSLLPL

SEQ ID NO: 251415 - protein, 9 aa, Dengue virus
VLNPYMPSV

SEQ ID NO: 251416 - protein, 9 aa, Dengue virus
QVFGAAYGV

SEQ ID NO: 251417 - protein, 9 aa, Dengue virus
HMIAGVFLT

SEQ ID NO: 251418 - protein, 9 aa, Dengue virus
VTLFFLSGR

SEQ ID NO: 251419 - protein, 9 aa, Dengue virus
VMKDGRVLV

SEQ ID NO: 251420 - protein, 9 aa, Dengue virus
VLPENLEYT

SEQ ID NO: 251421 - protein, 9 aa, Dengue virus
RPGYHTQIA

SEQ ID NO: 251422 - protein, 9 aa, Dengue virus
TPETKNSTF

SEQ ID NO: 251423 - protein, 9 aa, Dengue virus
LIAAVLLLV

SEQ ID NO: 251424 - protein, 9 aa, Dengue virus
VENHHHAAM

SEQ ID NO: 251425 - protein, 9 aa, Dengue virus
STMPLTMAW

SEQ ID NO: 251426 - protein, 9 aa, Dengue virus
TAKEVALLR

SEQ ID NO: 251427 - protein, 9 aa, Dengue virus
ALGKSEFQI

SEQ ID NO: 251428 - protein, 9 aa, Dengue virus
MLIALLGAM

SEQ ID NO: 251429 - protein, 9 aa, Dengue virus
LLMLLPTTL

SEQ ID NO: 251430 - protein, 9 aa, Dengue virus
CLMMILPAT

SEQ ID NO: 251431 - protein, 9 aa, Dengue virus
RPTFAAGLL

SEQ ID NO: 251432 - protein, 9 aa, Dengue virus
MGYWIESQK

SEQ ID NO: 251433 - protein, 9 aa, Dengue virus
DVFFVPPEK

SEQ ID NO: 251434 - protein, 9 aa, Dengue virus
LLVTHYAII

SEQ ID NO: 251435 - protein, 9 aa, Dengue virus
IAVGGITLF

SEQ ID NO: 251436 - protein, 9 aa, Dengue virus
GPMKMVMAF

SEQ ID NO: 251437 - protein, 9 aa, Dengue virus
KTMAMALSI

SEQ ID NO: 251438 - protein, 9 aa, Dengue virus
HLAYRTRNA

SEQ ID NO: 251439 - protein, 9 aa, Dengue virus
RTLILAPTR

SEQ ID NO: 251440 - protein, 9 aa, Dengue virus
VPMAGPLVA

SEQ ID NO: 251441 - protein, 9 aa, Dengue virus
LMSARGIGK

SEQ ID NO: 251442 - protein, 9 aa, Dengue virus
SVIERMETL

SEQ ID NO: 251443 - protein, 9 aa, Dengue virus
QMENKAWLV

SEQ ID NO: 251444 - protein, 9 aa, Dengue virus
PMATYGWNL

SEQ ID NO: 251445 - protein, 9 aa, Dengue virus
FQIYKRSGI

SEQ ID NO: 251446 - protein, 9 aa, Dengue virus
QLAVTIMTI

SEQ ID NO: 251447 - protein, 9 aa, Dengue virus
LLLLTLLAA

SEQ ID NO: 251448 - protein, 9 aa, Dengue virus
FSGVSWIMK

SEQ ID NO: 251449 - protein, 9 aa, Dengue virus
HMIVGRQEK

SEQ ID NO: 251450 - protein, 9 aa, Dengue virus
TVWNRVWIL

SEQ ID NO: 251451 - protein, 9 aa, Dengue virus
SMTCVAVGL

SEQ ID NO: 251452 - protein, 9 aa, Dengue virus
LLMRTSWAL

SEQ ID NO: 251453 - protein, 9 aa, Dengue virus
LMMMFPATL

SEQ ID NO: 251454 - protein, 9 aa, Dengue virus
YVMCTGPFK

SEQ ID NO: 251455 - protein, 9 aa, Dengue virus
MSSGNILFM

SEQ ID NO: 251456 - protein, 9 aa, Dengue virus
MPVMRRYSA

SEQ ID NO: 251457 - protein, 9 aa, Dengue virus
GPLRMVLAF

SEQ ID NO: 251458 - protein, 9 aa, Dengue virus
YLAGAGLAF

SEQ ID NO: 251459 - protein, 9 aa, Dengue virus
FSGVSWVMK

SEQ ID NO: 251460 - protein, 9 aa, Dengue virus
CMAVGGITL

SEQ ID NO: 251461 - protein, 9 aa, Dengue virus
VIAFFLAHA

SEQ ID NO: 251462 - protein, 9 aa, Dengue virus
KLTLKGISY

SEQ ID NO: 251463 - protein, 9 aa, Dengue virus
VMCTGLFKL

SEQ ID NO: 251464 - protein, 9 aa, Dengue virus
KITQWLETK

SEQ ID NO: 251465 - protein, 9 aa, Dengue virus
RMGMGMTYL

SEQ ID NO: 251466 - protein, 9 aa, Dengue virus
RTAGIIIMV

SEQ ID NO: 251467 - protein, 9 aa, Dengue virus
MFGGVSWMI

SEQ ID NO: 251468 - protein, 9 aa, Dengue virus
WGKARIVTA

SEQ ID NO: 251469 - protein, 9 aa, Dengue virus
TAGPWHLGK

SEQ ID NO: 251470 - protein, 9 aa, Dengue virus
LSRKDFDLY

SEQ ID NO: 251471 - protein, 9 aa, Dengue virus
AIDGEYRLK

SEQ ID NO: 251472 - protein, 9 aa, Dengue virus
SYAMCSGTF

SEQ ID NO: 251473 - protein, 9 aa, Dengue virus
SLSMTCIAV

SEQ ID NO: 251474 - protein, 9 aa, Dengue virus
RVAAEGINY

SEQ ID NO: 251475 - protein, 9 aa, Dengue virus
VVIGILTLA

SEQ ID NO: 251476 - protein, 9 aa, Dengue virus
LNRRKRSTM

SEQ ID NO: 251477 - protein, 9 aa, Dengue virus
SWFKRGSSI

SEQ ID NO: 251478 - protein, 9 aa, Dengue virus
MALSIVSLF

SEQ ID NO: 251479 - protein, 9 aa, Dengue virus
WGKAKMLPT

SEQ ID NO: 251480 - protein, 9 aa, Dengue virus
SAAQRRGRI

SEQ ID NO: 251481 - protein, 9 aa, Dengue virus
TQESNWIQK

SEQ ID NO: 251482 - protein, 9 aa, Dengue virus
ILIAHKDGV

SEQ ID NO: 251483 - protein, 9 aa, Dengue virus
FLSGKGLGK

SEQ ID NO: 251484 - protein, 9 aa, Dengue virus
RLRDSYTQV

SEQ ID NO: 251485 - protein, 9 aa, Dengue virus
KSKAINVLR

SEQ ID NO: 251486 - protein, 9 aa, Dengue virus
PTYLSSRAK

SEQ ID NO: 251487 - protein, 9 aa, Dengue virus
YILRDISNI

SEQ ID NO: 251488 - protein, 9 aa, Dengue virus
LMAIDLGEL

SEQ ID NO: 251489 - protein, 9 aa, Dengue virus
YLRPQPTEL

SEQ ID NO: 251490 - protein, 9 aa, Dengue virus
ILLENDMKL

SEQ ID NO: 251491 - protein, 9 aa, Dengue virus
MVRILIGLL

SEQ ID NO: 251492 - protein, 9 aa, Dengue virus
IAVGLITLY

SEQ ID NO: 251493 - protein, 9 aa, Dengue virus
VTVASAAQR

SEQ ID NO: 251494 - protein, 9 aa, Dengue virus
VVTYGLNTF

SEQ ID NO: 251495 - protein, 9 aa, Dengue virus
YAMCTNTFV

SEQ ID NO: 251496 - protein, 9 aa, Dengue virus
LTASLVMLF

SEQ ID NO: 251497 - protein, 9 aa, Dengue virus
GVLGMALFL

SEQ ID NO: 251498 - protein, 9 aa, Dengue virus
EVKTCVWPK

SEQ ID NO: 251499 - protein, 9 aa, Dengue virus
TFRMRPMFA

SEQ ID NO: 251500 - protein, 9 aa, Dengue virus
AALSEGVYR

SEQ ID NO: 251501 - protein, 9 aa, Dengue virus
MTTTFSIPH

SEQ ID NO: 251502 - protein, 9 aa, Dengue virus
PVMKRYSAL

SEQ ID NO: 251503 - protein, 9 aa, Dengue virus
GILGMALFL

SEQ ID NO: 251504 - protein, 9 aa, Dengue virus
AMKRYSAHF

SEQ ID NO: 251505 - protein, 9 aa, Dengue virus
LGKKKTPRL

SEQ ID NO: 251506 - protein, 9 aa, Dengue virus
ALTPQPMEL

SEQ ID NO: 251507 - protein, 9 aa, Dengue virus
IMAVGMVSI

SEQ ID NO: 251508 - protein, 9 aa, Dengue virus
KAVQHENLK

SEQ ID NO: 251509 - protein, 9 aa, Dengue virus
KLSVGLIAI

SEQ ID NO: 251510 - protein, 9 aa, Dengue virus
KTVQYENLK

SEQ ID NO: 251511 - protein, 9 aa, Dengue virus
MSIPATLFV

SEQ ID NO: 251512 - protein, 9 aa, Dengue virus
MAAVLAYTI

SEQ ID NO: 251513 - protein, 9 aa, Dengue virus
MALKLITQF

SEQ ID NO: 251514 - protein, 9 aa, Dengue virus
TPTWNKKEL

SEQ ID NO: 251515 - protein, 9 aa, Dengue virus
ATLLSLTFI

SEQ ID NO: 251516 - protein, 9 aa, Dengue virus
VSWKNKELK

SEQ ID NO: 251517 - protein, 9 aa, Dengue virus
IPNHGVTAT

SEQ ID NO: 251518 - protein, 9 aa, Dengue virus
KTSLCLVMI

SEQ ID NO: 251519 - protein, 9 aa, Dengue virus
LTLKGTSYV

SEQ ID NO: 251520 - protein, 9 aa, Dengue virus
LLLVAISFV

SEQ ID NO: 251521 - protein, 9 aa, Dengue virus
TLKNVTEVK

SEQ ID NO: 251522 - protein, 9 aa, Dengue virus
SLSMTCIVV

SEQ ID NO: 251523 - protein, 9 aa, Dengue virus
TVLELTDAL

SEQ ID NO: 251524 - protein, 9 aa, Dengue virus
TTILDVDLR

SEQ ID NO: 251525 - protein, 9 aa, Dengue virus
FQENVFHTM

SEQ ID NO: 251526 - protein, 9 aa, Dengue virus
MIALFLAHA

SEQ ID NO: 251527 - protein, 9 aa, Dengue virus
MILQHAWKV

SEQ ID NO: 251528 - protein, 9 aa, Dengue virus
TFIKTTMPL

SEQ ID NO: 251529 - protein, 9 aa, Dengue virus
VSSVNMISR

SEQ ID NO: 251530 - protein, 9 aa, Dengue virus
SPPEVGRAV

SEQ ID NO: 251531 - protein, 9 aa, Dengue virus
CLQKQSHWV

SEQ ID NO: 251532 - protein, 9 aa, Dengue virus
QVFGAIYGA

SEQ ID NO: 251533 - protein, 9 aa, Dengue virus
FQRALIFIL

SEQ ID NO: 251534 - protein, 9 aa, Dengue virus
HRREKRSVA

SEQ ID NO: 251535 - protein, 9 aa, Dengue virus
SMAMSCIVV

SEQ ID NO: 251536 - protein, 9 aa, Dengue virus
KNTPFNMLK

SEQ ID NO: 251537 - protein, 9 aa, Dengue virus
KTARPSFNM

SEQ ID NO: 251538 - protein, 9 aa, Dengue virus
RTAGFLIMV

SEQ ID NO: 251539 - protein, 9 aa, Dengue virus
VSAITQAER

SEQ ID NO: 251540 - protein, 9 aa, Dengue virus
LIVSGIFPY

SEQ ID NO: 251541 - protein, 9 aa, Dengue virus
GSLIGLTSR

SEQ ID NO: 251542 - protein, 9 aa, Dengue virus
KMKGKTWLV

SEQ ID NO: 251543 - protein, 9 aa, Dengue virus
KLMSGKDVF

SEQ ID NO: 251544 - protein, 9 aa, Dengue virus
LLFKTASGI

SEQ ID NO: 251545 - protein, 9 aa, Dengue virus
ASDLKYSWK

SEQ ID NO: 251546 - protein, 9 aa, Dengue virus
KLLTDFQSY

SEQ ID NO: 251547 - protein, 9 aa, Dengue virus
APTWNRKEL

SEQ ID NO: 251548 - protein, 9 aa, Dengue virus
YAMCTKTFV

SEQ ID NO: 251549 - protein, 9 aa, Dengue virus
FTDPASIAA

SEQ ID NO: 251550 - protein, 9 aa, Dengue virus
FCSHHFHEL

SEQ ID NO: 251551 - protein, 9 aa, Dengue virus
GLNSRSTSL

SEQ ID NO: 251552 - protein, 9 aa, Dengue virus
LQRKHGGNL

SEQ ID NO: 251553 - protein, 9 aa, Dengue virus
AMFTCLKKM

SEQ ID NO: 251554 - protein, 9 aa, Dengue virus
RANDWDFVV

SEQ ID NO: 251555 - protein, 9 aa, Dengue virus
LNRRKRSTI

SEQ ID NO: 251556 - protein, 9 aa, Dengue virus
NIVKLMSGK

SEQ ID NO: 251557 - protein, 9 aa, Dengue virus
TLEVHWNHK

SEQ ID NO: 251558 - protein, 9 aa, Dengue virus
FGSAYTALF

SEQ ID NO: 251559 - protein, 9 aa, Dengue virus
VIIAILTVV

SEQ ID NO: 251560 - protein, 9 aa, Dengue virus
RLRIKGMSY

SEQ ID NO: 251561 - protein, 9 aa, Dengue virus
SPATAQKAM

SEQ ID NO: 251562 - protein, 9 aa, Dengue virus
LPLCQSSSM

SEQ ID NO: 251563 - protein, 9 aa, Dengue virus
TLIAAVLML

SEQ ID NO: 251564 - protein, 9 aa, Dengue virus
ILRNPGFAL

SEQ ID NO: 251565 - protein, 9 aa, Dengue virus
RQMEGEGVF

SEQ ID NO: 251566 - protein, 9 aa, Dengue virus
ALALGMMAL

SEQ ID NO: 251567 - protein, 9 aa, Dengue virus
NILFMGHLK

SEQ ID NO: 251568 - protein, 9 aa, Dengue virus
WSLMYFHRR

SEQ ID NO: 251569 - protein, 9 aa, Dengue virus
SMAVSCIAV

SEQ ID NO: 251570 - protein, 9 aa, Dengue virus
SLTFISSTM

SEQ ID NO: 251571 - protein, 9 aa, Dengue virus
TTNIWLKLK

SEQ ID NO: 251572 - protein, 9 aa, Dengue virus
RLKMDKLTL

SEQ ID NO: 251573 - protein, 9 aa, Dengue virus
MVLLTMKEK

SEQ ID NO: 251574 - protein, 9 aa, Dengue virus
GAVLTYNGK

SEQ ID NO: 251575 - protein, 9 aa, Dengue virus
KLVMAFIAF

SEQ ID NO: 251576 - protein, 9 aa, Dengue virus
CTGKFKVVK

SEQ ID NO: 251577 - protein, 9 aa, Dengue virus
GLFTSVGKL

SEQ ID NO: 251578 - protein, 9 aa, Dengue virus
RVISATPLA

SEQ ID NO: 251579 - protein, 9 aa, Dengue virus
GMGEAAAIF

SEQ ID NO: 251580 - protein, 9 aa, Dengue virus
TTILTPMLR

SEQ ID NO: 251581 - protein, 9 aa, Dengue virus
AMTAGIFLF

SEQ ID NO: 251582 - protein, 9 aa, Dengue virus
CVSILIEEV

SEQ ID NO: 251583 - protein, 9 aa, Dengue virus
PTQGEPFLK

SEQ ID NO: 251584 - protein, 9 aa, Dengue virus
LPAIVREAI

SEQ ID NO: 251585 - protein, 9 aa, Dengue virus
TLIFILLTA

SEQ ID NO: 251586 - protein, 9 aa, Dengue virus
YLPAIVREA

SEQ ID NO: 251587 - protein, 9 aa, Dengue virus
MLLNRFTMT

SEQ ID NO: 251588 - protein, 9 aa, Dengue virus
SIGGVFTSI

SEQ ID NO: 251589 - protein, 9 aa, Dengue virus
FTMTHRRPT

SEQ ID NO: 251590 - protein, 9 aa, Dengue virus
FVKTTFSVH

SEQ ID NO: 251591 - protein, 9 aa, Dengue virus
YILWENNIK

SEQ ID NO: 251592 - protein, 9 aa, Dengue virus
LVLCAVQLL

SEQ ID NO: 251593 - protein, 9 aa, Dengue virus
WVMKIGIGI

SEQ ID NO: 251594 - protein, 9 aa, Dengue virus
TQGLNWIQK

SEQ ID NO: 251595 - protein, 9 aa, Dengue virus
FLMLMPTAL

SEQ ID NO: 251596 - protein, 9 aa, Dengue virus
AVVLQNAWK

SEQ ID NO: 251597 - protein, 9 aa, Dengue virus
CSNAFVLKK

SEQ ID NO: 251598 - protein, 9 aa, Dengue virus
VIDPRRCMK

SEQ ID NO: 251599 - protein, 9 aa, Dengue virus
KTWAYHGSY

SEQ ID NO: 251600 - protein, 9 aa, Dengue virus
MAMTDTTPF

SEQ ID NO: 251601 - protein, 9 aa, Dengue virus
RMRPMFAVG

SEQ ID NO: 251602 - protein, 9 aa, Dengue virus
YLPAIIREA

SEQ ID NO: 251603 - protein, 9 aa, Dengue virus
LTAALLLLI

SEQ ID NO: 251604 - protein, 9 aa, Dengue virus
KPIDDRFAS

SEQ ID NO: 251605 - protein, 9 aa, Dengue virus
GIITLYLGV

SEQ ID NO: 251606 - protein, 9 aa, Dengue virus
VTDPAVLRK

SEQ ID NO: 251607 - protein, 9 aa, Dengue virus
VIMDEAHFT

SEQ ID NO: 251608 - protein, 9 aa, Dengue virus
TLIAAVLLL

SEQ ID NO: 251609 - protein, 9 aa, Dengue virus
SRWSRRMLM

SEQ ID NO: 251610 - protein, 9 aa, Dengue virus
QMESKAWLV

SEQ ID NO: 251611 - protein, 9 aa, Dengue virus
TMKHKKATY

SEQ ID NO: 251612 - protein, 9 aa, Dengue virus
MTTTLSIPH

SEQ ID NO: 251613 - protein, 9 aa, Dengue virus
IPKNFAGPV

SEQ ID NO: 251614 - protein, 9 aa, Dengue virus
KTFDSEYIK

SEQ ID NO: 251615 - protein, 9 aa, Dengue virus
LLAAYVMSG

SEQ ID NO: 251616 - protein, 9 aa, Dengue virus
MLFVHYAII

SEQ ID NO: 251617 - protein, 9 aa, Dengue virus
WLKLREMYS

SEQ ID NO: 251618 - protein, 9 aa, Dengue virus
IIFILLMLV

SEQ ID NO: 251619 - protein, 9 aa, Dengue virus
TMKKKSWLV

SEQ ID NO: 251620 - protein, 9 aa, Dengue virus
EALKRRLRT

SEQ ID NO: 251621 - protein, 9 aa, Dengue virus
CTREEFISK

SEQ ID NO: 251622 - protein, 9 aa, Dengue virus
AVIEHLERL

SEQ ID NO: 251623 - protein, 9 aa, Dengue virus
TTLSRTNKK

SEQ ID NO: 251624 - protein, 9 aa, Dengue virus
VPTWNRKEL

SEQ ID NO: 251625 - protein, 9 aa, Dengue virus
RPRLCTREE

SEQ ID NO: 251626 - protein, 9 aa, Dengue virus
SQMLIPKTY

SEQ ID NO: 251627 - protein, 9 aa, Dengue virus
IFLFFMQGK

SEQ ID NO: 251628 - protein, 9 aa, Dengue virus
SVGGVFTSV

SEQ ID NO: 251629 - protein, 9 aa, Dengue virus
HPGFTVIAL

SEQ ID NO: 251630 - protein, 9 aa, Dengue virus
KPGTSGSPI

SEQ ID NO: 251631 - protein, 9 aa, Dengue virus
MGLGKGWPL

SEQ ID NO: 251632 - protein, 9 aa, Dengue virus
LIMAWRTIM

SEQ ID NO: 251633 - protein, 9 aa, Dengue virus
TYQLWTALV

SEQ ID NO: 251634 - protein, 9 aa, Dengue virus
AQMWTLMYF

SEQ ID NO: 251635 - protein, 9 aa, Dengue virus
IALGLMTLK

SEQ ID NO: 251636 - protein, 9 aa, Dengue virus
TYGWNLVKL

SEQ ID NO: 251637 - protein, 9 aa, Dengue virus
MTAGTFLFF

SEQ ID NO: 251638 - protein, 9 aa, Dengue virus
KLFMALVAF

SEQ ID NO: 251639 - protein, 9 aa, Dengue virus
SLLTCAKFK

SEQ ID NO: 251640 - protein, 9 aa, Dengue virus
KSAAVDGEY

SEQ ID NO: 251641 - protein, 9 aa, Dengue virus
IVVQNWLAR

SEQ ID NO: 251642 - protein, 9 aa, Dengue virus
KQESNWIQK

SEQ ID NO: 251643 - protein, 9 aa, Dengue virus
FQEGVFHTM

SEQ ID NO: 251644 - protein, 9 aa, Dengue virus
VMALFLAHA

SEQ ID NO: 251645 - protein, 9 aa, Dengue virus
TSNHGVTAM

SEQ ID NO: 251646 - protein, 9 aa, Dengue virus
SVIERMEAL

SEQ ID NO: 251647 - protein, 9 aa, Dengue virus
ILNAHKDGV

SEQ ID NO: 251648 - protein, 9 aa, Dengue virus
GINSRSTSL

SEQ ID NO: 251649 - protein, 9 aa, Dengue virus
MILMKMKAK

SEQ ID NO: 251650 - protein, 9 aa, Dengue virus
PTLDFELTK

SEQ ID NO: 251651 - protein, 9 aa, Dengue virus
LLTVGLSLV

SEQ ID NO: 251652 - protein, 9 aa, Dengue virus
GGRAYRHAV

SEQ ID NO: 251653 - protein, 9 aa, Dengue virus
KPLDERFAT

SEQ ID NO: 251654 - protein, 9 aa, Dengue virus
RPTPKGTVM

SEQ ID NO: 251655 - protein, 9 aa, Dengue virus
WAFCEALTL

SEQ ID NO: 251656 - protein, 9 aa, Dengue virus
MCLNAFVLK

SEQ ID NO: 251657 - protein, 9 aa, Dengue virus
TTVITPMMR

SEQ ID NO: 251658 - protein, 9 aa, Dengue virus
ITASILLWH

SEQ ID NO: 251659 - protein, 9 aa, Dengue virus
SLITCAKFK

SEQ ID NO: 251660 - protein, 9 aa, Dengue virus
LLLIAHYAI

SEQ ID NO: 251661 - protein, 9 aa, Dengue virus
ILLTAVTPS

SEQ ID NO: 251662 - protein, 9 aa, Dengue virus
LNRRRRSTV

SEQ ID NO: 251663 - protein, 9 aa, Dengue virus
VLIFILLTA

SEQ ID NO: 251664 - protein, 9 aa, Dengue virus
YAWKTMAMI

SEQ ID NO: 251665 - protein, 9 aa, Dengue virus
VIFVLLMLV

SEQ ID NO: 251666 - protein, 9 aa, Dengue virus
LGKKKTPRM

SEQ ID NO: 251667 - protein, 9 aa, Dengue virus
RLITVNPII

SEQ ID NO: 251668 - protein, 9 aa, Dengue virus
KLVHQVFGA

SEQ ID NO: 251669 - protein, 9 aa, Dengue virus
FIFSLKDAL

SEQ ID NO: 251670 - protein, 9 aa, Dengue virus
LTLNLITEM

SEQ ID NO: 251671 - protein, 9 aa, Dengue virus
SVMCIAVGM

SEQ ID NO: 251672 - protein, 9 aa, Dengue virus
TMTYRKPTI

SEQ ID NO: 251673 - protein, 9 aa, Dengue virus
TLKGISYVM

SEQ ID NO: 251674 - protein, 9 aa, Dengue virus
ALGKNEFQI

SEQ ID NO: 251675 - protein, 9 aa, Dengue virus
RLKMDKLEL

SEQ ID NO: 251676 - protein, 9 aa, Dengue virus
IFTTNIWLK

SEQ ID NO: 251677 - protein, 9 aa, Dengue virus
VVKPLDERF

SEQ ID NO: 251678 - protein, 9 aa, Dengue virus
ALTLHWFRK

SEQ ID NO: 251679 - protein, 9 aa, Dengue virus
CTKEEFISK

SEQ ID NO: 251680 - protein, 9 aa, Dengue virus
SGSPIINKK

SEQ ID NO: 251681 - protein, 9 aa, Dengue virus
LIFILLTAI

SEQ ID NO: 251682 - protein, 9 aa, Dengue virus
VPNYNMIIM

SEQ ID NO: 251683 - protein, 9 aa, Dengue virus
HPGFTTMAA

SEQ ID NO: 251684 - protein, 9 aa, Dengue virus
DLMEFIDGI

SEQ ID NO: 251685 - protein, 9 aa, Dengue virus
EMCDDTVTY

SEQ ID NO: 251686 - protein, 9 aa, Dengue virus
VIGMAMTTV

SEQ ID NO: 251687 - protein, 9 aa, Dengue virus
KAAEVSWEK

SEQ ID NO: 251688 - protein, 9 aa, Dengue virus
SLLPLCLST

SEQ ID NO: 251689 - protein, 9 aa, Dengue virus
DVFFIPPEK

SEQ ID NO: 251690 - protein, 9 aa, Dengue virus
IPKAYAGPI

SEQ ID NO: 251691 - protein, 9 aa, Dengue virus
LLITHYAII

SEQ ID NO: 251692 - protein, 9 aa, Dengue virus
GTVMDVISR

SEQ ID NO: 251693 - protein, 9 aa, Dengue virus
SSMINGVVK

SEQ ID NO: 251694 - protein, 9 aa, Dengue virus
YTPEGIIPT

SEQ ID NO: 251695 - protein, 9 aa, Dengue virus
GLFSGKGPL

SEQ ID NO: 251696 - protein, 9 aa, Dengue virus
RLAEAIFKL

SEQ ID NO: 251697 - protein, 9 aa, Dengue virus
RVIDPRRCM

SEQ ID NO: 251698 - protein, 9 aa, Dengue virus
AVFFVVTLI

SEQ ID NO: 251699 - protein, 9 aa, Dengue virus
AMASGLLWI

SEQ ID NO: 251700 - protein, 9 aa, Dengue virus
APLESEGVL

SEQ ID NO: 251701 - protein, 9 aa, Dengue virus
ATLKNVTEV

SEQ ID NO: 251702 - protein, 9 aa, Dengue virus
WAKNIQAAI

SEQ ID NO: 251703 - protein, 9 aa, Dengue virus
MATFKMRPM

SEQ ID NO: 251704 - protein, 9 aa, Dengue virus
WHYDDENPY

SEQ ID NO: 251705 - protein, 9 aa, Dengue virus
KSGAIKVLR

SEQ ID NO: 251706 - protein, 9 aa, Dengue virus
LTNTTTESR

SEQ ID NO: 251707 - protein, 9 aa, Dengue virus
MTQKARNAL

SEQ ID NO: 251708 - protein, 9 aa, Dengue virus
GTILVQIKY

SEQ ID NO: 251709 - protein, 9 aa, Dengue virus
FPYSIPATL

SEQ ID NO: 251710 - protein, 9 aa, Dengue virus
VPHAKRQDV

SEQ ID NO: 251711 - protein, 9 aa, Dengue virus
LMLVPTALA

SEQ ID NO: 251712 - protein, 9 aa, Dengue virus
LMMLVAPSY

SEQ ID NO: 251713 - protein, 9 aa, Dengue virus
ITYNCPLLK

SEQ ID NO: 251714 - protein, 9 aa, Dengue virus
GLGVLLTWL

SEQ ID NO: 251715 - protein, 9 aa, Dengue virus
MLLMLMPTA

SEQ ID NO: 251716 - protein, 9 aa, Dengue virus
LALGMMALK

SEQ ID NO: 251717 - protein, 9 aa, Dengue virus
ILLTAIAPS

SEQ ID NO: 251718 - protein, 9 aa, Dengue virus
SSMVNGVVR

SEQ ID NO: 251719 - protein, 9 aa, Dengue virus
VVVGDTIGV

SEQ ID NO: 251720 - protein, 9 aa, Dengue virus
AYTIGTTYF

SEQ ID NO: 251721 - protein, 9 aa, Dengue virus
TPRAKRGTA

SEQ ID NO: 251722 - protein, 9 aa, Dengue virus
LAVVSVSPL

SEQ ID NO: 251723 - protein, 9 aa, Dengue virus
SMTFIRTTF

SEQ ID NO: 251724 - protein, 9 aa, Dengue virus
ISKMLLNRF

SEQ ID NO: 251725 - protein, 9 aa, Dengue virus
WIMKIGIGV

SEQ ID NO: 251726 - protein, 9 aa, Dengue virus
SMTCIAVGM

SEQ ID NO: 251727 - protein, 9 aa, Dengue virus
LVLCAGQLF

SEQ ID NO: 251728 - protein, 9 aa, Dengue virus
DLRLAANAI

SEQ ID NO: 251729 - protein, 9 aa, Dengue virus
LTNTTTASR

SEQ ID NO: 251730 - protein, 9 aa, Dengue virus
WTMKILIGA

SEQ ID NO: 251731 - protein, 9 aa, Dengue virus
LMMTTIGIV

SEQ ID NO: 251732 - protein, 9 aa, Dengue virus
SLTFIRTTF

SEQ ID NO: 251733 - protein, 9 aa, Dengue virus
MAAILAYTV

SEQ ID NO: 251734 - protein, 9 aa, Dengue virus
SVTMLLMLV

SEQ ID NO: 251735 - protein, 9 aa, Dengue virus
TSGSPIVNR

SEQ ID NO: 251736 - protein, 9 aa, Dengue virus
LMSGKDVFY

SEQ ID NO: 251737 - protein, 9 aa, Dengue virus
VLMHRGKRI

SEQ ID NO: 251738 - protein, 9 aa, Dengue virus
MILMKMKTK

SEQ ID NO: 251739 - protein, 9 aa, Dengue virus
SMGKLVHQV

SEQ ID NO: 251740 - protein, 9 aa, Dengue virus
GILTLAAIV

SEQ ID NO: 251741 - protein, 9 aa, Dengue virus
TMAHRKPTF

SEQ ID NO: 251742 - protein, 9 aa, Dengue virus
LTPPVNDLK

SEQ ID NO: 251743 - protein, 9 aa, Dengue virus
AKMLSTESY

SEQ ID NO: 251744 - protein, 9 aa, Dengue virus
TIGVLEQGK

SEQ ID NO: 251745 - protein, 9 aa, Dengue virus
LPDYGELSL

SEQ ID NO: 251746 - protein, 9 aa, Dengue virus
GIVTCAMFR

SEQ ID NO: 251747 - protein, 9 aa, Dengue virus
QMEGEGLFK

SEQ ID NO: 251748 - protein, 9 aa, Dengue virus
MALKDFKEF

SEQ ID NO: 251749 - protein, 9 aa, Dengue virus
LALFLAHYV

SEQ ID NO: 251750 - protein, 9 aa, Dengue virus
FISSTMPLV

SEQ ID NO: 251751 - protein, 9 aa, Dengue virus
VLAFITFLR

SEQ ID NO: 251752 - protein, 9 aa, Dengue virus
KLREGSSEV

SEQ ID NO: 251753 - protein, 9 aa, Dengue virus
ATHLATLRK

SEQ ID NO: 251754 - protein, 9 aa, Dengue virus
YMPAVIEHL

SEQ ID NO: 251755 - protein, 9 aa, Dengue virus
SMAMSCIAV

SEQ ID NO: 251756 - protein, 9 aa, Dengue virus
TLTGEIGAV

SEQ ID NO: 251757 - protein, 9 aa, Dengue virus
KPMPGTRKV

SEQ ID NO: 251758 - protein, 9 aa, Dengue virus
KVVIFILLI

SEQ ID NO: 251759 - protein, 9 aa, Dengue virus
ALPVYLMTL

SEQ ID NO: 251760 - protein, 9 aa, Dengue virus
ILGYSQIGA

SEQ ID NO: 251761 - protein, 9 aa, Dengue virus
GLYPLAIPI

SEQ ID NO: 251762 - protein, 9 aa, Dengue virus
TPRTPSVEV

SEQ ID NO: 251763 - protein, 9 aa, Dengue virus
IPKSLAGPI

SEQ ID NO: 251764 - protein, 9 aa, Dengue virus
TVGPWHLGK

SEQ ID NO: 251765 - protein, 9 aa, Dengue virus
IAGPWHLGK

SEQ ID NO: 251766 - protein, 9 aa, Dengue virus
KTSLCLMMV

SEQ ID NO: 251767 - protein, 9 aa, Dengue virus
TFAAGLFLR

SEQ ID NO: 251768 - protein, 9 aa, Dengue virus
KTRANDWDF

SEQ ID NO: 251769 - protein, 9 aa, Dengue virus
KQWFLNLPL

SEQ ID NO: 251770 - protein, 9 aa, Dengue virus
GLLCVTASS

SEQ ID NO: 251771 - protein, 9 aa, Dengue virus
IILGGLTWM

SEQ ID NO: 251772 - protein, 9 aa, Dengue virus
TTNIWMKFR

SEQ ID NO: 251773 - protein, 9 aa, Dengue virus
LPDYGELTL

SEQ ID NO: 251774 - protein, 9 aa, Dengue virus
MLLMLIPTA

SEQ ID NO: 251775 - protein, 9 aa, Dengue virus
QMEGEGVFK

SEQ ID NO: 251776 - protein, 9 aa, Dengue virus
MLSVHYAII

SEQ ID NO: 251777 - protein, 9 aa, Dengue virus
SNMLNTMNR

SEQ ID NO: 251778 - protein, 9 aa, Dengue virus
VVQNWLARV

SEQ ID NO: 251779 - protein, 9 aa, Dengue virus
STVQQLTKR

SEQ ID NO: 251780 - protein, 9 aa, Dengue virus
VVVMVGATM

SEQ ID NO: 251781 - protein, 9 aa, Dengue virus
NIWLRLREK

SEQ ID NO: 251782 - protein, 9 aa, Dengue virus
FMKDGRSLV

SEQ ID NO: 251783 - protein, 9 aa, Dengue virus
TMCSGKFSI

SEQ ID NO: 251784 - protein, 9 aa, Dengue virus
VTRGAVLTY

SEQ ID NO: 251785 - protein, 9 aa, Dengue virus
TMFLITENK

SEQ ID NO: 251786 - protein, 9 aa, Dengue virus
LPEYGTLGL

SEQ ID NO: 251787 - protein, 9 aa, Dengue virus
SYSMCTGKF

SEQ ID NO: 251788 - protein, 9 aa, Dengue virus
GLLCLTLFM

SEQ ID NO: 251789 - protein, 9 aa, Dengue virus
TYFQRVLIF

SEQ ID NO: 251790 - protein, 9 aa, Dengue virus
YAWKTTAMV

SEQ ID NO: 251791 - protein, 9 aa, Dengue virus
HILLENGMK

SEQ ID NO: 251792 - protein, 9 aa, Dengue virus
NRRRRTAGM

SEQ ID NO: 251793 - protein, 9 aa, Dengue virus
IAVGLVTLY

SEQ ID NO: 251794 - protein, 9 aa, Dengue virus
KSYAQMWTL

SEQ ID NO: 251795 - protein, 9 aa, Dengue virus
FIRSTIPLV

SEQ ID NO: 251796 - protein, 9 aa, Dengue virus
PLNEGIMAV

SEQ ID NO: 251797 - protein, 9 aa, Dengue virus
ILPDGPERV

SEQ ID NO: 251798 - protein, 9 aa, Dengue virus
RQLANAIFK

SEQ ID NO: 251799 - protein, 9 aa, Dengue virus
GIQRAVFFV

SEQ ID NO: 251800 - protein, 9 aa, Dengue virus
RQGYATQTV

SEQ ID NO: 251801 - protein, 9 aa, Dengue virus
SYVMCTGLF

SEQ ID NO: 251802 - protein, 9 aa, Dengue virus
AQWKKGEEV

SEQ ID NO: 251803 - protein, 9 aa, Dengue virus
IFLFLMSGK

SEQ ID NO: 251804 - protein, 9 aa, Dengue virus
IQMSGTTTI

SEQ ID NO: 251805 - protein, 9 aa, Dengue virus
SMFEPEREK

SEQ ID NO: 251806 - protein, 9 aa, Dengue virus
ALGMMILKI

SEQ ID NO: 251807 - protein, 9 aa, Dengue virus
MVGANASDK

SEQ ID NO: 251808 - protein, 9 aa, Dengue virus
NFVCRRTFV

SEQ ID NO: 251809 - protein, 9 aa, Dengue virus
TIPESILEL

SEQ ID NO: 251810 - protein, 9 aa, Dengue virus
LMMMLPATL

SEQ ID NO: 251811 - protein, 9 aa, Dengue virus
TILIKIEYK

SEQ ID NO: 251812 - protein, 9 aa, Dengue virus
LAIPPTAGV

SEQ ID NO: 251813 - protein, 9 aa, Dengue virus
TLTASLVML

SEQ ID NO: 251814 - protein, 9 aa, Dengue virus
ILRHPGFTL

SEQ ID NO: 251815 - protein, 9 aa, Dengue virus
QPMEHRYSW

SEQ ID NO: 251816 - protein, 9 aa, Dengue virus
SMEKYQLAV

SEQ ID NO: 251817 - protein, 9 aa, Dengue virus
CVMSSSALL

SEQ ID NO: 251818 - protein, 9 aa, Dengue virus
AAFKVRPTF

SEQ ID NO: 251819 - protein, 9 aa, Dengue virus
VLNLVENWL

SEQ ID NO: 251820 - protein, 9 aa, Dengue virus
TLSLDYAWK

SEQ ID NO: 251821 - protein, 9 aa, Dengue virus
ALWYMWQVK

SEQ ID NO: 251822 - protein, 9 aa, Dengue virus
HQWMTTEDM

SEQ ID NO: 251823 - protein, 9 aa, Dengue virus
RMVLAFITF

SEQ ID NO: 251824 - protein, 9 aa, Dengue virus
TTNIWLRLR

SEQ ID NO: 251825 - protein, 9 aa, Dengue virus
LIVSGVFPY

SEQ ID NO: 251826 - protein, 9 aa, Dengue virus
WAKNIHTAI

SEQ ID NO: 251827 - protein, 9 aa, Dengue virus
SLKDTPKRK

SEQ ID NO: 251828 - protein, 9 aa, Dengue virus
TQHGTILVK

SEQ ID NO: 251829 - protein, 9 aa, Dengue virus
RAVFFVLMM

SEQ ID NO: 251830 - protein, 9 aa, Dengue virus
VVLPENLEY

SEQ ID NO: 251831 - protein, 9 aa, Dengue virus
TTLDILTEI

SEQ ID NO: 251832 - protein, 9 aa, Dengue virus
FMNEDHWFS

SEQ ID NO: 251833 - protein, 9 aa, Dengue virus
MLWMAEIPL

SEQ ID NO: 251834 - protein, 9 aa, Dengue virus
RVLDWLKKY

SEQ ID NO: 251835 - protein, 9 aa, Dengue virus
LIFILLAAV

SEQ ID NO: 251836 - protein, 9 aa, Dengue virus
ITLFLGFTV

SEQ ID NO: 251837 - protein, 9 aa, Dengue virus
LMMATIGIA

SEQ ID NO: 251838 - protein, 9 aa, Dengue virus
TVIEHLERL

SEQ ID NO: 251839 - protein, 9 aa, Dengue virus
NPITLTAAL

SEQ ID NO: 251840 - protein, 9 aa, Dengue virus
FLIMVIPTV

SEQ ID NO: 251841 - protein, 9 aa, Dengue virus
SLLKNDVPL

SEQ ID NO: 251842 - protein, 9 aa, Dengue virus
VIYDSKFEK

SEQ ID NO: 251843 - protein, 9 aa, Dengue virus
TILELTDAL

SEQ ID NO: 251844 - protein, 9 aa, Dengue virus
LQSGVDVFF

SEQ ID NO: 251845 - protein, 9 aa, Dengue virus
ILLVAVSFL

SEQ ID NO: 251846 - protein, 9 aa, Dengue virus
IMAAILAHT

SEQ ID NO: 251847 - protein, 9 aa, Dengue virus
VVVGDIIGV

SEQ ID NO: 251848 - protein, 9 aa, Dengue virus
HSWEDIPYL

SEQ ID NO: 251849 - protein, 9 aa, Dengue virus
KLPDYGELT

SEQ ID NO: 251850 - protein, 9 aa, Dengue virus
TPQAPTSEI

SEQ ID NO: 251851 - protein, 9 aa, Dengue virus
GTVMDIISR

SEQ ID NO: 251852 - protein, 9 aa, Dengue virus
WLGARFLEF

SEQ ID NO: 251853 - protein, 9 aa, Dengue virus
WLVHKQWFL

SEQ ID NO: 251854 - protein, 9 aa, Dengue virus
RQIQKVETW

SEQ ID NO: 251855 - protein, 9 aa, Dengue virus
LMMILPATL

SEQ ID NO: 251856 - protein, 9 aa, Dengue virus
IVVGDVIGV

SEQ ID NO: 251857 - protein, 9 aa, Dengue virus
TQGSNWIQK

SEQ ID NO: 251858 - protein, 9 aa, Dengue virus
AIKRRLRTL

SEQ ID NO: 251859 - protein, 9 aa, Dengue virus
KLREMYTQL

SEQ ID NO: 251860 - protein, 9 aa, Dengue virus
TLAVFLLLI

SEQ ID NO: 251861 - protein, 9 aa, Dengue virus
MLMTGTLAV

SEQ ID NO: 251862 - protein, 9 aa, Dengue virus
KMDIGVPLL

SEQ ID NO: 251863 - protein, 9 aa, Dengue virus
MIAGVLFMF

SEQ ID NO: 251864 - protein, 9 aa, Dengue virus
LLGVGLAMA

SEQ ID NO: 251865 - protein, 9 aa, Dengue virus
VLNPYMPAV

SEQ ID NO: 251866 - protein, 9 aa, Dengue virus
TYSDPLALK

SEQ ID NO: 251867 - protein, 9 aa, Dengue virus
RLQSGVDVF

SEQ ID NO: 251868 - protein, 9 aa, Dengue virus
CTGPFKLEK

SEQ ID NO: 251869 - protein, 9 aa, Dengue virus
KLFMAFVAF

SEQ ID NO: 251870 - protein, 9 aa, Dengue virus
GMFTTNIWM

SEQ ID NO: 251871 - protein, 9 aa, Dengue virus
WTMKILIGV

SEQ ID NO: 251872 - protein, 9 aa, Dengue virus
IINRRKRSV

SEQ ID NO: 251873 - protein, 9 aa, Dengue virus
LLSLVAHYA

SEQ ID NO: 251874 - protein, 9 aa, Dengue virus
LTLKGISYV

SEQ ID NO: 251875 - protein, 9 aa, Dengue virus
LLLRKLTSK

SEQ ID NO: 251876 - protein, 9 aa, Dengue virus
TIIGRRLQR

SEQ ID NO: 251877 - protein, 9 aa, Dengue virus
SMSFSCIAI

SEQ ID NO: 251878 - protein, 9 aa, Dengue virus
SSVNTISKM

SEQ ID NO: 251879 - protein, 9 aa, Dengue virus
MIRILIGIL

SEQ ID NO: 251880 - protein, 9 aa, Dengue virus
FIDGLSLGL

SEQ ID NO: 251881 - protein, 9 aa, Dengue virus
LTWIGLNSK

SEQ ID NO: 251882 - protein, 9 aa, Dengue virus
LGKCGSCVY

SEQ ID NO: 251883 - protein, 9 aa, Dengue virus
LNRRRRSTM

SEQ ID NO: 251884 - protein, 9 aa, Dengue virus
LQRTEATQL

SEQ ID NO: 251885 - protein, 9 aa, Dengue virus
MILMKMEKK

SEQ ID NO: 251886 - protein, 9 aa, Dengue virus
SQVNPLTLI

SEQ ID NO: 251887 - protein, 9 aa, Dengue virus
LVAGGLLTV

SEQ ID NO: 251888 - protein, 9 aa, Dengue virus
RTVFFILMM

SEQ ID NO: 251889 - protein, 9 aa, Dengue virus
CIAVGLVTL

SEQ ID NO: 251890 - protein, 9 aa, Dengue virus
SPKRLATAI

SEQ ID NO: 251891 - protein, 9 aa, Dengue virus
VILLNAWKV

SEQ ID NO: 251892 - protein, 9 aa, Dengue virus
IVFKMSPGY

SEQ ID NO: 251893 - protein, 9 aa, Dengue virus
SQGETLGEK

SEQ ID NO: 251894 - protein, 9 aa, Dengue virus
IVTAETQNF

SEQ ID NO: 251895 - protein, 9 aa, Dengue virus
EMILMEMKK

SEQ ID NO: 251896 - protein, 9 aa, Dengue virus
LLAKAIFKL

SEQ ID NO: 251897 - protein, 9 aa, Dengue virus
AVMDIISRK

SEQ ID NO: 251898 - protein, 9 aa, Dengue virus
RLLGNENYL

SEQ ID NO: 251899 - protein, 9 aa, Dengue virus
VMCTGPFKL

SEQ ID NO: 251900 - protein, 9 aa, Dengue virus
AGLAFSLIK

SEQ ID NO: 251901 - protein, 9 aa, Dengue virus
PTLDIELQK

SEQ ID NO: 251902 - protein, 9 aa, Dengue virus
RARNRVSTV

SEQ ID NO: 251903 - protein, 9 aa, Dengue virus
FMQGKGIGK

SEQ ID NO: 251904 - protein, 9 aa, Dengue virus
RLKEKQDAF

SEQ ID NO: 251905 - protein, 9 aa, Dengue virus
YAWKTMAMV

SEQ ID NO: 251906 - protein, 9 aa, Dengue virus
NVKKDLISY

SEQ ID NO: 251907 - protein, 9 aa, Dengue virus
LLLLGLMIL

SEQ ID NO: 251908 - protein, 9 aa, Dengue virus
SVGKALHQV

SEQ ID NO: 251909 - protein, 9 aa, Dengue virus
RSTPFNMLK

SEQ ID NO: 251910 - protein, 9 aa, Dengue virus
NRRKRSVTM

SEQ ID NO: 251911 - protein, 9 aa, Dengue virus
GGVFTSIGK

SEQ ID NO: 251912 - protein, 9 aa, Dengue virus
RPTPTGTVM

SEQ ID NO: 251913 - protein, 9 aa, Dengue virus
SPGYVLGVF

SEQ ID NO: 251914 - protein, 9 aa, Dengue virus
IVLEFFMMV

SEQ ID NO: 251915 - protein, 9 aa, Dengue virus
LTMAWRTIM

SEQ ID NO: 251916 - protein, 9 aa, Dengue virus
VVYDAKFEK

SEQ ID NO: 251917 - protein, 9 aa, Dengue virus
QPHWIAASI

SEQ ID NO: 251918 - protein, 9 aa, Dengue virus
TFLFFMQGK

SEQ ID NO: 251919 - protein, 9 aa, Dengue virus
MIRILIGFL

SEQ ID NO: 251920 - protein, 9 aa, Dengue virus
LPIRYQTTA

SEQ ID NO: 251921 - protein, 9 aa, Dengue virus
WIIRILIGL

SEQ ID NO: 251922 - protein, 9 aa, Dengue virus
ILAGFMAYM

SEQ ID NO: 251923 - protein, 9 aa, Dengue virus
KVAAEGINY

SEQ ID NO: 251924 - protein, 9 aa, Dengue virus
MCLNTFVLK

SEQ ID NO: 251925 - protein, 9 aa, Dengue virus
MLLNRFTTR

SEQ ID NO: 251926 - protein, 9 aa, Dengue virus
GVTATITPR

SEQ ID NO: 251927 - protein, 9 aa, Dengue virus
TLLCLIPTV

SEQ ID NO: 251928 - protein, 9 aa, Dengue virus
LPWLPGADI

SEQ ID NO: 251929 - protein, 9 aa, Dengue virus
TIMDLHPGA

SEQ ID NO: 251930 - protein, 9 aa, Dengue virus
KTFDTEYPK

SEQ ID NO: 251931 - protein, 9 aa, Dengue virus
WMTTEDMLA

SEQ ID NO: 251932 - protein, 9 aa, Dengue virus
GLLCLTLFI

SEQ ID NO: 251933 - protein, 9 aa, Dengue virus
ILLKATLLA

SEQ ID NO: 251934 - protein, 9 aa, Dengue virus
LMSGRGVGK

SEQ ID NO: 251935 - protein, 9 aa, Dengue virus
IGMAMTTVF

SEQ ID NO: 251936 - protein, 9 aa, Dengue virus
LATLRKLCI

SEQ ID NO: 251937 - protein, 9 aa, Dengue virus
LPAIIREAI

SEQ ID NO: 251938 - protein, 9 aa, Dengue virus
SSKPEFCIK

SEQ ID NO: 251939 - protein, 9 aa, Dengue virus
RILAKAIFK

SEQ ID NO: 251940 - protein, 9 aa, Dengue virus
NTYKRSGIM

SEQ ID NO: 251941 - protein, 9 aa, Dengue virus
MVISCVPNA

SEQ ID NO: 251942 - protein, 9 aa, Dengue virus
IMQAGRRSL

SEQ ID NO: 251943 - protein, 9 aa, Dengue virus
MFTTNIWMK

SEQ ID NO: 251944 - protein, 9 aa, Dengue virus
KILAKAIFK

SEQ ID NO: 251945 - protein, 9 aa, Dengue virus
NRRRRSVGM

SEQ ID NO: 251946 - protein, 9 aa, Dengue virus
IMKDGRILV

SEQ ID NO: 251947 - protein, 9 aa, Dengue virus
QLKLSWFKK

SEQ ID NO: 251948 - protein, 9 aa, Dengue virus
LLFKTATGI

SEQ ID NO: 251949 - protein, 9 aa, Dengue virus
RLGYILREV

SEQ ID NO: 251950 - protein, 9 aa, Dengue virus
TTKTPTWNR

SEQ ID NO: 251951 - protein, 9 aa, Dengue virus
LMTGTLVVF

SEQ ID NO: 251952 - protein, 9 aa, Dengue virus
ALALGMMIL

SEQ ID NO: 251953 - protein, 9 aa, Dengue virus
NPLTLTAAV

SEQ ID NO: 251954 - protein, 9 aa, Dengue virus
LVVAITFCA

SEQ ID NO: 251955 - protein, 9 aa, Dengue virus
SLPLFIFSL

SEQ ID NO: 251956 - protein, 9 aa, Dengue virus
MFKKRNLTI

SEQ ID NO: 251957 - protein, 9 aa, Dengue virus
VMAVGMVSI

SEQ ID NO: 251958 - protein, 9 aa, Dengue virus
MISRMLINR

SEQ ID NO: 251959 - protein, 9 aa, Dengue virus
HTWQKQTQR

SEQ ID NO: 251960 - protein, 9 aa, Dengue virus
TLAKAIFKL

SEQ ID NO: 251961 - protein, 9 aa, Dengue virus
TPKAKRGTV

SEQ ID NO: 251962 - protein, 9 aa, Dengue virus
GLFTSLGKA

SEQ ID NO: 251963 - protein, 9 aa, Dengue virus
AMLLVAVSF

SEQ ID NO: 251964 - protein, 9 aa, Dengue virus
RITQWLETK

SEQ ID NO: 251965 - protein, 9 aa, Dengue virus
FLDLPLPWL

SEQ ID NO: 251966 - protein, 9 aa, Dengue virus
KLTLKGMSY

SEQ ID NO: 251967 - protein, 9 aa, Dengue virus
LARWSSFKK

SEQ ID NO: 251968 - protein, 9 aa, Dengue virus
SQKNGSWKL

SEQ ID NO: 251969 - protein, 9 aa, Dengue virus
FQPESPSKL

SEQ ID NO: 251970 - protein, 9 aa, Dengue virus
YQLAVTVMA

SEQ ID NO: 251971 - protein, 9 aa, Dengue virus
IYGAAFSGV

SEQ ID NO: 251972 - protein, 9 aa, Dengue virus
LLLITHYAI

SEQ ID NO: 251973 - protein, 9 aa, Dengue virus
VSTVSQLAK

SEQ ID NO: 251974 - protein, 9 aa, Dengue virus
RLGYILEDI

SEQ ID NO: 251975 - protein, 9 aa, Dengue virus
FMTATPPGS

SEQ ID NO: 251976 - protein, 9 aa, Dengue virus
VLCAGQLFL

SEQ ID NO: 251977 - protein, 9 aa, Dengue virus
LISGKGIGK

SEQ ID NO: 251978 - protein, 9 aa, Dengue virus
SLTCSNTMF

SEQ ID NO: 251979 - protein, 9 aa, Dengue virus
MMLKLLTDF

SEQ ID NO: 251980 - protein, 9 aa, Dengue virus
FLAHYVGTS

SEQ ID NO: 251981 - protein, 9 aa, Dengue virus
NQAAILMGL

SEQ ID NO: 251982 - protein, 9 aa, Dengue virus
PTLDIELLK

SEQ ID NO: 251983 - protein, 9 aa, Dengue virus
LAYTIGTTY

SEQ ID NO: 251984 - protein, 9 aa, Dengue virus
QLANAIFKL

SEQ ID NO: 251985 - protein, 9 aa, Dengue virus
SLIGLTARA

SEQ ID NO: 251986 - protein, 9 aa, Dengue virus
TFIKSTMPL

SEQ ID NO: 251987 - protein, 9 aa, Dengue virus
GPLIAGGML

SEQ ID NO: 251988 - protein, 9 aa, Dengue virus
LLLTSSRQK

SEQ ID NO: 251989 - protein, 9 aa, Dengue virus
VMCTGSFKL

SEQ ID NO: 251990 - protein, 9 aa, Dengue virus
FTVIALFLA

SEQ ID NO: 251991 - protein, 9 aa, Dengue virus
SLSVSLVLV

SEQ ID NO: 251992 - protein, 9 aa, Dengue virus
AVVSVSPLI

SEQ ID NO: 251993 - protein, 9 aa, Dengue virus
KLRDSYTQM

SEQ ID NO: 251994 - protein, 9 aa, Dengue virus
IQRVETWVL

SEQ ID NO: 251995 - protein, 9 aa, Dengue virus
AVLTYNGKR

SEQ ID NO: 251996 - protein, 9 aa, Dengue virus
KMEKKTWLV

SEQ ID NO: 251997 - protein, 9 aa, Dengue virus
MSAAIKDER

SEQ ID NO: 251998 - protein, 9 aa, Dengue virus
GVLESQMLI

SEQ ID NO: 251999 - protein, 9 aa, Dengue virus
FQPHQLWTT

SEQ ID NO: 252000 - protein, 9 aa, Dengue virus
KVSCTILAA

SEQ ID NO: 252001 - protein, 9 aa, Dengue virus
CVTTMARNK

SEQ ID NO: 252002 - protein, 9 aa, Dengue virus
TTANWLWAL

SEQ ID NO: 252003 - protein, 9 aa, Dengue virus
LTWNDLTRL

SEQ ID NO: 252004 - protein, 9 aa, Dengue virus
IPKMYGGPI

SEQ ID NO: 252005 - protein, 9 aa, Dengue virus
IMLTPTVMA

SEQ ID NO: 252006 - protein, 9 aa, Dengue virus
FLIDGPETT

SEQ ID NO: 252007 - protein, 9 aa, Dengue virus
LVMLSVHYA

SEQ ID NO: 252008 - protein, 9 aa, Dengue virus
LTAALFLLV

SEQ ID NO: 252009 - protein, 9 aa, Dengue virus
KFWNTTIAV

SEQ ID NO: 252010 - protein, 9 aa, Dengue virus
HMIVSIQEK

SEQ ID NO: 252011 - protein, 9 aa, Dengue virus
MPVTAASAA

SEQ ID NO: 252012 - protein, 9 aa, Dengue virus
WTMKIGLGV

SEQ ID NO: 252013 - protein, 9 aa, Dengue virus
VMVMVGATM

SEQ ID NO: 252014 - protein, 9 aa, Dengue virus
LLATSIFKL

SEQ ID NO: 252015 - protein, 9 aa, Dengue virus
GVQRTVFFV

SEQ ID NO: 252016 - protein, 9 aa, Dengue virus
SSWEDVPYL

SEQ ID NO: 252017 - protein, 9 aa, Dengue virus
RPMFAVGLL

SEQ ID NO: 252018 - protein, 9 aa, Dengue virus
NLLFTGHLK

SEQ ID NO: 252019 - protein, 9 aa, Dengue virus
HMIAGVFFM

SEQ ID NO: 252020 - protein, 9 aa, Dengue virus
TSIGLLCVM

SEQ ID NO: 252021 - protein, 9 aa, Dengue virus
RFVCRHSMV

SEQ ID NO: 252022 - protein, 9 aa, Dengue virus
GLLCLTLFV

SEQ ID NO: 252023 - protein, 9 aa, Dengue virus
ILLKMVTHF

SEQ ID NO: 252024 - protein, 9 aa, Dengue virus
VLVGVITLY

SEQ ID NO: 252025 - protein, 9 aa, Dengue virus
LAAVTGGIF

SEQ ID NO: 252026 - protein, 9 aa, Dengue virus
VTYGTCTTM

SEQ ID NO: 252027 - protein, 9 aa, Dengue virus
GGVFTSMGK

SEQ ID NO: 252028 - protein, 9 aa, Dengue virus
LMLIALLGA

SEQ ID NO: 252029 - protein, 9 aa, Dengue virus
TQVPFCSHH

SEQ ID NO: 252030 - protein, 9 aa, Dengue virus
RTLAKEGIK

SEQ ID NO: 252031 - protein, 9 aa, Dengue virus
ATWATNIQV

SEQ ID NO: 252032 - protein, 9 aa, Dengue virus
KPVDDRFAT

SEQ ID NO: 252033 - protein, 9 aa, Dengue virus
KLSMGLIAI

SEQ ID NO: 252034 - protein, 9 aa, Dengue virus
IAGALFTFV

SEQ ID NO: 252035 - protein, 9 aa, Dengue virus
FMMVLLIPE

SEQ ID NO: 252036 - protein, 9 aa, Dengue virus
RLIGNENYL

SEQ ID NO: 252037 - protein, 9 aa, Dengue virus
MVMAFIAFL

SEQ ID NO: 252038 - protein, 9 aa, Dengue virus
LLMLVPTAL

SEQ ID NO: 252039 - protein, 9 aa, Dengue virus
YLAGAGLLF

SEQ ID NO: 252040 - protein, 9 aa, Dengue virus
LVQIENLEY

SEQ ID NO: 252041 - protein, 9 aa, Dengue virus
LTAAVLLLV

SEQ ID NO: 252042 - protein, 9 aa, Dengue virus
KSGAIKVLK

SEQ ID NO: 252043 - protein, 9 aa, Dengue virus
HILSENEAK

SEQ ID NO: 252044 - protein, 9 aa, Dengue virus
RLEPSWASV

SEQ ID NO: 252045 - protein, 9 aa, Dengue virus
ATYGWNLVK

SEQ ID NO: 252046 - protein, 9 aa, Dengue virus
MPGIFQTTM

SEQ ID NO: 252047 - protein, 9 aa, Dengue virus
RLTSRETAL

SEQ ID NO: 252048 - protein, 9 aa, Dengue virus
KLRDSHTQM

SEQ ID NO: 252049 - protein, 9 aa, Dengue virus
GVVTRSGTY

SEQ ID NO: 252050 - protein, 9 aa, Dengue virus
ILLENGMKF

SEQ ID NO: 252051 - protein, 9 aa, Dengue virus
NYKERMVTF

SEQ ID NO: 252052 - protein, 9 aa, Dengue virus
ALGRSEFQI

SEQ ID NO: 252053 - protein, 9 aa, Dengue virus
KLKEKQDVF

SEQ ID NO: 252054 - protein, 9 aa, Dengue virus
KPSGSASSM

SEQ ID NO: 252055 - protein, 9 aa, Dengue virus
VMAFIAFLR

SEQ ID NO: 252056 - protein, 9 aa, Dengue virus
LQRKHGGSL

SEQ ID NO: 252057 - protein, 9 aa, Dengue virus
LLFKTSAGV

SEQ ID NO: 252058 - protein, 9 aa, Dengue virus
LAKRFSRGL

SEQ ID NO: 252059 - protein, 9 aa, Dengue virus
GIALGLMTL

SEQ ID NO: 252060 - protein, 9 aa, Dengue virus
GLLVISGVF

SEQ ID NO: 252061 - protein, 9 aa, Dengue virus
MVLLQMEEK

SEQ ID NO: 252062 - protein, 9 aa, Dengue virus
SFGKMVHQI

SEQ ID NO: 252063 - protein, 9 aa, Dengue virus
MIAGALFTF

SEQ ID NO: 252064 - protein, 9 aa, Dengue virus
LTIMTGEIK

SEQ ID NO: 252065 - protein, 9 aa, Dengue virus
ILLVTVSFV

SEQ ID NO: 252066 - protein, 9 aa, Dengue virus
GLLTVCYVL

SEQ ID NO: 252067 - protein, 9 aa, Dengue virus
STYGWNLVR

SEQ ID NO: 252068 - protein, 9 aa, Dengue virus
PMFLITENK

SEQ ID NO: 252069 - protein, 9 aa, Dengue virus
TTFVTPMLR

SEQ ID NO: 252070 - protein, 9 aa, Dengue virus
IPKNLAGPV

SEQ ID NO: 252071 - protein, 9 aa, Dengue virus
AMLLVHYAI

SEQ ID NO: 252072 - protein, 9 aa, Dengue virus
TPRGAVMDI

SEQ ID NO: 252073 - protein, 9 aa, Dengue virus
HWFSRENSF

SEQ ID NO: 252074 - protein, 9 aa, Dengue virus
FTMGVLCLA

SEQ ID NO: 252075 - protein, 9 aa, Dengue virus
IPRDLMEFI

SEQ ID NO: 252076 - protein, 9 aa, Dengue virus
VFTTNIWLK

SEQ ID NO: 252077 - protein, 9 aa, Dengue virus
AVLMYQGKR

SEQ ID NO: 252078 - protein, 9 aa, Dengue virus
CAKFLCSGK

SEQ ID NO: 252079 - protein, 9 aa, Dengue virus
VFSTNIWLK

SEQ ID NO: 252080 - protein, 9 aa, Dengue virus
GILKRWGTI

SEQ ID NO: 252081 - protein, 9 aa, Dengue virus
LITGNMSFK

SEQ ID NO: 252082 - protein, 9 aa, Dengue virus
LAVSGVYPL

SEQ ID NO: 252083 - protein, 9 aa, Dengue virus
VATTFITPM

SEQ ID NO: 252084 - protein, 9 aa, Dengue virus
CPTQGEATL

SEQ ID NO: 252085 - protein, 9 aa, Dengue virus
QPKPGTRVV

SEQ ID NO: 252086 - protein, 9 aa, Dengue virus
ALLAKSIFK

SEQ ID NO: 252087 - protein, 9 aa, Dengue virus
IQNSGGTSI

SEQ ID NO: 252088 - protein, 9 aa, Dengue virus
LLMRTTWAL

SEQ ID NO: 252089 - protein, 9 aa, Dengue virus
LLLLIAHYA

SEQ ID NO: 252090 - protein, 9 aa, Dengue virus
KPEFCIKVL

SEQ ID NO: 252091 - protein, 9 aa, Dengue virus
LAVFLLLTM

SEQ ID NO: 252092 - protein, 9 aa, Dengue virus
LIMVIPTVM

SEQ ID NO: 252093 - protein, 9 aa, Dengue virus
RTIMAVFFV

SEQ ID NO: 252094 - protein, 9 aa, Dengue virus
VLTGGVTLF

SEQ ID NO: 252095 - protein, 9 aa, Dengue virus
YFQRVLIFI

SEQ ID NO: 252096 - protein, 9 aa, Dengue virus
AQMWQLMYF

SEQ ID NO: 252097 - protein, 9 aa, Dengue virus
FLLLTLGQL

SEQ ID NO: 252098 - protein, 9 aa, Dengue virus
SMGLIAIAV

SEQ ID NO: 252099 - protein, 9 aa, Dengue virus
WLPMTVAAM

SEQ ID NO: 252100 - protein, 9 aa, Dengue virus
SLIQKVVIF

SEQ ID NO: 252101 - protein, 9 aa, Dengue virus
KITQWLENK

SEQ ID NO: 252102 - protein, 9 aa, Dengue virus
NPTTLTASL

SEQ ID NO: 252103 - protein, 9 aa, Dengue virus
TLLVALSFV

SEQ ID NO: 252104 - protein, 9 aa, Dengue virus
VSSWEEVPY

SEQ ID NO: 252105 - protein, 9 aa, Dengue virus
LQRRHGGSL

SEQ ID NO: 252106 - protein, 9 aa, Dengue virus
HMIAGVLFT

SEQ ID NO: 252107 - protein, 9 aa, Dengue virus
GLLSGQGPM

SEQ ID NO: 252108 - protein, 9 aa, Dengue virus
VLLKTALLI

SEQ ID NO: 252109 - protein, 9 aa, Dengue virus
VIFILLMLV

SEQ ID NO: 252110 - protein, 9 aa, Dengue virus
MIVGVLFTF

SEQ ID NO: 252111 - protein, 9 aa, Dengue virus
FTVTAFFLA

SEQ ID NO: 252112 - protein, 9 aa, Dengue virus
RKKAKTTPF

SEQ ID NO: 252113 - protein, 9 aa, Dengue virus
AVLLLVTHY

SEQ ID NO: 252114 - protein, 9 aa, Dengue virus
QVMLLILCV

SEQ ID NO: 252115 - protein, 9 aa, Dengue virus
RKKAKNTPF

SEQ ID NO: 252116 - protein, 9 aa, Dengue virus
LQRRYGGSL

SEQ ID NO: 252117 - protein, 9 aa, Dengue virus
LSIPATLFV

SEQ ID NO: 252118 - protein, 9 aa, Dengue virus
GIVTLYLGV

SEQ ID NO: 252119 - protein, 9 aa, Dengue virus
ISYGGGWRF

SEQ ID NO: 252120 - protein, 9 aa, Dengue virus
TPEVRNSTF

SEQ ID NO: 252121 - protein, 9 aa, Dengue virus
MAMTTTFSI

SEQ ID NO: 252122 - protein, 9 aa, Dengue virus
KLRDSYTQA

SEQ ID NO: 252123 - protein, 9 aa, Dengue virus
MLVRNPLSR

SEQ ID NO: 252124 - protein, 9 aa, Dengue virus
MLKRERNRV

SEQ ID NO: 252125 - protein, 9 aa, Dengue virus
TMAWRTIMA

SEQ ID NO: 252126 - protein, 9 aa, Dengue virus
VSSVNTISK

SEQ ID NO: 252127 - protein, 9 aa, Dengue virus
LAHYVGTSL

SEQ ID NO: 252128 - protein, 9 aa, Dengue virus
GIVTLYLGV

SEQ ID NO: 252129 - protein, 9 aa, Dengue virus
ISYGGGWRF

SEQ ID NO: 252130 - protein, 9 aa, Dengue virus
TPEVRNSTF

SEQ ID NO: 252131 - protein, 9 aa, Dengue virus
MAMTTTFSI

SEQ ID NO: 252132 - protein, 9 aa, Dengue virus
KLRDSYTQA

SEQ ID NO: 252133 - protein, 9 aa, Dengue virus
MLVRNPLSR

SEQ ID NO: 252134 - protein, 9 aa, Dengue virus
MLKRERNRV

SEQ ID NO: 252135 - protein, 9 aa, Dengue virus
TMAWRTIMA

SEQ ID NO: 252136 - protein, 9 aa, Dengue virus
VSSVNTISK

SEQ ID NO: 252137 - protein, 9 aa, Dengue virus
LAHYVGTSL

SEQ ID NO: 252138 - protein, 9 aa, Dengue virus
TTMAAILAY

SEQ ID NO: 252139 - protein, 9 aa, Dengue virus
RVRPTFAVG

SEQ ID NO: 252140 - protein, 9 aa, Dengue virus
FAGKTVWFV

SEQ ID NO: 252141 - protein, 9 aa, Dengue virus
MKMEKKTWL

SEQ ID NO: 252142 - protein, 9 aa, Dengue virus
VERLRRMAI

SEQ ID NO: 252143 - protein, 9 aa, Dengue virus
GLLCTSIMI

SEQ ID NO: 252144 - protein, 9 aa, Dengue virus
STIGKMFEA

SEQ ID NO: 252145 - protein, 9 aa, Dengue virus
IGAVTLDFK

SEQ ID NO: 252146 - protein, 9 aa, Dengue virus
VTEVRGYTK

SEQ ID NO: 252147 - protein, 9 aa, Dengue virus
KQIQKVETW

SEQ ID NO: 252148 - protein, 9 aa, Dengue virus
TMKGKSWLV

SEQ ID NO: 252149 - protein, 9 aa, Dengue virus
LTYQNKVVK

SEQ ID NO: 252150 - protein, 9 aa, Dengue virus
KQIQRVETW

SEQ ID NO: 252151 - protein, 9 aa, Dengue virus
QTSGTTTIF

SEQ ID NO: 252152 - protein, 9 aa, Dengue virus
HWFSRENSL

SEQ ID NO: 252153 - protein, 9 aa, Dengue virus
TTLLSLTFV

SEQ ID NO: 252154 - protein, 9 aa, Dengue virus
YMGEDGCWY

SEQ ID NO: 252155 - protein, 9 aa, Dengue virus
MNRRKRSVT

SEQ ID NO: 252156 - protein, 9 aa, Dengue virus
APSTGSASS

SEQ ID NO: 252157 - protein, 9 aa, Dengue virus
GGRAYNHAL

SEQ ID NO: 252158 - protein, 9 aa, Dengue virus
SNMLSIINR

SEQ ID NO: 252159 - protein, 9 aa, Dengue virus
QISGGTSIF

SEQ ID NO: 252160 - protein, 9 aa, Dengue virus
QLAYVVIGI

SEQ ID NO: 252161 - protein, 9 aa, Dengue virus
GLNSRNTSL

SEQ ID NO: 252162 - protein, 9 aa, Dengue virus
MVGANAFDR

SEQ ID NO: 252163 - protein, 9 aa, Dengue virus
WGKAKVVTA

SEQ ID NO: 252164 - protein, 9 aa, Dengue virus
IMTIDLDPV

SEQ ID NO: 252165 - protein, 9 aa, Dengue virus
AVQNWLVRV

SEQ ID NO: 252166 - protein, 9 aa, Dengue virus
MKMKKKTWL

SEQ ID NO: 252167 - protein, 9 aa, Dengue virus
VSSIAQTEK

SEQ ID NO: 252168 - protein, 9 aa, Dengue virus
MTAGIFLFF

SEQ ID NO: 252169 - protein, 9 aa, Dengue virus
TYLALLAAF

SEQ ID NO: 252170 - protein, 9 aa, Dengue virus
LWKQVANEL

SEQ ID NO: 252171 - protein, 9 aa, Dengue virus
GVFSTNIWL

SEQ ID NO: 252172 - protein, 9 aa, Dengue virus
GVTAMITPR

SEQ ID NO: 252173 - protein, 9 aa, Dengue virus
TQIAGPWHL

SEQ ID NO: 252174 - protein, 9 aa, Dengue virus
WSYYCAGLK

SEQ ID NO: 252175 - protein, 9 aa, Dengue virus
YMPSVIERM

SEQ ID NO: 252176 - protein, 9 aa, Dengue virus
VLCAGQLLL

SEQ ID NO: 252177 - protein, 9 aa, Dengue virus
VTHSSAAQR

SEQ ID NO: 252178 - protein, 9 aa, Dengue virus
VAVGLVTLY

SEQ ID NO: 252179 - protein, 9 aa, Dengue virus
ILWENNIKL

SEQ ID NO: 252180 - protein, 9 aa, Dengue virus
VSWTGKELK

SEQ ID NO: 252181 - protein, 9 aa, Dengue virus
KALKLSWFK

SEQ ID NO: 252182 - protein, 9 aa, Dengue virus
ILMLLPTAL

SEQ ID NO: 252183 - protein, 9 aa, Dengue virus
SVLLWYAQI

SEQ ID NO: 252184 - protein, 9 aa, Dengue virus
QIDNFSLGV

SEQ ID NO: 252185 - protein, 9 aa, Dengue virus
KLGEFGKAK

SEQ ID NO: 252186 - protein, 9 aa, Dengue virus
IFRKKRLTI

SEQ ID NO: 252187 - protein, 9 aa, Dengue virus
LLVALSFVT

SEQ ID NO: 252188 - protein, 9 aa, Dengue virus
YILLENDMK

SEQ ID NO: 252189 - protein, 9 aa, Dengue virus
GLFKLEKEV

SEQ ID NO: 252190 - protein, 9 aa, Dengue virus
QLWTALVSL

SEQ ID NO: 252191 - protein, 9 aa, Dengue virus
FLLLIMGQL

SEQ ID NO: 252192 - protein, 9 aa, Dengue virus
ILAENEVKL

SEQ ID NO: 252193 - protein, 9 aa, Dengue virus
GVFHTMWHV

SEQ ID NO: 252194 - protein, 9 aa, Dengue virus
ILLVALSFV

SEQ ID NO: 252195 - protein, 9 aa, Dengue virus
WVMKIGIGV

SEQ ID NO: 252196 - protein, 9 aa, Dengue virus
LLALNDMGK

SEQ ID NO: 252197 - protein, 9 aa, Dengue virus
QPHQLWTTL

SEQ ID NO: 252198 - protein, 9 aa, Dengue virus
TSEVHWNYK

SEQ ID NO: 252199 - protein, 9 aa, Dengue virus
AIEPGKNPK

SEQ ID NO: 252200 - protein, 9 aa, Dengue virus
TIPETILEL

SEQ ID NO: 252201 - protein, 9 aa, Dengue virus
MVLLQMKNK

SEQ ID NO: 252202 - protein, 9 aa, Dengue virus
TKKVRSNAA

SEQ ID NO: 252203 - protein, 9 aa, Dengue virus
NILTAIQQV

SEQ ID NO: 252204 - protein, 9 aa, Dengue virus
ALGKSEFQV

SEQ ID NO: 252205 - protein, 9 aa, Dengue virus
AIKRKLRTL

SEQ ID NO: 252206 - protein, 9 aa, Dengue virus
MTATPPGSM

SEQ ID NO: 252207 - protein, 9 aa, Dengue virus
IVMLHTTER

SEQ ID NO: 252208 - protein, 9 aa, Dengue virus
FTDPSSVAA

SEQ ID NO: 252209 - protein, 9 aa, Dengue virus
ILNRRRRST

SEQ ID NO: 252210 - protein, 9 aa, Dengue virus
RQWFFDLPL

SEQ ID NO: 252211 - protein, 9 aa, Dengue virus
VQWDEMAAI

SEQ ID NO: 252212 - protein, 9 aa, Dengue virus
SVGLIAIAV

SEQ ID NO: 252213 - protein, 9 aa, Dengue virus
GTAKLRWFV

SEQ ID NO: 252214 - protein, 9 aa, Dengue virus
QGKCATCVY

SEQ ID NO: 252215 - protein, 9 aa, Dengue virus
CTGKFKIVK

SEQ ID NO: 252216 - protein, 9 aa, Dengue virus
VALLRTYCI

SEQ ID NO: 252217 - protein, 9 aa, Dengue virus
HPGFTLMAA

SEQ ID NO: 252218 - protein, 9 aa, Dengue virus
KSALRDGSK

SEQ ID NO: 252219 - protein, 9 aa, Dengue virus
ITVGGITLF

SEQ ID NO: 252220 - protein, 9 aa, Dengue virus
EMILMKMKK

SEQ ID NO: 252221 - protein, 9 aa, Dengue virus
DLRLASNAI

SEQ ID NO: 252222 - protein, 9 aa, Dengue virus
SYTMCSGKF

SEQ ID NO: 252223 - protein, 9 aa, Dengue virus
KPRWLDARI

SEQ ID NO: 252224 - protein, 9 aa, Dengue virus
ILNKRRRTA

SEQ ID NO: 252225 - protein, 9 aa, Dengue virus
WYMWLGARF

SEQ ID NO: 252226 - protein, 9 aa, Dengue virus
LIGAIITWI

SEQ ID NO: 252227 - protein, 9 aa, Dengue virus
HILSENEVK

SEQ ID NO: 252228 - protein, 9 aa, Dengue virus
MIGQTRIQR

SEQ ID NO: 252229 - protein, 9 aa, Dengue virus
KTFVELMKR

SEQ ID NO: 252230 - protein, 9 aa, Dengue virus
SSADLSLER

SEQ ID NO: 252231 - protein, 9 aa, Dengue virus
CWCNLTSAW

SEQ ID NO: 252232 - protein, 9 aa, Dengue virus
VSTGTQLAK

SEQ ID NO: 252233 - protein, 9 aa, Dengue virus
CWCNTTDTW

SEQ ID NO: 252234 - protein, 9 aa, Dengue virus
VISCVPNAV

SEQ ID NO: 252235 - protein, 9 aa, Dengue virus
MTGTLAVLF

SEQ ID NO: 252236 - protein, 9 aa, Dengue virus
TLLCLIPTI

SEQ ID NO: 252237 - protein, 9 aa, Dengue virus
FLLLVMGQL

SEQ ID NO: 252238 - protein, 9 aa, Dengue virus
TLPETILEL

SEQ ID NO: 252239 - protein, 9 aa, Dengue virus
MWHVTRGSV

SEQ ID NO: 252240 - protein, 9 aa, Dengue virus
FLAHVIGTS

SEQ ID NO: 252241 - protein, 9 aa, Dengue virus
TLMKGASRR

SEQ ID NO: 252242 - protein, 9 aa, Dengue virus
IVVGLVTLY

SEQ ID NO: 252243 - protein, 9 aa, Dengue virus
QMEEKAWLV

SEQ ID NO: 252244 - protein, 9 aa, Dengue virus
AYRHAMEEL

SEQ ID NO: 252245 - protein, 9 aa, Dengue virus
TLYAVATTI

SEQ ID NO: 252246 - protein, 9 aa, Dengue virus
MTDDIGIGV

SEQ ID NO: 252247 - protein, 9 aa, Dengue virus
KMFEATARG

SEQ ID NO: 252248 - protein, 9 aa, Dengue virus
KQLATLRKY

SEQ ID NO: 252249 - protein, 9 aa, Dengue virus
NRRRRTAGF

SEQ ID NO: 252250 - protein, 9 aa, Dengue virus
GGKAYRHAM

SEQ ID NO: 252251 - protein, 9 aa, Dengue virus
AMEELPDTI

SEQ ID NO: 252252 - protein, 9 aa, Dengue virus
RMEALQRKF

SEQ ID NO: 252253 - protein, 9 aa, Dengue virus
RPKWLDARV

SEQ ID NO: 252254 - protein, 9 aa, Dengue virus
KTLAKAIFK

SEQ ID NO: 252255 - protein, 9 aa, Dengue virus
TTETPIWNR

SEQ ID NO: 252256 - protein, 9 aa, Dengue virus
HSWEDVPYL

SEQ ID NO: 252257 - protein, 9 aa, Dengue virus
RPMPGTRKA

SEQ ID NO: 252258 - protein, 9 aa, Dengue virus
CPTQGEAIL

SEQ ID NO: 252259 - protein, 9 aa, Dengue virus
YAWKTMAMA

SEQ ID NO: 252260 - protein, 9 aa, Dengue virus
YMWLGARFL

SEQ ID NO: 252261 - protein, 9 aa, Dengue virus
LLFKTSVGV

SEQ ID NO: 252262 - protein, 9 aa, Dengue virus
AILCVPNAV

SEQ ID NO: 252263 - protein, 9 aa, Dengue virus
LIALNDMGK

SEQ ID NO: 252264 - protein, 9 aa, Dengue virus
IFGSVYTTM

SEQ ID NO: 252265 - protein, 9 aa, Dengue virus
SMINGVVKL

SEQ ID NO: 252266 - protein, 9 aa, Dengue virus
WSYYMATLK

SEQ ID NO: 252267 - protein, 9 aa, Dengue virus
MILVVVATL

SEQ ID NO: 252268 - protein, 9 aa, Dengue virus
AMLLVVVSF

SEQ ID NO: 252269 - protein, 9 aa, Dengue virus
MWKQISNEL

SEQ ID NO: 252270 - protein, 9 aa, Dengue virus
ALIMLGDTM

SEQ ID NO: 252271 - protein, 9 aa, Dengue virus
MLWMADVPL

SEQ ID NO: 252272 - protein, 9 aa, Dengue virus
ISVLRGFRK

SEQ ID NO: 252273 - protein, 9 aa, Dengue virus
AAILMGLDK

SEQ ID NO: 252274 - protein, 9 aa, Dengue virus
NSRNTPMAM

SEQ ID NO: 252275 - protein, 9 aa, Dengue virus
ILNGRKRSK

SEQ ID NO: 252276 - protein, 9 aa, Dengue virus
LLTGGAMLF

SEQ ID NO: 252277 - protein, 9 aa, Dengue virus
YAQMWTLMY

SEQ ID NO: 252278 - protein, 9 aa, Dengue virus
RMIMTTTAN

SEQ ID NO: 252279 - protein, 9 aa, Dengue virus
MVLLQMEDK

SEQ ID NO: 252280 - protein, 9 aa, Dengue virus
STYGWNLVK

SEQ ID NO: 252281 - protein, 9 aa, Dengue virus
SPARLASAI

SEQ ID NO: 252282 - protein, 9 aa, Dengue virus
LQKTEATHL

SEQ ID NO: 252283 - protein, 9 aa, Dengue virus
WGKAKIVIA

SEQ ID NO: 252284 - protein, 9 aa, Dengue virus
TSEDHWNYK

SEQ ID NO: 252285 - protein, 9 aa, Dengue virus
RPTPRGAVM

SEQ ID NO: 252286 - protein, 9 aa, Dengue virus
LMAMDLGEL

SEQ ID NO: 252287 - protein, 9 aa, Dengue virus
IERLKRMAI

SEQ ID NO: 252288 - protein, 9 aa, Dengue virus
VLFSGVSWT

SEQ ID NO: 252289 - protein, 9 aa, Dengue virus
GLMALKLTT

SEQ ID NO: 252290 - protein, 9 aa, Dengue virus
ASMAICSAV

SEQ ID NO: 252291 - protein, 9 aa, Dengue virus
MTDEMGMGV

SEQ ID NO: 252292 - protein, 9 aa, Dengue virus
VVVMVGAAM

SEQ ID NO: 252293 - protein, 9 aa, Dengue virus
SRWSRKMLM

SEQ ID NO: 252294 - protein, 9 aa, Dengue virus
VIFILLILV

SEQ ID NO: 252295 - protein, 9 aa, Dengue virus
VTQLATLRK

SEQ ID NO: 252296 - protein, 9 aa, Dengue virus
SMVNGVVRL

SEQ ID NO: 252297 - protein, 9 aa, Dengue virus
AQWLETKGV

SEQ ID NO: 252298 - protein, 9 aa, Dengue virus
LTKRFSLGM

SEQ ID NO: 252299 - protein, 9 aa, Dengue virus
WLKMRDSYT

SEQ ID NO: 252300 - protein, 9 aa, Dengue virus
FQSHQLWTT

SEQ ID NO: 252301 - protein, 9 aa, Dengue virus
SNAALGAVF

SEQ ID NO: 252302 - protein, 9 aa, Dengue virus
IAVSMANIF

SEQ ID NO: 252303 - protein, 9 aa, Dengue virus
LVMAWRTIM

SEQ ID NO: 252304 - protein, 9 aa, Dengue virus
MLLVVVSFV

SEQ ID NO: 252305 - protein, 9 aa, Dengue virus
ISLTCSNTM

SEQ ID NO: 252306 - protein, 9 aa, Dengue virus
ITISEDGSM

SEQ ID NO: 252307 - protein, 9 aa, Dengue virus
GTNSRNTSM

SEQ ID NO: 252308 - protein, 9 aa, Dengue virus
GIQRTIFFV

SEQ ID NO: 252309 - protein, 9 aa, Dengue virus
TVCYVLTGR

SEQ ID NO: 252310 - protein, 9 aa, Dengue virus
GVVTRSGAY

SEQ ID NO: 252311 - protein, 9 aa, Dengue virus
RLATAIAGA

SEQ ID NO: 252312 - protein, 9 aa, Dengue virus
AIWYMWLGA

SEQ ID NO: 252313 - protein, 9 aa, Dengue virus
FRKKRLTIM

SEQ ID NO: 252314 - protein, 9 aa, Dengue virus
KVSCTILAV

SEQ ID NO: 252315 - protein, 9 aa, Dengue virus
FGKMVHQIF

SEQ ID NO: 252316 - protein, 9 aa, Dengue virus
RTEAKSALK

SEQ ID NO: 252317 - protein, 9 aa, Dengue virus
KAKTWLVHK

SEQ ID NO: 252318 - protein, 9 aa, Dengue virus
TVNPIVTER

SEQ ID NO: 252319 - protein, 9 aa, Dengue virus
LWKQIANEL

SEQ ID NO: 252320 - protein, 9 aa, Dengue virus
SILASSLLK

SEQ ID NO: 252321 - protein, 9 aa, Dengue virus
KIPGGAMYA

SEQ ID NO: 252322 - protein, 9 aa, Dengue virus
ILLKTVTQF

SEQ ID NO: 252323 - protein, 9 aa, Dengue virus
VMSGSSADL

SEQ ID NO: 252324 - protein, 9 aa, Dengue virus
ALSELPETL

SEQ ID NO: 252325 - protein, 9 aa, Dengue virus
ITYNCPLLR

SEQ ID NO: 252326 - protein, 9 aa, Dengue virus
AIIREAIKR

SEQ ID NO: 252327 - protein, 9 aa, Dengue virus
GFMNEDHWF

SEQ ID NO: 252328 - protein, 9 aa, Dengue virus
STITLLCLI

SEQ ID NO: 252329 - protein, 9 aa, Dengue virus
KLREKQDVF

SEQ ID NO: 252330 - protein, 9 aa, Dengue virus
IMNRRKRSV

SEQ ID NO: 252331 - protein, 9 aa, Dengue virus
LAHYIGTSL

SEQ ID NO: 252332 - protein, 9 aa, Dengue virus
FIFNLKDTL

SEQ ID NO: 252333 - protein, 9 aa, Dengue virus
GILARWGTF

SEQ ID NO: 252334 - protein, 9 aa, Dengue virus
QLWTALISL

SEQ ID NO: 252335 - protein, 9 aa, Dengue virus
TVTEEIAVK

SEQ ID NO: 252336 - protein, 9 aa, Dengue virus
TVIALFLAH

SEQ ID NO: 252337 - protein, 9 aa, Dengue virus
LLLGLLATV

SEQ ID NO: 252338 - protein, 9 aa, Dengue virus
LLAGFMAYM

SEQ ID NO: 252339 - protein, 9 aa, Dengue virus
TQWQKGEEV

SEQ ID NO: 252340 - protein, 9 aa, Dengue virus
ALITVSGLY

SEQ ID NO: 252341 - protein, 9 aa, Dengue virus
SGFWELVDK

SEQ ID NO: 252342 - protein, 9 aa, Dengue virus
MAMTTTLSI

SEQ ID NO: 252343 - protein, 9 aa, Dengue virus
TPQASTAEV

SEQ ID NO: 252344 - protein, 9 aa, Dengue virus
SIPHDLMEL

SEQ ID NO: 252345 - protein, 9 aa, Dengue virus
GLFGKGSLI

SEQ ID NO: 252346 - protein, 9 aa, Dengue virus
TTIITPMMR

SEQ ID NO: 252347 - protein, 9 aa, Dengue virus
ITYKCPFLK

SEQ ID NO: 252348 - protein, 9 aa, Dengue virus
MAFIAFLRF

SEQ ID NO: 252349 - protein, 9 aa, Dengue virus
GLLNGQGPM

SEQ ID NO: 252350 - protein, 9 aa, Dengue virus
LARWGSFKK

SEQ ID NO: 252351 - protein, 9 aa, Dengue virus
WAALLSLTF

SEQ ID NO: 252352 - protein, 9 aa, Dengue virus
MVLSVVSLF

SEQ ID NO: 252353 - protein, 9 aa, Dengue virus
FIFGLKDTL

SEQ ID NO: 252354 - protein, 9 aa, Dengue virus
FCIKVLNPY

SEQ ID NO: 252355 - protein, 9 aa, Dengue virus
RLITANPIV

SEQ ID NO: 252356 - protein, 9 aa, Dengue virus
FLTSSQQKA

SEQ ID NO: 252357 - protein, 9 aa, Dengue virus
WMVRILIGF

SEQ ID NO: 252358 - protein, 9 aa, Dengue virus
TFIKTTFSL

SEQ ID NO: 252359 - protein, 9 aa, Dengue virus
KMKKKTWLV

SEQ ID NO: 252360 - protein, 9 aa, Dengue virus
FLTQDEKGV

SEQ ID NO: 252361 - protein, 9 aa, Dengue virus
MLSIINRRK

SEQ ID NO: 252362 - protein, 9 aa, Dengue virus
SPATTQKAA

SEQ ID NO: 252363 - protein, 9 aa, Dengue virus
TTSQETWNR

SEQ ID NO: 252364 - protein, 9 aa, Dengue virus
QMEDKAWLV

SEQ ID NO: 252365 - protein, 9 aa, Dengue virus
RLREKQDAF

SEQ ID NO: 252366 - protein, 9 aa, Dengue virus
LLLLVAHYA

SEQ ID NO: 252367 - protein, 9 aa, Dengue virus
TIMAAILAY

SEQ ID NO: 252368 - protein, 9 aa, Dengue virus
VAFLRFLTI

SEQ ID NO: 252369 - protein, 9 aa, Dengue virus
RTIMAVLFV

SEQ ID NO: 252370 - protein, 9 aa, Dengue virus
MMLKLLTEF

SEQ ID NO: 252371 - protein, 9 aa, Dengue virus
RSRWSRKML

SEQ ID NO: 252372 - protein, 9 aa, Dengue virus
LISYGGGWK

SEQ ID NO: 252373 - protein, 9 aa, Dengue virus
CSGTFVLKK

SEQ ID NO: 252374 - protein, 9 aa, Dengue virus
GSNTQFCVK

SEQ ID NO: 252375 - protein, 9 aa, Dengue virus
YLALIATFK

SEQ ID NO: 252376 - protein, 9 aa, Dengue virus
TVEAGRTLR

SEQ ID NO: 252377 - protein, 9 aa, Dengue virus
KMRKKTWLV

SEQ ID NO: 252378 - protein, 9 aa, Dengue virus
KIAQWLETK

SEQ ID NO: 252379 - protein, 9 aa, Dengue virus
VLMLVAHYA

SEQ ID NO: 252380 - protein, 9 aa, Dengue virus
AVQNWLARV

SEQ ID NO: 252381 - protein, 9 aa, Dengue virus
ILRHPGFAI

SEQ ID NO: 252382 - protein, 9 aa, Dengue virus
VQTAPGTFK

SEQ ID NO: 252383 - protein, 9 aa, Dengue virus
VSSWEDVPY

SEQ ID NO: 252384 - protein, 9 aa, Dengue virus
MLMAGTLAV

SEQ ID NO: 252385 - protein, 9 aa, Dengue virus
LLTAIAPSM

SEQ ID NO: 252386 - protein, 9 aa, Dengue virus
IIGPGLQAK

SEQ ID NO: 252387 - protein, 9 aa, Dengue virus
YIIIGAGEK

SEQ ID NO: 252388 - protein, 9 aa, Dengue virus
CWCNATDTW

SEQ ID NO: 252389 - protein, 9 aa, Dengue virus
WAKNIQVAI

SEQ ID NO: 252390 - protein, 9 aa, Dengue virus
VVGILAQGK

SEQ ID NO: 252391 - protein, 9 aa, Dengue virus
APSENEGVL

SEQ ID NO: 252392 - protein, 9 aa, Dengue virus
MTLMKGASK

SEQ ID NO: 252393 - protein, 9 aa, Dengue virus
KMVRNMEKY

SEQ ID NO: 252394 - protein, 9 aa, Dengue virus
TPEAKNSTF

SEQ ID NO: 252395 - protein, 9 aa, Dengue virus
GIMQAGKRY

SEQ ID NO: 252396 - protein, 9 aa, Dengue virus
ATLLAISGV

SEQ ID NO: 252397 - protein, 9 aa, Dengue virus
VLLGSFGCK

SEQ ID NO: 252398 - protein, 9 aa, Dengue virus
ISKIPGGAM

SEQ ID NO: 252399 - protein, 9 aa, Dengue virus
MLLDNIYTP

SEQ ID NO: 252400 - protein, 9 aa, Dengue virus
LLMRTTWAF

SEQ ID NO: 252401 - protein, 9 aa, Dengue virus
NYADRRWCF

SEQ ID NO: 252402 - protein, 9 aa, Dengue virus
FGRAKGSRA

SEQ ID NO: 252403 - protein, 9 aa, Dengue virus
TILIKVEYR

SEQ ID NO: 252404 - protein, 9 aa, Dengue virus
TQVGVGVQK

SEQ ID NO: 252405 - protein, 9 aa, Dengue virus
TTWENVPYL

SEQ ID NO: 252406 - protein, 9 aa, Dengue virus
GIGALLTWI

SEQ ID NO: 252407 - protein, 9 aa, Dengue virus
VQTKPGIFK

SEQ ID NO: 252408 - protein, 9 aa, Dengue virus
MTSRMLLNR

SEQ ID NO: 252409 - protein, 9 aa, Dengue virus
GLLCISIII

SEQ ID NO: 252410 - protein, 9 aa, Dengue virus
VLWEGGHDL

SEQ ID NO: 252411 - protein, 9 aa, Dengue virus
TSQETWNRK

SEQ ID NO: 252412 - protein, 9 aa, Dengue virus
SLVMLSVHY

SEQ ID NO: 252413 - protein, 9 aa, Dengue virus
QLAVTVMAM

SEQ ID NO: 252414 - protein, 9 aa, Dengue virus
TMFLIAENK

SEQ ID NO: 252415 - protein, 9 aa, Dengue virus
LIVMDEAHF

SEQ ID NO: 252416 - protein, 9 aa, Dengue virus
CLMMMFPAT

SEQ ID NO: 252417 - protein, 9 aa, Dengue virus
NMVKSLVSA

SEQ ID NO: 252418 - protein, 9 aa, Dengue virus
FIRSTMPLV

SEQ ID NO: 252419 - protein, 9 aa, Dengue virus
TTIFAGHLK

SEQ ID NO: 252420 - protein, 9 aa, Dengue virus
ATVLMGLGR

SEQ ID NO: 252421 - protein, 9 aa, Dengue virus
GMALFLEEM

SEQ ID NO: 252422 - protein, 9 aa, Dengue virus
LTIMTGDTK

SEQ ID NO: 252423 - protein, 9 aa, Dengue virus
IMQRGLFGK

SEQ ID NO: 252424 - protein, 9 aa, Dengue virus
KAINVLRGF

SEQ ID NO: 252425 - protein, 9 aa, Dengue virus
KQTGSASSM

SEQ ID NO: 252426 - protein, 9 aa, Dengue virus
AGLLFSIMK

SEQ ID NO: 252427 - protein, 9 aa, Dengue virus
RPMPGTRKV

SEQ ID NO: 252428 - protein, 9 aa, Dengue virus
YVVIGILTL

SEQ ID NO: 252429 - protein, 9 aa, Dengue virus
MALWYIWQV

SEQ ID NO: 252430 - protein, 9 aa, Dengue virus
GTGNIVASV

SEQ ID NO: 252431 - protein, 9 aa, Dengue virus
ATMLDVDLR

SEQ ID NO: 252432 - protein, 9 aa, Dengue virus
QMSLGNILF

SEQ ID NO: 252433 - protein, 9 aa, Dengue virus
LQKTEVTQL

SEQ ID NO: 252434 - protein, 9 aa, Dengue virus
YPMSIPATL

SEQ ID NO: 252435 - protein, 9 aa, Dengue virus
APSESEGVL

SEQ ID NO: 252436 - protein, 9 aa, Dengue virus
HPGFTVIAF

SEQ ID NO: 252437 - protein, 9 aa, Dengue virus
IVGVFFTFV

SEQ ID NO: 252438 - protein, 9 aa, Dengue virus
TMKILIGAI

SEQ ID NO: 252439 - protein, 9 aa, Dengue virus
ILLKIVTHF

SEQ ID NO: 252440 - protein, 9 aa, Dengue virus
RTNDWDFVV

SEQ ID NO: 252441 - protein, 9 aa, Dengue virus
AVHNWLARV

SEQ ID NO: 252442 - protein, 9 aa, Dengue virus
ALMATFKMR

SEQ ID NO: 252443 - protein, 9 aa, Dengue virus
AQNALDNLV

SEQ ID NO: 252444 - protein, 9 aa, Dengue virus
VTLLSLTFV

SEQ ID NO: 252445 - protein, 9 aa, Dengue virus
WPKSHTLWS

SEQ ID NO: 252446 - protein, 9 aa, Dengue virus
SPSKLASAI

SEQ ID NO: 252447 - protein, 9 aa, Dengue virus
TVAWRTATL

SEQ ID NO: 252448 - protein, 9 aa, Dengue virus
IGAIALDFK

SEQ ID NO: 252449 - protein, 9 aa, Dengue virus
SALLWMASV

SEQ ID NO: 252450 - protein, 9 aa, Dengue virus
CGRGGWSYY

SEQ ID NO: 252451 - protein, 9 aa, Dengue virus
IILEFFLMV

SEQ ID NO: 252452 - protein, 9 aa, Dengue virus
TLIASLVML

SEQ ID NO: 252453 - protein, 9 aa, Dengue virus
VLMMLVAPS

SEQ ID NO: 252454 - protein, 9 aa, Dengue virus
KTFDTEYQK

SEQ ID NO: 252455 - protein, 9 aa, Dengue virus
GQGTSETFF

SEQ ID NO: 252456 - protein, 9 aa, Dengue virus
ATGEHRREK

SEQ ID NO: 252457 - protein, 9 aa, Dengue virus
EARKTFVDL

SEQ ID NO: 252458 - protein, 9 aa, Dengue virus
MMILPAALA

SEQ ID NO: 252459 - protein, 9 aa, Dengue virus
VPMVTQLAM

SEQ ID NO: 252460 - protein, 9 aa, Dengue virus
YVILTILTI

SEQ ID NO: 252461 - protein, 9 aa, Dengue virus
DLMELIDGI

SEQ ID NO: 252462 - protein, 9 aa, Dengue virus
MILMKMKKK

SEQ ID NO: 252463 - protein, 9 aa, Dengue virus
LMTGTLAVF

SEQ ID NO: 252464 - protein, 9 aa, Dengue virus
GLNSKNTSM

SEQ ID NO: 252465 - protein, 9 aa, Dengue virus
FMTATPPGA

SEQ ID NO: 252466 - protein, 9 aa, Dengue virus
ILLVAASFV

SEQ ID NO: 252467 - protein, 9 aa, Dengue virus
LAMATTLQL

SEQ ID NO: 252468 - protein, 9 aa, Dengue virus
MDLLRALIM

SEQ ID NO: 252469 - protein, 9 aa, Dengue virus
CPTQGEAVL

SEQ ID NO: 252470 - protein, 9 aa, Dengue virus
IVMLIPTAI

SEQ ID NO: 252471 - protein, 9 aa, Dengue virus
RTLRVLNLV

SEQ ID NO: 252472 - protein, 9 aa, Dengue virus
LALNLITEM

SEQ ID NO: 252473 - protein, 9 aa, Dengue virus
CTILAVVSV

SEQ ID NO: 252474 - protein, 9 aa, Dengue virus
SLLPVCQSS

SEQ ID NO: 252475 - protein, 9 aa, Dengue virus
VVVDEHCGY

SEQ ID NO: 252476 - protein, 9 aa, Dengue virus
STSQEIWNR

SEQ ID NO: 252477 - protein, 9 aa, Dengue virus
IQNLGGTSI

SEQ ID NO: 252478 - protein, 9 aa, Dengue virus
VMKRYSAPF

SEQ ID NO: 252479 - protein, 9 aa, Dengue virus
CVTQVLMMR

SEQ ID NO: 252480 - protein, 9 aa, Dengue virus
VSWSGKELK

SEQ ID NO: 252481 - protein, 9 aa, Dengue virus
TPKAKRGTA

SEQ ID NO: 252482 - protein, 9 aa, Dengue virus
YPLAIPITM

SEQ ID NO: 252483 - protein, 9 aa, Dengue virus
RQYGGALVR

SEQ ID NO: 252484 - protein, 9 aa, Dengue virus
IQMSSGNIL

SEQ ID NO: 252485 - protein, 9 aa, Dengue virus
FQSHQLWVT

SEQ ID NO: 252486 - protein, 9 aa, Dengue virus
VTMLDVDLR

SEQ ID NO: 252487 - protein, 9 aa, Dengue virus
MTLMKGASR

SEQ ID NO: 252488 - protein, 9 aa, Dengue virus
YPLAIPVTM

SEQ ID NO: 252489 - protein, 9 aa, Dengue virus
LMAAILAYT

SEQ ID NO: 252490 - protein, 9 aa, Dengue virus
LALALTFIK

SEQ ID NO: 252491 - protein, 9 aa, Dengue virus
TPETRNSTF

SEQ ID NO: 252492 - protein, 9 aa, Dengue virus
CTREEFTKK

SEQ ID NO: 252493 - protein, 9 aa, Dengue virus
CTNTFVLKK

SEQ ID NO: 252494 - protein, 9 aa, Dengue virus
GLICVVASS

SEQ ID NO: 252495 - protein, 9 aa, Dengue virus
LPWASGATT

SEQ ID NO: 252496 - protein, 9 aa, Dengue virus
KSYAQMWQL

SEQ ID NO: 252497 - protein, 9 aa, Dengue virus
LMCHATFTM

SEQ ID NO: 252498 - protein, 9 aa, Dengue virus
WQIEKASLI

SEQ ID NO: 252499 - protein, 9 aa, Dengue virus
HGIERLKRM

SEQ ID NO: 252500 - protein, 9 aa, Dengue virus
HFQRTLIFI

SEQ ID NO: 252501 - protein, 9 aa, Dengue virus
ALLAKAIFK

SEQ ID NO: 252502 - protein, 9 aa, Dengue virus
ILLVAVSFM

SEQ ID NO: 252503 - protein, 9 aa, Dengue virus
MLINRFTMR

SEQ ID NO: 252504 - protein, 9 aa, Dengue virus
ATLTEGVYR

SEQ ID NO: 252505 - protein, 9 aa, Dengue virus
AMHSALAGA

SEQ ID NO: 252506 - protein, 9 aa, Dengue virus
AQIMEVTAK

SEQ ID NO: 252507 - protein, 9 aa, Dengue virus
RPGYFTQAA

SEQ ID NO: 252508 - protein, 9 aa, Dengue virus
SLGLLCISI

SEQ ID NO: 252509 - protein, 9 aa, Dengue virus
KVIDLGCGR

SEQ ID NO: 252510 - protein, 9 aa, Dengue virus
MLVAHYAII

SEQ ID NO: 252511 - protein, 9 aa, Dengue virus
HMIVGVFFT

SEQ ID NO: 252512 - protein, 9 aa, Dengue virus
GPLVAGGLL

SEQ ID NO: 252513 - protein, 9 aa, Dengue virus
VILTILTII

SEQ ID NO: 252514 - protein, 9 aa, Dengue virus
ELVHREREL

SEQ ID NO: 252515 - protein, 9 aa, Dengue virus
ALGMMVLKI

SEQ ID NO: 252516 - protein, 9 aa, Dengue virus
MIAGVFFMF

SEQ ID NO: 252517 - protein, 9 aa, Dengue virus
LLLGLMILL

SEQ ID NO: 252518 - protein, 9 aa, Dengue virus
TSGSPIINR

SEQ ID NO: 252519 - protein, 9 aa, Dengue virus
MLNILNRRK

SEQ ID NO: 252520 - protein, 9 aa, Dengue virus
RVLDWLEKY

SEQ ID NO: 252521 - protein, 9 aa, Dengue virus
YVIIAILTV

SEQ ID NO: 252522 - protein, 9 aa, Dengue virus
TLILAVISL

SEQ ID NO: 252523 - protein, 9 aa, Dengue virus
FLLLTMGQL

SEQ ID NO: 252524 - protein, 9 aa, Dengue virus
KMEALQRQY

SEQ ID NO: 252525 - protein, 9 aa, Dengue virus
TMFGGVSWI

SEQ ID NO: 252526 - protein, 9 aa, Dengue virus
CLMMVLPAA

SEQ ID NO: 252527 - protein, 9 aa, Dengue virus
ITANPIVTK

SEQ ID NO: 252528 - protein, 9 aa, Dengue virus
MFGGVSWII

SEQ ID NO: 252529 - protein, 9 aa, Dengue virus
KALKINWYK

SEQ ID NO: 252530 - protein, 9 aa, Dengue virus
NIWLKLREV

SEQ ID NO: 252531 - protein, 9 aa, Dengue virus
WYAQIQPHW

SEQ ID NO: 252532 - protein, 9 aa, Dengue virus
SLGKMVHQI

SEQ ID NO: 252533 - protein, 9 aa, Dengue virus
TIGTTHFQR

SEQ ID NO: 252534 - protein, 9 aa, Dengue virus
MAVGGITLF

SEQ ID NO: 252535 - protein, 9 aa, Dengue virus
WPKTHTLWS

SEQ ID NO: 252536 - protein, 9 aa, Dengue virus
GLLCVMASS

SEQ ID NO: 252537 - protein, 9 aa, Dengue virus
GTIVIRIQY

SEQ ID NO: 252538 - protein, 9 aa, Dengue virus
CTSQILLMR

SEQ ID NO: 252539 - protein, 9 aa, Dengue virus
FTVIAFFLA

SEQ ID NO: 252540 - protein, 9 aa, Dengue virus
VTYKCPFLK

SEQ ID NO: 252541 - protein, 9 aa, Dengue virus
LLCVMASSV

SEQ ID NO: 252542 - protein, 9 aa, Dengue virus
NIWLKLREM

SEQ ID NO: 252543 - protein, 9 aa, Dengue virus
IMQRGLLGK

SEQ ID NO: 252544 - protein, 9 aa, Dengue virus
MSAAVKDER

SEQ ID NO: 252545 - protein, 9 aa, Dengue virus
IMAVGLVSL

SEQ ID NO: 252546 - protein, 9 aa, Dengue virus
KITAKWLWK

SEQ ID NO: 252547 - protein, 9 aa, Dengue virus
ALVAFLRFL

SEQ ID NO: 252548 - protein, 9 aa, Dengue virus
CSGKFSIDK

SEQ ID NO: 252549 - protein, 9 aa, Dengue virus
MIRPQPMEY

SEQ ID NO: 252550 - protein, 9 aa, Dengue virus
SPAATQKAA

SEQ ID NO: 252551 - protein, 9 aa, Dengue virus
TMAMVLSIA

SEQ ID NO: 252552 - protein, 9 aa, Dengue virus
TANPIVTDK

SEQ ID NO: 252553 - protein, 9 aa, Dengue virus
QIFGTAYGI

SEQ ID NO: 252554 - protein, 9 aa, Dengue virus
WIMKILIGV

SEQ ID NO: 252555 - protein, 9 aa, Dengue virus
LLRTYCIEA

SEQ ID NO: 252556 - protein, 9 aa, Dengue virus
VIGVLEQGK

SEQ ID NO: 252557 - protein, 9 aa, Dengue virus
ILKDGPERV

SEQ ID NO: 252558 - protein, 9 aa, Dengue virus
WGKAKVLST

SEQ ID NO: 252559 - protein, 9 aa, Dengue virus
AIVREAIRR

SEQ ID NO: 252560 - protein, 9 aa, Dengue virus
LLLTSSQQK

SEQ ID NO: 252561 - protein, 9 aa, Dengue virus
IAMTDTTPF

SEQ ID NO: 252562 - protein, 9 aa, Dengue virus
QISNELNYI

SEQ ID NO: 252563 - protein, 9 aa, Dengue virus
ALRINWYKK

SEQ ID NO: 252564 - protein, 9 aa, Dengue virus
VLLLVTHYA

SEQ ID NO: 252565 - protein, 9 aa, Dengue virus
FIAFLRFLA

SEQ ID NO: 252566 - protein, 9 aa, Dengue virus
LAIGIMMLK

SEQ ID NO: 252567 - protein, 9 aa, Dengue virus
NLCEGTTVV

SEQ ID NO: 252568 - protein, 9 aa, Dengue virus
GVVTLYLGV

SEQ ID NO: 252569 - protein, 9 aa, Dengue virus
QQLTKRFSL

SEQ ID NO: 252570 - protein, 9 aa, Dengue virus
TTEVHWNYK

SEQ ID NO: 252571 - protein, 9 aa, Dengue virus
ISRKAGGAM

SEQ ID NO: 252572 - protein, 9 aa, Dengue virus
YVLGIFLRK

SEQ ID NO: 252573 - protein, 9 aa, Dengue virus
TVNPIATEK

SEQ ID NO: 252574 - protein, 9 aa, Dengue virus
LMMILPAAL

SEQ ID NO: 252575 - protein, 9 aa, Dengue virus
LTAAVLMLV

SEQ ID NO: 252576 - protein, 9 aa, Dengue virus
VQTKPGLFK

SEQ ID NO: 252577 - protein, 9 aa, Dengue virus
GSSPIIEVK

SEQ ID NO: 252578 - protein, 9 aa, Dengue virus
VWPKSHTLW

SEQ ID NO: 252579 - protein, 9 aa, Dengue virus
TIMVVLFVV

SEQ ID NO: 252580 - protein, 9 aa, Dengue virus
FTMRLLSPI

SEQ ID NO: 252581 - protein, 9 aa, Dengue virus
IMAWRTIMA

SEQ ID NO: 252582 - protein, 9 aa, Dengue virus
TVMDVISRR

SEQ ID NO: 252583 - protein, 9 aa, Dengue virus
MALKLTTQF

SEQ ID NO: 252584 - protein, 9 aa, Dengue virus
AMKRYSAPF

SEQ ID NO: 252585 - protein, 9 aa, Dengue virus
AIMAAILAY

SEQ ID NO: 252586 - protein, 9 aa, Dengue virus
MIMTTTANW

SEQ ID NO: 252587 - protein, 9 aa, Dengue virus
GILARWGSF

SEQ ID NO: 252588 - protein, 9 aa, Dengue virus
GPSLRTTTV

SEQ ID NO: 252589 - protein, 9 aa, Dengue virus
PTYLSSKAK

SEQ ID NO: 252590 - protein, 9 aa, Dengue virus
TLTEGVYRI

SEQ ID NO: 252591 - protein, 9 aa, Dengue virus
YMPSVVEAL

SEQ ID NO: 252592 - protein, 9 aa, Dengue virus
VMTTTANWL

SEQ ID NO: 252593 - protein, 9 aa, Dengue virus
FQSYQLWAT

SEQ ID NO: 252594 - protein, 9 aa, Dengue virus
ALALGMMVL

SEQ ID NO: 252595 - protein, 9 aa, Dengue virus
LLTGGVMLF

SEQ ID NO: 252596 - protein, 9 aa, Dengue virus
YQFQPESPA

SEQ ID NO: 252597 - protein, 9 aa, Dengue virus
LILTSSQQK

SEQ ID NO: 252598 - protein, 9 aa, Dengue virus
IQMSLGNIL

SEQ ID NO: 252599 - protein, 9 aa, Dengue virus
LLMRTSWAF

SEQ ID NO: 252600 - protein, 9 aa, Dengue virus
HILAENEVK

SEQ ID NO: 252601 - protein, 9 aa, Dengue virus
RVIDPRRCL

SEQ ID NO: 252602 - protein, 9 aa, Dengue virus
ILNRRRRTA

SEQ ID NO: 252603 - protein, 9 aa, Dengue virus
TVMDIISRR

SEQ ID NO: 252604 - protein, 9 aa, Dengue virus
LIIMDEAHF

SEQ ID NO: 252605 - protein, 9 aa, Dengue virus
GQLKLNWFK

SEQ ID NO: 252606 - protein, 9 aa, Dengue virus
ALAPPVNDL

SEQ ID NO: 252607 - protein, 9 aa, Dengue virus
LQMEEKAWL

SEQ ID NO: 252608 - protein, 9 aa, Dengue virus
CTREEFIKK

SEQ ID NO: 252609 - protein, 9 aa, Dengue virus
HLAIMAVFK

SEQ ID NO: 252610 - protein, 9 aa, Dengue virus
SMGLITIAV

SEQ ID NO: 252611 - protein, 9 aa, Dengue virus
TMRYKKATY

SEQ ID NO: 252612 - protein, 9 aa, Dengue virus
SSVNTTSKM

SEQ ID NO: 252613 - protein, 9 aa, Dengue virus
MILVVVITF

SEQ ID NO: 252614 - protein, 9 aa, Dengue virus
YLMTLMKGA

SEQ ID NO: 252615 - protein, 9 aa, Dengue virus
LMLMPTALA

SEQ ID NO: 252616 - protein, 9 aa, Dengue virus
VSAVNMTSR

SEQ ID NO: 252617 - protein, 9 aa, Dengue virus
KMLMTGTLA

SEQ ID NO: 252618 - protein, 9 aa, Dengue virus
MTIMTGDIK

SEQ ID NO: 252619 - protein, 9 aa, Dengue virus
ISSWEDVPY

SEQ ID NO: 252620 - protein, 9 aa, Dengue virus
TLKGVSYVM

SEQ ID NO: 252621 - protein, 9 aa, Dengue virus
ILAVFFLLI

SEQ ID NO: 252622 - protein, 9 aa, Dengue virus
LLFKTSAGI

SEQ ID NO: 252623 - protein, 9 aa, Dengue virus
KMGMGVTYL

SEQ ID NO: 252624 - protein, 9 aa, Dengue virus
FLIDGPETA

SEQ ID NO: 252625 - protein, 9 aa, Dengue virus
SSMLNIINR

SEQ ID NO: 252626 - protein, 9 aa, Dengue virus
VVTLIPLCR

SEQ ID NO: 252627 - protein, 9 aa, Dengue virus
LQRKYGGNL

SEQ ID NO: 252628 - protein, 9 aa, Dengue virus
GQMFATTMR

SEQ ID NO: 252629 - protein, 9 aa, Dengue virus
VPNYNLVIM

SEQ ID NO: 252630 - protein, 9 aa, Dengue virus
WLWALLGKK

SEQ ID NO: 252631 - protein, 9 aa, Dengue virus
ALLARSIFK

SEQ ID NO: 252632 - protein, 9 aa, Dengue virus
TANIFRGSY

SEQ ID NO: 252633 - protein, 9 aa, Dengue virus
FQPESPARV

SEQ ID NO: 252634 - protein, 9 aa, Dengue virus
ILLMRTTWA

SEQ ID NO: 252635 - protein, 9 aa, Dengue virus
STGTQLAKR

SEQ ID NO: 252636 - protein, 9 aa, Dengue virus
DVFYLPPEK

SEQ ID NO: 252637 - protein, 9 aa, Dengue virus
RQDLLVTFK

SEQ ID NO: 252638 - protein, 9 aa, Dengue virus
AMLFLISGK

SEQ ID NO: 252639 - protein, 9 aa, Dengue virus
SLVRCPLSR

SEQ ID NO: 252640 - protein, 9 aa, Dengue virus
QMEGEGIFK

SEQ ID NO: 252641 - protein, 9 aa, Dengue virus
TQDDMHNPK

SEQ ID NO: 252642 - protein, 9 aa, Dengue virus
LLGAMTAGI

SEQ ID NO: 252643 - protein, 9 aa, Dengue virus
AYRHAVEEL

SEQ ID NO: 252644 - protein, 9 aa, Dengue virus
MVMTTTANW

SEQ ID NO: 252645 - protein, 9 aa, Dengue virus
RPTEQVDTL

SEQ ID NO: 252646 - protein, 9 aa, Dengue virus
SMLNIMNRR

SEQ ID NO: 252647 - protein, 9 aa, Dengue virus
MLWMADIPL

SEQ ID NO: 252648 - protein, 9 aa, Dengue virus
LLMLVTPSM

SEQ ID NO: 252649 - protein, 9 aa, Dengue virus
KLSMGLITI

SEQ ID NO: 252650 - protein, 9 aa, Dengue virus
GTCAQSGER

SEQ ID NO: 252651 - protein, 9 aa, Dengue virus
LLMLMPTAL

SEQ ID NO: 252652 - protein, 9 aa, Dengue virus
FGAIYGAAF

SEQ ID NO: 252653 - protein, 9 aa, Dengue virus
QMSSGNLLF

SEQ ID NO: 252654 - protein, 9 aa, Dengue virus
MMGKREKKL

SEQ ID NO: 252655 - protein, 9 aa, Dengue virus
FLMVLLIPE

SEQ ID NO: 252656 - protein, 9 aa, Dengue virus
GLFGKGSLL

SEQ ID NO: 252657 - protein, 9 aa, Dengue virus
VDRLKRMAI

SEQ ID NO: 252658 - protein, 9 aa, Dengue virus
CPTQGEPSL

SEQ ID NO: 252659 - protein, 9 aa, Dengue virus
MATFRMRPM

SEQ ID NO: 252660 - protein, 9 aa, Dengue virus
ATLLAVSGV

SEQ ID NO: 252661 - protein, 9 aa, Dengue virus
STITLLYLI

SEQ ID NO: 252662 - protein, 9 aa, Dengue virus
VTNPAILRK

SEQ ID NO: 252663 - protein, 9 aa, Dengue virus
RSADLELER

SEQ ID NO: 252664 - protein, 9 aa, Dengue virus
LMILLTGGV

SEQ ID NO: 252665 - protein, 9 aa, Dengue virus
VSSVNTTSK

SEQ ID NO: 252666 - protein, 9 aa, Dengue virus
MALVAFLRF

SEQ ID NO: 252667 - protein, 9 aa, Dengue virus
TMKNKAWMV

SEQ ID NO: 252668 - protein, 9 aa, Dengue virus
KWKKRLNQL

SEQ ID NO: 252669 - protein, 9 aa, Dengue virus
ILSENEAKL

SEQ ID NO: 252670 - protein, 9 aa, Dengue virus
KITGNLVQV

SEQ ID NO: 252671 - protein, 9 aa, Dengue virus
FLNEDHWFG

SEQ ID NO: 252672 - protein, 9 aa, Dengue virus
YSDYMTSMK

SEQ ID NO: 252673 - protein, 9 aa, Dengue virus
SILLWYAQI

SEQ ID NO: 252674 - protein, 9 aa, Dengue virus
WLKLRDSHT

SEQ ID NO: 252675 - protein, 9 aa, Dengue virus
VMAVGLVSI

SEQ ID NO: 252676 - protein, 9 aa, Dengue virus
TLEVHWNYK

SEQ ID NO: 252677 - protein, 9 aa, Dengue virus
WMVHRQWFF

SEQ ID NO: 252678 - protein, 9 aa, Dengue virus
KAYAQMWAL

SEQ ID NO: 252679 - protein, 9 aa, Dengue virus
QLWTTLLSL

SEQ ID NO: 252680 - protein, 9 aa, Dengue virus
TVTAFFLAH

SEQ ID NO: 252681 - protein, 9 aa, Dengue virus
EMILMEMRK

SEQ ID NO: 252682 - protein, 9 aa, Dengue virus
LVQVENLEY

SEQ ID NO: 252683 - protein, 9 aa, Dengue virus
STSQETWNR

SEQ ID NO: 252684 - protein, 9 aa, Dengue virus
LTMKKKSWL

SEQ ID NO: 252685 - protein, 9 aa, Dengue virus
LTTLSRTSK

SEQ ID NO: 252686 - protein, 9 aa, Dengue virus
MPVMKRYSA

SEQ ID NO: 252687 - protein, 9 aa, Dengue virus
LIAVLTGGV

SEQ ID NO: 252688 - protein, 9 aa, Dengue virus
YLALLAAFK

SEQ ID NO: 252689 - protein, 9 aa, Dengue virus
TQMIMTTTA

SEQ ID NO: 252690 - protein, 9 aa, Dengue virus
FIRSTTPLV

SEQ ID NO: 252691 - protein, 9 aa, Dengue virus
SQGAGWSLK

SEQ ID NO: 252692 - protein, 9 aa, Dengue virus
NFQTMPGTF

SEQ ID NO: 252693 - protein, 9 aa, Dengue virus
YVMCTGLFK

SEQ ID NO: 252694 - protein, 9 aa, Dengue virus
APEARNSTF

SEQ ID NO: 252695 - protein, 9 aa, Dengue virus
VSWNGRELK

SEQ ID NO: 252696 - protein, 9 aa, Dengue virus
MILAVVITL

SEQ ID NO: 252697 - protein, 9 aa, Dengue virus
KAALSEGVY

SEQ ID NO: 252698 - protein, 9 aa, Dengue virus
RQLASAIFK

SEQ ID NO: 252699 - protein, 9 aa, Dengue virus
MIKPKGKVV

SEQ ID NO: 252700 - protein, 9 aa, Dengue virus
TLLVKLALI

SEQ ID NO: 252701 - protein, 9 aa, Dengue virus
FGAAYGVLF

SEQ ID NO: 252702 - protein, 9 aa, Dengue virus
RLITANPVV

SEQ ID NO: 252703 - protein, 9 aa, Dengue virus
LLLMRTTWA

SEQ ID NO: 252704 - protein, 9 aa, Dengue virus
MILVVVTTF

SEQ ID NO: 252705 - protein, 9 aa, Dengue virus
FMQGKGMGK

SEQ ID NO: 252706 - protein, 9 aa, Dengue virus
LSIASLFPL

SEQ ID NO: 252707 - protein, 9 aa, Dengue virus
TQHGTAVVK

SEQ ID NO: 252708 - protein, 9 aa, Dengue virus
TLLAVSGVY

SEQ ID NO: 252709 - protein, 9 aa, Dengue virus
FTMMAAILA

SEQ ID NO: 252710 - protein, 9 aa, Dengue virus
KITAEWLWK

SEQ ID NO: 252711 - protein, 9 aa, Dengue virus
LLLVAHYAI

SEQ ID NO: 252712 - protein, 9 aa, Dengue virus
LATLRKYCI

SEQ ID NO: 252713 - protein, 9 aa, Dengue virus
TMNRRKRSV

SEQ ID NO: 252714 - protein, 9 aa, Dengue virus
VVASEMAEA

SEQ ID NO: 252715 - protein, 9 aa, Dengue virus
VSKKEGGAM

SEQ ID NO: 252716 - protein, 9 aa, Dengue virus
IALLSQSTM

SEQ ID NO: 252717 - protein, 9 aa, Dengue virus
ALILGAQAL

SEQ ID NO: 252718 - protein, 9 aa, Dengue virus
QVFGTAYGV

SEQ ID NO: 252719 - protein, 9 aa, Dengue virus
LMSGRGIGK

SEQ ID NO: 252720 - protein, 9 aa, Dengue virus
VMVMVGAAM

SEQ ID NO: 252721 - protein, 9 aa, Dengue virus
LQMESKAWL

SEQ ID NO: 252722 - protein, 9 aa, Dengue virus
MLNIINRRK

SEQ ID NO: 252723 - protein, 9 aa, Dengue virus
FRKRNLTIM

SEQ ID NO: 252724 - protein, 9 aa, Dengue virus
VTFKVPHAK

SEQ ID NO: 252725 - protein, 9 aa, Dengue virus
QLKLDWFKK

SEQ ID NO: 252726 - protein, 9 aa, Dengue virus
TILGGLTWM

SEQ ID NO: 252727 - protein, 9 aa, Dengue virus
LMTGTLAVL

SEQ ID NO: 252728 - protein, 9 aa, Dengue virus
AVQDWLVRV

SEQ ID NO: 252729 - protein, 9 aa, Dengue virus
VVIAILTLV

SEQ ID NO: 252730 - protein, 9 aa, Dengue virus
SIVREALKR

SEQ ID NO: 252731 - protein, 9 aa, Dengue virus
RTEAKSALR

SEQ ID NO: 252732 - protein, 9 aa, Dengue virus
VVQPENLEY

SEQ ID NO: 252733 - protein, 9 aa, Dengue virus
ALRGLPIRY

SEQ ID NO: 252734 - protein, 9 aa, Dengue virus
SYAQMWQLM

SEQ ID NO: 252735 - protein, 9 aa, Dengue virus
GAIKVLRGF

SEQ ID NO: 252736 - protein, 9 aa, Dengue virus
HWFSRENSW

SEQ ID NO: 252737 - protein, 9 aa, Dengue virus
FIRSTTPLI

SEQ ID NO: 252738 - protein, 9 aa, Dengue virus
IQMSSGNLL

SEQ ID NO: 252739 - protein, 9 aa, Dengue virus
EARKTFVEL

SEQ ID NO: 252740 - protein, 9 aa, Dengue virus
SLGGVFTSI

SEQ ID NO: 252741 - protein, 9 aa, Dengue virus
YILREVSKK

SEQ ID NO: 252742 - protein, 9 aa, Dengue virus
KVLNPYMPA

SEQ ID NO: 252743 - protein, 9 aa, Dengue virus
MILKLLTDF

SEQ ID NO: 252744 - protein, 9 aa, Dengue virus
TVKEEIAVK

SEQ ID NO: 252745 - protein, 9 aa, Dengue virus
RPRWLDART

SEQ ID NO: 252746 - protein, 9 aa, Dengue virus
LLSGQGPMK

SEQ ID NO: 252747 - protein, 9 aa, Dengue virus
MLVALLGAM

SEQ ID NO: 252748 - protein, 9 aa, Dengue virus
KLVHQIFGT

SEQ ID NO: 252749 - protein, 9 aa, Dengue virus
TLKGTSYVM

SEQ ID NO: 252750 - protein, 9 aa, Dengue virus
AYNHALSEL

SEQ ID NO: 252751 - protein, 9 aa, Dengue virus
KTSLCLMMI

SEQ ID NO: 252752 - protein, 9 aa, Dengue virus
LQWIASAIV

SEQ ID NO: 252753 - protein, 9 aa, Dengue virus
ILTDGEERV

SEQ ID NO: 252754 - protein, 9 aa, Dengue virus
AMHSALTGA

SEQ ID NO: 252755 - protein, 9 aa, Dengue virus
ATKSEHTGK

SEQ ID NO: 252756 - protein, 9 aa, Dengue virus
IALDLVTEI

SEQ ID NO: 252757 - protein, 9 aa, Dengue virus
SMAMTCMAV

SEQ ID NO: 252758 - protein, 9 aa, Dengue virus
AAQNWLARV

SEQ ID NO: 252759 - protein, 9 aa, Dengue virus
AILLAAVSF

SEQ ID NO: 252760 - protein, 9 aa, Dengue virus
LIGAVITWI

SEQ ID NO: 252761 - protein, 9 aa, Dengue virus
AVASGLLWI

SEQ ID NO: 252762 - protein, 9 aa, Dengue virus
KPTDDRFAT

SEQ ID NO: 252763 - protein, 9 aa, Dengue virus
SLFPLCLST

SEQ ID NO: 252764 - protein, 9 aa, Dengue virus
GVYPMSIPA

SEQ ID NO: 252765 - protein, 9 aa, Dengue virus
DYMPSMKRF

SEQ ID NO: 252766 - protein, 9 aa, Dengue virus
HSGVDVFYK

SEQ ID NO: 252767 - protein, 9 aa, Dengue virus
YPLSIPATL

SEQ ID NO: 252768 - protein, 9 aa, Dengue virus
RPTPRGTVM

SEQ ID NO: 252769 - protein, 9 aa, Dengue virus
TSELHWNYK

SEQ ID NO: 252770 - protein, 9 aa, Dengue virus
ATQLATLRK

SEQ ID NO: 252771 - protein, 9 aa, Dengue virus
AIIMLGDTM

SEQ ID NO: 252772 - protein, 9 aa, Dengue virus
KTKTWLVHK

SEQ ID NO: 252773 - protein, 9 aa, Dengue virus
ILNPYMPSV

SEQ ID NO: 252774 - protein, 9 aa, Dengue virus
TPQASTTEV

SEQ ID NO: 252775 - protein, 9 aa, Dengue virus
RTTWAFCEV

SEQ ID NO: 252776 - protein, 9 aa, Dengue virus
GILAVFFLL

SEQ ID NO: 252777 - protein, 9 aa, Dengue virus
KLGYILREV

SEQ ID NO: 252778 - protein, 9 aa, Dengue virus
GVYPLSIPA

SEQ ID NO: 252779 - protein, 9 aa, Dengue virus
TVNPIVIEK

SEQ ID NO: 252780 - protein, 9 aa, Dengue virus
GLFPVSIPI

SEQ ID NO: 252781 - protein, 9 aa, Dengue virus
TMAQGKPTL

SEQ ID NO: 252782 - protein, 9 aa, Dengue virus
SYAMCSNAF

SEQ ID NO: 252783 - protein, 9 aa, Dengue virus
IQKETLVTF

SEQ ID NO: 252784 - protein, 9 aa, Dengue virus
NLVNSLVTA

SEQ ID NO: 252785 - protein, 9 aa, Dengue virus
LAMGIMILK

SEQ ID NO: 252786 - protein, 9 aa, Dengue virus
VSAITQAEK

SEQ ID NO: 252787 - protein, 9 aa, Dengue virus
WAFCEVLTL

SEQ ID NO: 252788 - protein, 9 aa, Dengue virus
ITGVLEQGK

SEQ ID NO: 252789 - protein, 9 aa, Dengue virus
DVFFMPPEK

SEQ ID NO: 252790 - protein, 9 aa, Dengue virus
KMEKYQLAV

SEQ ID NO: 252791 - protein, 9 aa, Dengue virus
SLHYAWKTM

SEQ ID NO: 252792 - protein, 9 aa, Dengue virus
IMKDGRVLV

SEQ ID NO: 252793 - protein, 9 aa, Dengue virus
VILQNAWKV

SEQ ID NO: 252794 - protein, 9 aa, Dengue virus
LGAQALPVY

SEQ ID NO: 252795 - protein, 9 aa, Dengue virus
MNRRKKSVT

SEQ ID NO: 252796 - protein, 9 aa, Dengue virus
RQMEAEGVI

SEQ ID NO: 252797 - protein, 9 aa, Dengue virus
AQALPVYLM

SEQ ID NO: 252798 - protein, 9 aa, Dengue virus
TMKEKAWLV

SEQ ID NO: 252799 - protein, 9 aa, Dengue virus
TMAMALSIV

SEQ ID NO: 252800 - protein, 9 aa, Dengue virus
MSAAIKDNR

SEQ ID NO: 252801 - protein, 9 aa, Dengue virus
GMNSRSTSL

SEQ ID NO: 252802 - protein, 9 aa, Dengue virus
MRMKKKTWL

SEQ ID NO: 252803 - protein, 9 aa, Dengue virus
TRKHMILAV

SEQ ID NO: 252804 - protein, 9 aa, Dengue virus
MAWRTIMVV

SEQ ID NO: 252805 - protein, 9 aa, Dengue virus
LAVSGVYPM

SEQ ID NO: 252806 - protein, 9 aa, Dengue virus
LTPPVSDLK

SEQ ID NO: 252807 - protein, 9 aa, Dengue virus
HMIVSRQEK

SEQ ID NO: 252808 - protein, 9 aa, Dengue virus
AERLKRMAI

SEQ ID NO: 252809 - protein, 9 aa, Dengue virus
RTTWSIHAK

SEQ ID NO: 252810 - protein, 9 aa, Dengue virus
KLLTKPWDV

SEQ ID NO: 252811 - protein, 9 aa, Dengue virus
HLAIMIVFK

SEQ ID NO: 252812 - protein, 9 aa, Dengue virus
MLINRFTMK

SEQ ID NO: 252813 - protein, 9 aa, Dengue virus
HSGVDVFYR

SEQ ID NO: 252814 - protein, 9 aa, Dengue virus
QTSGGTSIF

SEQ ID NO: 252815 - protein, 9 aa, Dengue virus
GILCVSILI

SEQ ID NO: 252816 - protein, 9 aa, Dengue virus
MIIMDEAHF

SEQ ID NO: 252817 - protein, 9 aa, Dengue virus
MVLLTMKGK

SEQ ID NO: 252818 - protein, 9 aa, Dengue virus
LVREGRERL

SEQ ID NO: 252819 - protein, 9 aa, Dengue virus
WSYYCGGLK

SEQ ID NO: 252820 - protein, 9 aa, Dengue virus
TIGTTHFQK

SEQ ID NO: 252821 - protein, 9 aa, Dengue virus
ALFEPEREK

SEQ ID NO: 252822 - protein, 9 aa, Dengue virus
NMITLLVKL

SEQ ID NO: 252823 - protein, 9 aa, Dengue virus
TIEAGRTLR

SEQ ID NO: 252824 - protein, 9 aa, Dengue virus
AQGKPTLDF

SEQ ID NO: 252825 - protein, 9 aa, Dengue virus
IPKIHGGPI

SEQ ID NO: 252826 - protein, 9 aa, Dengue virus
GTLAVFFLL

SEQ ID NO: 252827 - protein, 9 aa, Dengue virus
IMNRRKKSV

SEQ ID NO: 252828 - protein, 9 aa, Dengue virus
IPKSYAGPF

SEQ ID NO: 252829 - protein, 9 aa, Dengue virus
VQTTPGTFK

SEQ ID NO: 252830 - protein, 9 aa, Dengue virus
TPFGQQRVF

SEQ ID NO: 252831 - protein, 9 aa, Dengue virus
VAGILVQGK

SEQ ID NO: 252832 - protein, 9 aa, Dengue virus
GIALGLMAL

SEQ ID NO: 252833 - protein, 9 aa, Dengue virus
TPEARNSTF

SEQ ID NO: 252834 - protein, 9 aa, Dengue virus
HILLENDIK

SEQ ID NO: 252835 - protein, 9 aa, Dengue virus
MLGDTMLSR

SEQ ID NO: 252836 - protein, 9 aa, Dengue virus
AQEDDQYVF

SEQ ID NO: 252837 - protein, 9 aa, Dengue virus
KVVQHENLK

SEQ ID NO: 252838 - protein, 9 aa, Dengue virus
ALFGGVSWI

SEQ ID NO: 252839 - protein, 9 aa, Dengue virus
KLGEFGRAK

SEQ ID NO: 252840 - protein, 9 aa, Dengue virus
NLVKLHSGV

SEQ ID NO: 252841 - protein, 9 aa, Dengue virus
YMPTVIEEL

SEQ ID NO: 252842 - protein, 9 aa, Dengue virus
IYADDTAGW

SEQ ID NO: 252843 - protein, 9 aa, Dengue virus
YRGAKRMAI

SEQ ID NO: 252844 - protein, 9 aa, Dengue virus
CLMMILPAA

SEQ ID NO: 252845 - protein, 9 aa, Dengue virus
RPAKSGTVM

SEQ ID NO: 252846 - protein, 9 aa, Dengue virus
EMILMKMRK

SEQ ID NO: 252847 - protein, 9 aa, Dengue virus
EQRKTFVEL

SEQ ID NO: 252848 - protein, 9 aa, Dengue virus
CVMASSALL

SEQ ID NO: 252849 - protein, 9 aa, Dengue virus
EGRERLARM

SEQ ID NO: 252850 - protein, 9 aa, Dengue virus
MSPGYVLGV

SEQ ID NO: 252851 - protein, 9 aa, Dengue virus
IVLEHGSCV

SEQ ID NO: 252852 - protein, 9 aa, Dengue virus
HWFRRGSSI

SEQ ID NO: 252853 - protein, 9 aa, Dengue virus
FTMRLLSPV

SEQ ID NO: 252854 - protein, 9 aa, Dengue virus
GMMALKIVK

SEQ ID NO: 252855 - protein, 9 aa, Dengue virus
RYMGEDGCW

SEQ ID NO: 252856 - protein, 9 aa, Dengue virus
RPTFAAGLF

SEQ ID NO: 252857 - protein, 9 aa, Dengue virus
YSIPATLLV

SEQ ID NO: 252858 - protein, 9 aa, Dengue virus
AAWYLWETK

SEQ ID NO: 252859 - protein, 9 aa, Dengue virus
MVLSIASLF

SEQ ID NO: 252860 - protein, 9 aa, Dengue virus
ALWYIWQVK

SEQ ID NO: 252861 - protein, 9 aa, Dengue virus
LIFILLTAV

SEQ ID NO: 252862 - protein, 9 aa, Dengue virus
NGRKRSTIT

SEQ ID NO: 252863 - protein, 9 aa, Dengue virus
GPMPVTAAS

SEQ ID NO: 252864 - protein, 9 aa, Dengue virus
KLRDVYTQL

SEQ ID NO: 252865 - protein, 9 aa, Dengue virus
MCSGTFVLK

SEQ ID NO: 252866 - protein, 9 aa, Dengue virus
CTLPPLRFK

SEQ ID NO: 252867 - protein, 9 aa, Dengue virus
LSKSEFNIY

SEQ ID NO: 252868 - protein, 9 aa, Dengue virus
LYSGKDVFF

SEQ ID NO: 252869 - protein, 9 aa, Dengue virus
QLAYVVIGL

SEQ ID NO: 252870 - protein, 9 aa, Dengue virus
LAMGIMMLK

SEQ ID NO: 252871 - protein, 9 aa, Dengue virus
YLDYMTSMK

SEQ ID NO: 252872 - protein, 9 aa, Dengue virus
ATFKIQPFL

SEQ ID NO: 252873 - protein, 9 aa, Dengue virus
SILLWHAQI

SEQ ID NO: 252874 - protein, 9 aa, Dengue virus
MLLMLLPTV

SEQ ID NO: 252875 - protein, 9 aa, Dengue virus
STVSQLAKR

SEQ ID NO: 252876 - protein, 9 aa, Dengue virus
AIKVLRGFK

SEQ ID NO: 252877 - protein, 9 aa, Dengue virus
VFRKRNLTI

SEQ ID NO: 252878 - protein, 9 aa, Dengue virus
MNNQRKKTA

SEQ ID NO: 252879 - protein, 9 aa, Dengue virus
PLNEGVMAV

SEQ ID NO: 252880 - protein, 9 aa, Dengue virus
KTLKLSWFK

SEQ ID NO: 252881 - protein, 9 aa, Dengue virus
IMIEEVMRS

SEQ ID NO: 252882 - protein, 9 aa, Dengue virus
YYTQTAGPW

SEQ ID NO: 252883 - protein, 9 aa, Dengue virus
HTWLVREGR

SEQ ID NO: 252884 - protein, 9 aa, Dengue virus
VLMMRTTWA

SEQ ID NO: 252885 - protein, 9 aa, Dengue virus
GGCVTTMAK

SEQ ID NO: 252886 - protein, 9 aa, Dengue virus
WVTLLSLTF

SEQ ID NO: 252887 - protein, 9 aa, Dengue virus
VLLIPEPEK

SEQ ID NO: 252888 - protein, 9 aa, Dengue virus
ATLLSLTFV

SEQ ID NO: 252889 - protein, 9 aa, Dengue virus
ALKGMPIRY

SEQ ID NO: 252890 - protein, 9 aa, Dengue virus
TWRDMAHTF

SEQ ID NO: 252891 - protein, 9 aa, Dengue virus
TAEVHWNYK

SEQ ID NO: 252892 - protein, 9 aa, Dengue virus
QPHQLWITL

SEQ ID NO: 252893 - protein, 9 aa, Dengue virus
HFQRVLIFI

SEQ ID NO: 252894 - protein, 9 aa, Dengue virus
ITAEWLWRT

SEQ ID NO: 252895 - protein, 9 aa, Dengue virus
MTTEDMLTV

SEQ ID NO: 252896 - protein, 9 aa, Dengue virus
ALNELPESL

SEQ ID NO: 252897 - protein, 9 aa, Dengue virus
GMVSILASS

SEQ ID NO: 252898 - protein, 9 aa, Dengue virus
RVISSTPFA

SEQ ID NO: 252899 - protein, 9 aa, Dengue virus
SVLLWMASV

SEQ ID NO: 252900 - protein, 9 aa, Dengue virus
LARVGRERL

SEQ ID NO: 252901 - protein, 9 aa, Dengue virus
MLKRVRNRV

SEQ ID NO: 252902 - protein, 9 aa, Dengue virus
AAAWYLWET

SEQ ID NO: 252903 - protein, 9 aa, Dengue virus
QPKLGTRVV

SEQ ID NO: 252904 - protein, 9 aa, Dengue virus
YVSAIAQAK

SEQ ID NO: 252905 - protein, 9 aa, Dengue virus
FTDPCSVAA

SEQ ID NO: 252906 - protein, 9 aa, Dengue virus
KIVQHENLK

SEQ ID NO: 252907 - protein, 9 aa, Dengue virus
LMLLPTVLA

SEQ ID NO: 252908 - protein, 9 aa, Dengue virus
VAGILAQGK

SEQ ID NO: 252909 - protein, 9 aa, Dengue virus
LLGAMTAGT

SEQ ID NO: 252910 - protein, 9 aa, Dengue virus
VMLFVHYAI

SEQ ID NO: 252911 - protein, 9 aa, Dengue virus
EAIKRRLRT

SEQ ID NO: 252912 - protein, 9 aa, Dengue virus
CSGKFSIGK

SEQ ID NO: 252913 - protein, 9 aa, Dengue virus
KALRINWYK

SEQ ID NO: 252914 - protein, 9 aa, Dengue virus
SQLCDHRLM

SEQ ID NO: 252915 - protein, 9 aa, Dengue virus
MGLGRGWPL

SEQ ID NO: 252916 - protein, 9 aa, Dengue virus
SSWEEVPYL

SEQ ID NO: 252917 - protein, 9 aa, Dengue virus
MSAAIKDQK

SEQ ID NO: 252918 - protein, 9 aa, Dengue virus
NSRSTSFSM

SEQ ID NO: 252919 - protein, 9 aa, Dengue virus
TMKEKSWLV

SEQ ID NO: 252920 - protein, 9 aa, Dengue virus
TQAAGPWHL

SEQ ID NO: 252921 - protein, 9 aa, Dengue virus
TMTHRRPTI

SEQ ID NO: 252922 - protein, 9 aa, Dengue virus
QYSDRRWCF

SEQ ID NO: 252923 - protein, 9 aa, Dengue virus
RLITVNPIA

SEQ ID NO: 252924 - protein, 9 aa, Dengue virus
CAMFTCLKK

SEQ ID NO: 252925 - protein, 9 aa, Dengue virus
VVVATLCAI

SEQ ID NO: 252926 - protein, 9 aa, Dengue virus
GVTTTITPR

SEQ ID NO: 252927 - protein, 9 aa, Dengue virus
GSLIGLTAR

SEQ ID NO: 252928 - protein, 9 aa, Dengue virus
LMYFHRRDL

SEQ ID NO: 252929 - protein, 9 aa, Dengue virus
HPGFTVTAF

SEQ ID NO: 252930 - protein, 9 aa, Dengue virus
ATWASNIQV

SEQ ID NO: 252931 - protein, 9 aa, Dengue virus
MVSRLLLNR

SEQ ID NO: 252932 - protein, 9 aa, Dengue virus
GLITLYLGV

SEQ ID NO: 252933 - protein, 9 aa, Dengue virus
RSEAKEGLK

SEQ ID NO: 252934 - protein, 9 aa, Dengue virus
CLVMILPAA

SEQ ID NO: 252935 - protein, 9 aa, Dengue virus
RVIDLGCGR

SEQ ID NO: 252936 - protein, 9 aa, Dengue virus
CAKFSCSGK

SEQ ID NO: 252937 - protein, 9 aa, Dengue virus
TARPSFNML

SEQ ID NO: 252938 - protein, 9 aa, Dengue virus
LLTAVTPSM

SEQ ID NO: 252939 - protein, 9 aa, Dengue virus
ISNITTATR

SEQ ID NO: 252940 - protein, 9 aa, Dengue virus
LAVFLLLVM

SEQ ID NO: 252941 - protein, 9 aa, Dengue virus
GMGKLSMGL

SEQ ID NO: 252942 - protein, 9 aa, Dengue virus
MVLSIVSLF

SEQ ID NO: 252943 - protein, 9 aa, Dengue virus
RTVFFVLMM

SEQ ID NO: 252944 - protein, 9 aa, Dengue virus
MSYSMCTGK

SEQ ID NO: 252945 - protein, 9 aa, Dengue virus
LAMAATLRL

SEQ ID NO: 252946 - protein, 9 aa, Dengue virus
YLALMATFK

SEQ ID NO: 252947 - protein, 9 aa, Dengue virus
GTIVIRVQY

SEQ ID NO: 252948 - protein, 9 aa, Dengue virus
KKMIRPQPM

SEQ ID NO: 252949 - protein, 9 aa, Dengue virus
MILMKMRKK

SEQ ID NO: 252950 - protein, 9 aa, Dengue virus
VGAIALDFK

SEQ ID NO: 252951 - protein, 9 aa, Dengue virus
QLAVTVMAI

SEQ ID NO: 252952 - protein, 9 aa, Dengue virus
YVILTILAI

SEQ ID NO: 252953 - protein, 9 aa, Dengue virus
VATTFVTPM

SEQ ID NO: 252954 - protein, 9 aa, Dengue virus
LGAMTAGTF

SEQ ID NO: 252955 - protein, 9 aa, Dengue virus
KLRDSYTQV

SEQ ID NO: 252956 - protein, 9 aa, Dengue virus
GQMEGRHKK

SEQ ID NO: 252957 - protein, 9 aa, Dengue virus
RMVMTTTAN

SEQ ID NO: 252958 - protein, 9 aa, Dengue virus
AMCTNTFVL

SEQ ID NO: 252959 - protein, 9 aa, Dengue virus
KIPGGNMYA

SEQ ID NO: 252960 - protein, 9 aa, Dengue virus
STNIWLKLR

SEQ ID NO: 252961 - protein, 9 aa, Dengue virus
GGITLFLGF

SEQ ID NO: 252962 - protein, 9 aa, Dengue virus
TLLSLTFIR

SEQ ID NO: 252963 - protein, 9 aa, Dengue virus
WKLARASFI

SEQ ID NO: 252964 - protein, 9 aa, Dengue virus
TPRSPSVEV

SEQ ID NO: 252965 - protein, 9 aa, Dengue virus
MLMTGTLVV

SEQ ID NO: 252966 - protein, 9 aa, Dengue virus
FLAGFMAYM

SEQ ID NO: 252967 - protein, 9 aa, Dengue virus
GGLFTSVGK

SEQ ID NO: 252968 - protein, 9 aa, Dengue virus
SMTCIVVGM

SEQ ID NO: 252969 - protein, 9 aa, Dengue virus
VPSLPLFIF

SEQ ID NO: 252970 - protein, 9 aa, Dengue virus
TLMAAILAY

SEQ ID NO: 252971 - protein, 9 aa, Dengue virus
DVFFTPPEK

SEQ ID NO: 252972 - protein, 9 aa, Dengue virus
RGRIGRNPA

SEQ ID NO: 252973 - protein, 9 aa, Dengue virus
LMLLPTTLA

SEQ ID NO: 252974 - protein, 9 aa, Dengue virus
MIRILIGLL

SEQ ID NO: 252975 - protein, 9 aa, Dengue virus
WFLDLPLPW

SEQ ID NO: 252976 - protein, 9 aa, Dengue virus
KAYAQMWSL

SEQ ID NO: 252977 - protein, 9 aa, Dengue virus
SPAATQKAT

SEQ ID NO: 252978 - protein, 9 aa, Dengue virus
TLTAALFLL

SEQ ID NO: 252979 - protein, 9 aa, Dengue virus
KLTLKGVSY

SEQ ID NO: 252980 - protein, 9 aa, Dengue virus
TPQAPMTEI

SEQ ID NO: 252981 - protein, 9 aa, Dengue virus
AVEDEDFWK

SEQ ID NO: 252982 - protein, 9 aa, Dengue virus
GPSLRTTTA

SEQ ID NO: 252983 - protein, 9 aa, Dengue virus
NIQTAITQV

SEQ ID NO: 252984 - protein, 9 aa, Dengue virus
YIGTSLTQK

SEQ ID NO: 252985 - protein, 9 aa, Dengue virus
AMVLSIASL

SEQ ID NO: 252986 - protein, 9 aa, Dengue virus
VLLVAVSFM

SEQ ID NO: 252987 - protein, 9 aa, Dengue virus
RQMEGEGIF

SEQ ID NO: 252988 - protein, 9 aa, Dengue virus
TMTHRKPTY

SEQ ID NO: 252989 - protein, 9 aa, Dengue virus
KVASAGISY

SEQ ID NO: 252990 - protein, 9 aa, Dengue virus
IFRKRRLTI

SEQ ID NO: 252991 - protein, 9 aa, Dengue virus
TYLALMATF

SEQ ID NO: 252992 - protein, 9 aa, Dengue virus
LTAAVLMLL

SEQ ID NO: 252993 - protein, 9 aa, Dengue virus
CIWPKSHTL

SEQ ID NO: 252994 - protein, 9 aa, Dengue virus
ALLSLTFIK

SEQ ID NO: 252995 - protein, 9 aa, Dengue virus
RIISSTPLA

SEQ ID NO: 252996 - protein, 9 aa, Dengue virus
FQDGVFHTM

SEQ ID NO: 252997 - protein, 9 aa, Dengue virus
TMFLITETK

SEQ ID NO: 252998 - protein, 9 aa, Dengue virus
IPKIYGGPT

SEQ ID NO: 252999 - protein, 9 aa, Dengue virus
AVVLMGLDK

SEQ ID NO: 253000 - protein, 9 aa, Dengue virus
SLVMLLVHY

SEQ ID NO: 253001 - protein, 9 aa, Dengue virus
VIGTSITQK

SEQ ID NO: 253002 - protein, 9 aa, Dengue virus
FTNMEAQLV

SEQ ID NO: 253003 - protein, 9 aa, Dengue virus
LIDGISLGL

SEQ ID NO: 253004 - protein, 9 aa, Dengue virus
VERLKRMAI

SEQ ID NO: 253005 - protein, 9 aa, Dengue virus
LMSGKGIGK

SEQ ID NO: 253006 - protein, 9 aa, Dengue virus
CNKVRSNAA

SEQ ID NO: 253007 - protein, 9 aa, Dengue virus
NPTTLIASL

SEQ ID NO: 253008 - protein, 9 aa, Dengue virus
SLVMLFVHY

SEQ ID NO: 253009 - protein, 9 aa, Dengue virus
LVKRFSTGL

SEQ ID NO: 253010 - protein, 9 aa, Dengue virus
LQRKFGGAL

SEQ ID NO: 253011 - protein, 9 aa, Dengue virus
QILEENVEV

SEQ ID NO: 253012 - protein, 9 aa, Dengue virus
TILVKVEYK

SEQ ID NO: 253013 - protein, 9 aa, Dengue virus
TQMCDHRLM

SEQ ID NO: 253014 - protein, 9 aa, Dengue virus
RQLNSLDRK

SEQ ID NO: 253015 - protein, 9 aa, Dengue virus
QVIAVEPGK

SEQ ID NO: 253016 - protein, 9 aa, Dengue virus
TILIRTGLL

SEQ ID NO: 253017 - protein, 9 aa, Dengue virus
SQHNHRPGY

SEQ ID NO: 253018 - protein, 9 aa, Dengue virus
MSLGNILFM

SEQ ID NO: 253019 - protein, 9 aa, Dengue virus
AAVLMGLGK

SEQ ID NO: 253020 - protein, 9 aa, Dengue virus
ILLTAVAPS

SEQ ID NO: 253021 - protein, 9 aa, Dengue virus
ALFLEEMLR

SEQ ID NO: 253022 - protein, 9 aa, Dengue virus
YILRDVGKK

SEQ ID NO: 253023 - protein, 9 aa, Dengue virus
SPAAAQKAT

SEQ ID NO: 253024 - protein, 9 aa, Dengue virus
SQLAKRFSR

SEQ ID NO: 253025 - protein, 9 aa, Dengue virus
RMKKKTWLV

SEQ ID NO: 253026 - protein, 9 aa, Dengue virus
ALMVIGMAM

SEQ ID NO: 253027 - protein, 9 aa, Dengue virus
GILTLAATI

SEQ ID NO: 253028 - protein, 9 aa, Dengue virus
MWHVTRGAV

SEQ ID NO: 253029 - protein, 9 aa, Dengue virus
RSCTLPPLR

SEQ ID NO: 253030 - protein, 9 aa, Dengue virus
SQHNNRPGY

SEQ ID NO: 253031 - protein, 9 aa, Dengue virus
VILAGPMPV

SEQ ID NO: 253032 - protein, 9 aa, Dengue virus
GLFKTSTGT

SEQ ID NO: 253033 - protein, 9 aa, Dengue virus
MVLLQMENK

SEQ ID NO: 253034 - protein, 9 aa, Dengue virus
VMKRYSAHF

SEQ ID NO: 253035 - protein, 9 aa, Dengue virus
TSGSPIINK

SEQ ID NO: 253036 - protein, 9 aa, Dengue virus
TPEARNNTF

SEQ ID NO: 253037 - protein, 9 aa, Dengue virus
AILTIIGLV

SEQ ID NO: 253038 - protein, 9 aa, Dengue virus
VSAIAQTEK

SEQ ID NO: 253039 - protein, 9 aa, Dengue virus
ILIRTGLLV

SEQ ID NO: 253040 - protein, 9 aa, Dengue virus
AVQNWLTRV

SEQ ID NO: 253041 - protein, 9 aa, Dengue virus
KQPATLRKF

SEQ ID NO: 253042 - protein, 9 aa, Dengue virus
VVRPPFNML

SEQ ID NO: 253043 - protein, 9 aa, Dengue virus
KLKERQDVF

SEQ ID NO: 253044 - protein, 9 aa, Dengue virus
TPQSSTTEA

SEQ ID NO: 253045 - protein, 9 aa, Dengue virus
VLCAVQLLL

SEQ ID NO: 253046 - protein, 9 aa, Dengue virus
IMAVGVVSI

SEQ ID NO: 253047 - protein, 9 aa, Dengue virus
QVDNFSLGV

SEQ ID NO: 253048 - protein, 9 aa, Dengue virus
CLNAFVLKK

SEQ ID NO: 253049 - protein, 9 aa, Dengue virus
MWRQISNEL

SEQ ID NO: 253050 - protein, 9 aa, Dengue virus
IANQATVLM

SEQ ID NO: 253051 - protein, 9 aa, Dengue virus
IPKIYGGPM

SEQ ID NO: 253052 - protein, 9 aa, Dengue virus
TLPTYLSSK

SEQ ID NO: 253053 - protein, 9 aa, Dengue virus
EVMRGKFGK

SEQ ID NO: 253054 - protein, 9 aa, Dengue virus
RQMEGEGLF

SEQ ID NO: 253055 - protein, 9 aa, Dengue virus
WTMKIEIGV

SEQ ID NO: 253056 - protein, 9 aa, Dengue virus
TIGTTYFQR

SEQ ID NO: 253057 - protein, 9 aa, Dengue virus
GMVTLYLGV

SEQ ID NO: 253058 - protein, 9 aa, Dengue virus
WLKLREVYT

SEQ ID NO: 253059 - protein, 9 aa, Dengue virus
KLREKQDAF

SEQ ID NO: 253060 - protein, 9 aa, Dengue virus
AVKNWLIRV

SEQ ID NO: 253061 - protein, 9 aa, Dengue virus
MPIRYQTTA

SEQ ID NO: 253062 - protein, 9 aa, Dengue virus
GILCASIMI

SEQ ID NO: 253063 - protein, 9 aa, Dengue virus
MTTVFSIPH

SEQ ID NO: 253064 - protein, 9 aa, Dengue virus
LMMVLPAAL

SEQ ID NO: 253065 - protein, 9 aa, Dengue virus
SQHNYRQGY

SEQ ID NO: 253066 - protein, 9 aa, Dengue virus
ILLTGGAML

SEQ ID NO: 253067 - protein, 9 aa, Dengue virus
AISCVPNAV

SEQ ID NO: 253068 - protein, 9 aa, Dengue virus
SKSEFNTYK

SEQ ID NO: 253069 - protein, 9 aa, Dengue virus
ITNITTDSR

SEQ ID NO: 253070 - protein, 9 aa, Dengue virus
GAIFTDENK

SEQ ID NO: 253071 - protein, 9 aa, Dengue virus
RTWAYHGSY

SEQ ID NO: 253072 - protein, 9 aa, Dengue virus
TILTIIALV

SEQ ID NO: 253073 - protein, 9 aa, Dengue virus
TLEARNSTF

SEQ ID NO: 253074 - protein, 9 aa, Dengue virus
SLIGDEEFL

SEQ ID NO: 253075 - protein, 9 aa, Dengue virus
GQPSFNMLK

SEQ ID NO: 253076 - protein, 9 aa, Dengue virus
IIMLTPTVM

SEQ ID NO: 253077 - protein, 9 aa, Dengue virus
RLRMDKLQL

SEQ ID NO: 253078 - protein, 9 aa, Dengue virus
IQNSGGTNI

SEQ ID NO: 253079 - protein, 9 aa, Dengue virus
TMLLMLVPT

SEQ ID NO: 253080 - protein, 9 aa, Dengue virus
LTAAVLLLI

SEQ ID NO: 253081 - protein, 9 aa, Dengue virus
SIGGLFTSV

SEQ ID NO: 253082 - protein, 9 aa, Dengue virus
KMLMTGTLV

SEQ ID NO: 253083 - protein, 9 aa, Dengue virus
VLVGIVTLY

SEQ ID NO: 253084 - protein, 9 aa, Dengue virus
IQRTVFFVL

SEQ ID NO: 253085 - protein, 9 aa, Dengue virus
RTLRVLSLV

SEQ ID NO: 253086 - protein, 9 aa, Dengue virus
CTGLFKLEK

SEQ ID NO: 253087 - protein, 9 aa, Dengue virus
VVIGLLFMI

SEQ ID NO: 253088 - protein, 9 aa, Dengue virus
RKRSVTMIL

SEQ ID NO: 253089 - protein, 9 aa, Dengue virus
KIIQWLETK

SEQ ID NO: 253090 - protein, 9 aa, Dengue virus
CTLPPLRYR

SEQ ID NO: 253091 - protein, 9 aa, Dengue virus
IPMVTQMAM

SEQ ID NO: 253092 - protein, 9 aa, Dengue virus
FLLVAHYAI

SEQ ID NO: 253093 - protein, 9 aa, Dengue virus
GAIKVLKGF

SEQ ID NO: 253094 - protein, 9 aa, Dengue virus
PVMRRYSAL

SEQ ID NO: 253095 - protein, 9 aa, Dengue virus
SLTCSNTIF

SEQ ID NO: 253096 - protein, 9 aa, Dengue virus
LSSRATWAK

SEQ ID NO: 253097 - protein, 9 aa, Dengue virus
VVLEHGSCV

SEQ ID NO: 253098 - protein, 9 aa, Dengue virus
MIGSNASDK

SEQ ID NO: 253099 - protein, 9 aa, Dengue virus
CVTTMAKNK

SEQ ID NO: 253100 - protein, 9 aa, Dengue virus
WAKNIQTAI

SEQ ID NO: 253101 - protein, 9 aa, Dengue virus
SQSAIPETV

SEQ ID NO: 253102 - protein, 9 aa, Dengue virus
KQLGQIMLL

SEQ ID NO: 253103 - protein, 9 aa, Dengue virus
AVEDEEFWK

SEQ ID NO: 253104 - protein, 9 aa, Dengue virus
LLKATLLAI

SEQ ID NO: 253105 - protein, 9 aa, Dengue virus
SLTQKAVIF

SEQ ID NO: 253106 - protein, 9 aa, Dengue virus
LTAVVLLLV

SEQ ID NO: 253107 - protein, 9 aa, Dengue virus
TLLCLIPTA

SEQ ID NO: 253108 - protein, 9 aa, Dengue virus
SLGILCVSI

SEQ ID NO: 253109 - protein, 9 aa, Dengue virus
TMAMILSIV

SEQ ID NO: 253110 - protein, 9 aa, Dengue virus
LTLKGVSYV

SEQ ID NO: 253111 - protein, 9 aa, Dengue virus
TPTWNRKEL

SEQ ID NO: 253112 - protein, 9 aa, Dengue virus
IMTTTANWL

SEQ ID NO: 253113 - protein, 9 aa, Dengue virus
KTVWFVPSI

SEQ ID NO: 253114 - protein, 9 aa, Dengue virus
GLFGKGSLV

SEQ ID NO: 253115 - protein, 9 aa, Dengue virus
SMAMTCITV

SEQ ID NO: 253116 - protein, 9 aa, Dengue virus
TLAVFLLLT

SEQ ID NO: 253117 - protein, 9 aa, Dengue virus
IVVGMVTLY

SEQ ID NO: 253118 - protein, 9 aa, Dengue virus
TMLLMLIPT

SEQ ID NO: 253119 - protein, 9 aa, Dengue virus
TTANWLWTL

SEQ ID NO: 253120 - protein, 9 aa, Dengue virus
MWKQITSEL

SEQ ID NO: 253121 - protein, 9 aa, Dengue virus
WLWTLLGKK

SEQ ID NO: 253122 - protein, 9 aa, Dengue virus
TPRGTVMDI

SEQ ID NO: 253123 - protein, 9 aa, Dengue virus
ILLAAVSFV

SEQ ID NO: 253124 - protein, 9 aa, Dengue virus
GVFPVSIPI

SEQ ID NO: 253125 - protein, 9 aa, Dengue virus
ATWAKNIQV

SEQ ID NO: 253126 - protein, 9 aa, Dengue virus
ITYKCPLLK

SEQ ID NO: 253127 - protein, 9 aa, Dengue virus
STMTLLCLI

SEQ ID NO: 253128 - protein, 9 aa, Dengue virus
IMAAILAYT

SEQ ID NO: 253129 - protein, 9 aa, Dengue virus
IVFFVLMML

SEQ ID NO: 253130 - protein, 9 aa, Dengue virus
SLIEVKTCL

SEQ ID NO: 253131 - protein, 9 aa, Dengue virus
RSVSTETEK

SEQ ID NO: 253132 - protein, 9 aa, Dengue virus
LLARSIFKL

SEQ ID NO: 253133 - protein, 9 aa, Dengue virus
MTLGMCCIV

SEQ ID NO: 253134 - protein, 9 aa, Dengue virus
CVMASSVLL

SEQ ID NO: 253135 - protein, 9 aa, Dengue virus
ALCESITLA

SEQ ID NO: 253136 - protein, 9 aa, Dengue virus
QPQWIAASI

SEQ ID NO: 253137 - protein, 9 aa, Dengue virus
AVVSVSPLF

SEQ ID NO: 253138 - protein, 9 aa, Dengue virus
SVSLVLVGV

SEQ ID NO: 253139 - protein, 9 aa, Dengue virus
TANPIVTKK

SEQ ID NO: 253140 - protein, 9 aa, Dengue virus
FLDLPLPWA

SEQ ID NO: 253141 - protein, 9 aa, Dengue virus
TTNIWLRLK

SEQ ID NO: 253142 - protein, 9 aa, Dengue virus
WFFDLPLPW

SEQ ID NO: 253143 - protein, 9 aa, Dengue virus
YVLGVFLRK

SEQ ID NO: 253144 - protein, 9 aa, Dengue virus
GLYPLAIPV

SEQ ID NO: 253145 - protein, 9 aa, Dengue virus
ALLKNDVPL

SEQ ID NO: 253146 - protein, 9 aa, Dengue virus
SLGGVFTSV

SEQ ID NO: 253147 - protein, 9 aa, Dengue virus
TMGPWHLGK

SEQ ID NO: 253148 - protein, 9 aa, Dengue virus
TYLALIATF

SEQ ID NO: 253149 - protein, 9 aa, Dengue virus
VSTPQGLVK

SEQ ID NO: 253150 - protein, 9 aa, Dengue virus
DLRLASMAI

SEQ ID NO: 253151 - protein, 9 aa, Dengue virus
AIFLTTLSR

SEQ ID NO: 253152 - protein, 9 aa, Dengue virus
KALKINWYR

SEQ ID NO: 253153 - protein, 9 aa, Dengue virus
NSKNTSMSF

SEQ ID NO: 253154 - protein, 9 aa, Dengue virus
MLKRERNRV

SEQ ID NO: 253155 - protein, 9 aa, Dengue virus
LAKRFSKGL

SEQ ID NO: 253156 - protein, 9 aa, Dengue virus
GPMKLVMAF

SEQ ID NO: 253157 - protein, 9 aa, Dengue virus
KLVMAFIAF

SEQ ID NO: 253158 - protein, 9 aa, Dengue virus
LVMAFIAFL

SEQ ID NO: 253159 - protein, 9 aa, Dengue virus
IAFLRFLAI

SEQ ID NO: 253160 - protein, 9 aa, Dengue virus
PTLDFELIK

SEQ ID NO: 253161 - protein, 9 aa, Dengue virus
WLVHKQWFL

SEQ ID NO: 253162 - protein, 9 aa, Dengue virus
KQWFLDLPL

SEQ ID NO: 253163 - protein, 9 aa, Dengue virus
WFLDLPLPW

SEQ ID NO: 253164 - protein, 9 aa, Dengue virus
VTFKTAHAK

SEQ ID NO: 253165 - protein, 9 aa, Dengue virus
AMHTALTGA

SEQ ID NO: 253166 - protein, 9 aa, Dengue virus
ARGARRMAI

SEQ ID NO: 253167 - protein, 9 aa, Dengue virus
FQADSPKRL

SEQ ID NO: 253168 - protein, 9 aa, Dengue virus
SPKRLSAAI

SEQ ID NO: 253169 - protein, 9 aa, Dengue virus
KAVHADMGY

SEQ ID NO: 253170 - protein, 9 aa, Dengue virus
WPKSHTLWS

SEQ ID NO: 253171 - protein, 9 aa, Dengue virus
SQHNYRPGY

SEQ ID NO: 253172 - protein, 9 aa, Dengue virus
GPSLRTTTA

SEQ ID NO: 253173 - protein, 9 aa, Dengue virus
RSCTLPPLR

SEQ ID NO: 253174 - protein, 9 aa, Dengue virus
CLQKQSHWV

SEQ ID NO: 253175 - protein, 9 aa, Dengue virus
PLNEGIMAV

SEQ ID NO: 253176 - protein, 9 aa, Dengue virus
SILASSLLK

SEQ ID NO: 253177 - protein, 9 aa, Dengue virus
ALLKNDVPL

SEQ ID NO: 253178 - protein, 9 aa, Dengue virus
GPLVAGGLL

SEQ ID NO: 253179 - protein, 9 aa, Dengue virus
SSADLSLEK

SEQ ID NO: 253180 - protein, 9 aa, Dengue virus
GVFHTMWHV

SEQ ID NO: 253181 - protein, 9 aa, Dengue virus
MWHVTRGAV

SEQ ID NO: 253182 - protein, 9 aa, Dengue virus
QVIAVEPGK

SEQ ID NO: 253183 - protein, 9 aa, Dengue virus
KPGTSGSPI

SEQ ID NO: 253184 - protein, 9 aa, Dengue virus
FRKKRLTIM

SEQ ID NO: 253185 - protein, 9 aa, Dengue virus
LPAIVREAI

SEQ ID NO: 253186 - protein, 9 aa, Dengue virus
RTLILAPTR

SEQ ID NO: 253187 - protein, 9 aa, Dengue virus
TLILAPTRV

SEQ ID NO: 253188 - protein, 9 aa, Dengue virus
ALRGLPIRY

SEQ ID NO: 253189 - protein, 9 aa, Dengue virus
LPIRYQTPA

SEQ ID NO: 253190 - protein, 9 aa, Dengue virus
LMCHATFTM

SEQ ID NO: 253191 - protein, 9 aa, Dengue virus
ATFTMRLLS

SEQ ID NO: 253192 - protein, 9 aa, Dengue virus
VPNYNLIIM

SEQ ID NO: 253193 - protein, 9 aa, Dengue virus
LIIMDEAHF

SEQ ID NO: 253194 - protein, 9 aa, Dengue virus
IIMDEAHFT

SEQ ID NO: 253195 - protein, 9 aa, Dengue virus
FTDPASIAA

SEQ ID NO: 253196 - protein, 9 aa, Dengue virus
FMTATPPGS

SEQ ID NO: 253197 - protein, 9 aa, Dengue virus
KTVWFVPSI

SEQ ID NO: 253198 - protein, 9 aa, Dengue virus
TVWFVPSIK

SEQ ID NO: 253199 - protein, 9 aa, Dengue virus
KTFDTEYQK

SEQ ID NO: 253200 - protein, 9 aa, Dengue virus
RVIDPRRCL

SEQ ID NO: 253201 - protein, 9 aa, Dengue virus
VIDPRRCLK

SEQ ID NO: 253202 - protein, 9 aa, Dengue virus
VILAGPMPV

SEQ ID NO: 253203 - protein, 9 aa, Dengue virus
MPVTVASAA

SEQ ID NO: 253204 - protein, 9 aa, Dengue virus
ALFEPEREK

SEQ ID NO: 253205 - protein, 9 aa, Dengue virus
EARKTFVDL

SEQ ID NO: 253206 - protein, 9 aa, Dengue virus
KTFVELMRR

SEQ ID NO: 253207 - protein, 9 aa, Dengue virus
LMRRGDLPV

SEQ ID NO: 253208 - protein, 9 aa, Dengue virus
KVASAGISY

SEQ ID NO: 253209 - protein, 9 aa, Dengue virus
RPRWLDART

SEQ ID NO: 253210 - protein, 9 aa, Dengue virus
RTYSDPLAL

SEQ ID NO: 253211 - protein, 9 aa, Dengue virus
AYQHALNEL

SEQ ID NO: 253212 - protein, 9 aa, Dengue virus
IAASIILEF

SEQ ID NO: 253213 - protein, 9 aa, Dengue virus
IILEFFLMV

SEQ ID NO: 253214 - protein, 9 aa, Dengue virus
QLTYVVIAI

SEQ ID NO: 253215 - protein, 9 aa, Dengue virus
ASAWTLYAV

SEQ ID NO: 253216 - protein, 9 aa, Dengue virus
TLYAVATTI

SEQ ID NO: 253217 - protein, 9 aa, Dengue virus
SLTAIANQA

SEQ ID NO: 253218 - protein, 9 aa, Dengue virus
NQATVLMGL

SEQ ID NO: 253219 - protein, 9 aa, Dengue virus
AAVLMGLGK

SEQ ID NO: 253220 - protein, 9 aa, Dengue virus
MGLGKGWPL

SEQ ID NO: 253221 - protein, 9 aa, Dengue virus
IIGPGLQAK

SEQ ID NO: 253222 - protein, 9 aa, Dengue virus
LQAKATREA

SEQ ID NO: 253223 - protein, 9 aa, Dengue virus
KQLGQVMLL

SEQ ID NO: 253224 - protein, 9 aa, Dengue virus
VLMMRTTWA

SEQ ID NO: 253225 - protein, 9 aa, Dengue virus
LLMRTTWAL

SEQ ID NO: 253226 - protein, 9 aa, Dengue virus
IAVSMANIF

SEQ ID NO: 253227 - protein, 9 aa, Dengue virus
AVSMANIFR

SEQ ID NO: 253228 - protein, 9 aa, Dengue virus
MANIFRGSY

SEQ ID NO: 253229 - protein, 9 aa, Dengue virus
NIFRGSYLA

SEQ ID NO: 253230 - protein, 9 aa, Dengue virus
YLAGAGLAF

SEQ ID NO: 253231 - protein, 9 aa, Dengue virus
AGLAFSLIK

SEQ ID NO: 253232 - protein, 9 aa, Dengue virus
HAVSRGSAK

SEQ ID NO: 253233 - protein, 9 aa, Dengue virus
CGRGGWSYY

SEQ ID NO: 253234 - protein, 9 aa, Dengue virus
WSYYCAGLK

SEQ ID NO: 253235 - protein, 9 aa, Dengue virus
ATYGWNLVK

SEQ ID NO: 253236 - protein, 9 aa, Dengue virus
TYGWNLVKL

SEQ ID NO: 253237 - protein, 9 aa, Dengue virus
KLHSGVDVF

SEQ ID NO: 253238 - protein, 9 aa, Dengue virus
VLNPYMPTV

SEQ ID NO: 253239 - protein, 9 aa, Dengue virus
LSRNSTHEM

SEQ ID NO: 253240 - protein, 9 aa, Dengue virus
MISRMLINR

SEQ ID NO: 253241 - protein, 9 aa, Dengue virus
KTWAYHGSY

SEQ ID NO: 253242 - protein, 9 aa, Dengue virus
SSMVNGVVK

SEQ ID NO: 253243 - protein, 9 aa, Dengue virus
SMVNGVVKL

SEQ ID NO: 253244 - protein, 9 aa, Dengue virus
KLLTKPWDV

SEQ ID NO: 253245 - protein, 9 aa, Dengue virus
MAMTDTTPF

SEQ ID NO: 253246 - protein, 9 aa, Dengue virus
TPFGQQRVF

SEQ ID NO: 253247 - protein, 9 aa, Dengue virus
CVYNMMGKR

SEQ ID NO: 253248 - protein, 9 aa, Dengue virus
MMGKREKKL

SEQ ID NO: 253249 - protein, 9 aa, Dengue virus
KLGEFGKAK

SEQ ID NO: 253250 - protein, 9 aa, Dengue virus
AIWYMWLGA

SEQ ID NO: 253251 - protein, 9 aa, Dengue virus
YMWLGARFL

SEQ ID NO: 253252 - protein, 9 aa, Dengue virus
WLGARFLEF

SEQ ID NO: 253253 - protein, 9 aa, Dengue virus
GFLNEDHWF

SEQ ID NO: 253254 - protein, 9 aa, Dengue virus
FLNEDHWFS

SEQ ID NO: 253255 - protein, 9 aa, Dengue virus
MYADDTAGW

SEQ ID NO: 253256 - protein, 9 aa, Dengue virus
LTYQNKVVR

SEQ ID NO: 253257 - protein, 9 aa, Dengue virus
TVMDIISRK

SEQ ID NO: 253258 - protein, 9 aa, Dengue virus
KAYAQMWSL

SEQ ID NO: 253259 - protein, 9 aa, Dengue virus
YAQMWSLMY

SEQ ID NO: 253260 - protein, 9 aa, Dengue virus
AQMWSLMYF

SEQ ID NO: 253261 - protein, 9 aa, Dengue virus
LMYFHRRDL

SEQ ID NO: 253262 - protein, 9 aa, Dengue virus
YFHRRDLRL

SEQ ID NO: 253263 - protein, 9 aa, Dengue virus
DLRLAANAI

SEQ ID NO: 253264 - protein, 9 aa, Dengue virus
GSLIGLTSR

SEQ ID NO: 253265 - protein, 9 aa, Dengue virus
SLIGLTSRA

SEQ ID NO: 253266 - protein, 9 aa, Dengue virus
MLKRARNRV

SEQ ID NO: 253267 - protein, 9 aa, Dengue virus
LVKRFSTGL

SEQ ID NO: 253268 - protein, 9 aa, Dengue virus
GPLRMVLAF

SEQ ID NO: 253269 - protein, 9 aa, Dengue virus
RMVLAFITF

SEQ ID NO: 253270 - protein, 9 aa, Dengue virus
MVLAFITFL

SEQ ID NO: 253271 - protein, 9 aa, Dengue virus
ITFLRVLSI

SEQ ID NO: 253272 - protein, 9 aa, Dengue virus
PTLDIELLK

SEQ ID NO: 253273 - protein, 9 aa, Dengue virus
WMVHRQWFF

SEQ ID NO: 253274 - protein, 9 aa, Dengue virus
RQWFFDLPL

SEQ ID NO: 253275 - protein, 9 aa, Dengue virus
WFFDLPLPW

SEQ ID NO: 253276 - protein, 9 aa, Dengue virus
VTFKNAHAK

SEQ ID NO: 253277 - protein, 9 aa, Dengue virus
AMHSALAGA

SEQ ID NO: 253278 - protein, 9 aa, Dengue virus
YRGAKRMAI

SEQ ID NO: 253279 - protein, 9 aa, Dengue virus
FQPESPARL

SEQ ID NO: 253280 - protein, 9 aa, Dengue virus
SPSKLASAI

SEQ ID NO: 253281 - protein, 9 aa, Dengue virus
RAVHADMGY

SEQ ID NO: 253282 - protein, 9 aa, Dengue virus
WPKTHTLWS

SEQ ID NO: 253283 - protein, 9 aa, Dengue virus
SQHNYRQGY

SEQ ID NO: 253284 - protein, 9 aa, Dengue virus
GPSLRTTTV

SEQ ID NO: 253285 - protein, 9 aa, Dengue virus
RSCTMPPLR

SEQ ID NO: 253286 - protein, 9 aa, Dengue virus
CLQKQSHWI

SEQ ID NO: 253287 - protein, 9 aa, Dengue virus
PLNEGVMAV

SEQ ID NO: 253288 - protein, 9 aa, Dengue virus
SLLGSALLK

SEQ ID NO: 253289 - protein, 9 aa, Dengue virus
SLLKNDIPM

SEQ ID NO: 253290 - protein, 9 aa, Dengue virus
GPMVAGGLL

SEQ ID NO: 253291 - protein, 9 aa, Dengue virus
RSADLELER

SEQ ID NO: 253292 - protein, 9 aa, Dengue virus
GTFHTMWHV

SEQ ID NO: 253293 - protein, 9 aa, Dengue virus
MWHVTRGSV

SEQ ID NO: 253294 - protein, 9 aa, Dengue virus
QVLALEPGK

SEQ ID NO: 253295 - protein, 9 aa, Dengue virus
SPGTSGSPI

SEQ ID NO: 253296 - protein, 9 aa, Dengue virus
FKKRNLTIM

SEQ ID NO: 253297 - protein, 9 aa, Dengue virus
LPSIVREAL

SEQ ID NO: 253298 - protein, 9 aa, Dengue virus
ALKGMPIRY

SEQ ID NO: 253299 - protein, 9 aa, Dengue virus
LPIRYQTTA

SEQ ID NO: 253300 - protein, 9 aa, Dengue virus
LMCHATFTT

SEQ ID NO: 253301 - protein, 9 aa, Dengue virus
ATFTTRLLS

SEQ ID NO: 253302 - protein, 9 aa, Dengue virus
VPNYNLIVM

SEQ ID NO: 253303 - protein, 9 aa, Dengue virus
LIVMDEAHF

SEQ ID NO: 253304 - protein, 9 aa, Dengue virus
IVMDEAHFT

SEQ ID NO: 253305 - protein, 9 aa, Dengue virus
FTDPSSVAA

SEQ ID NO: 253306 - protein, 9 aa, Dengue virus
FMTATPPGT

SEQ ID NO: 253307 - protein, 9 aa, Dengue virus
KTFDTEYPK

SEQ ID NO: 253308 - protein, 9 aa, Dengue virus
RVIDPRRCM

SEQ ID NO: 253309 - protein, 9 aa, Dengue virus
VIDPRRCMK

SEQ ID NO: 253310 - protein, 9 aa, Dengue virus
VILAGPIPV

SEQ ID NO: 253311 - protein, 9 aa, Dengue virus
IPVTPASAA

SEQ ID NO: 253312 - protein, 9 aa, Dengue virus
TLFGPEREK

SEQ ID NO: 253313 - protein, 9 aa, Dengue virus
EQRKTFVEL

SEQ ID NO: 253314 - protein, 9 aa, Dengue virus
KTFVDLMRR

SEQ ID NO: 253315 - protein, 9 aa, Dengue virus
LMKRGDLPV

SEQ ID NO: 253316 - protein, 9 aa, Dengue virus
KVASEGFQY

SEQ ID NO: 253317 - protein, 9 aa, Dengue virus
KPRWLDARI

SEQ ID NO: 253318 - protein, 9 aa, Dengue virus
RVYADPMAL

SEQ ID NO: 253319 - protein, 9 aa, Dengue virus
AYNHALSEL

SEQ ID NO: 253320 - protein, 9 aa, Dengue virus
IASAIVLEF

SEQ ID NO: 253321 - protein, 9 aa, Dengue virus
IILEFFLIV

SEQ ID NO: 253322 - protein, 9 aa, Dengue virus
QLAYVVIGL

SEQ ID NO: 253323 - protein, 9 aa, Dengue virus
TLYAVATTV

SEQ ID NO: 253324 - protein, 9 aa, Dengue virus
SLAAIANQA

SEQ ID NO: 253325 - protein, 9 aa, Dengue virus
NQAAVLMGL

SEQ ID NO: 253326 - protein, 9 aa, Dengue virus
AAILMGLDK

SEQ ID NO: 253327 - protein, 9 aa, Dengue virus
MGLDKGWPI

SEQ ID NO: 253328 - protein, 9 aa, Dengue virus
KQLGQIMLL

SEQ ID NO: 253329 - protein, 9 aa, Dengue virus
LLLMRTTWA

SEQ ID NO: 253330 - protein, 9 aa, Dengue virus
LMMRTTWAL

SEQ ID NO: 253331 - protein, 9 aa, Dengue virus
IAVSTANIF

SEQ ID NO: 253332 - protein, 9 aa, Dengue virus
AVSTANIFR

SEQ ID NO: 253333 - protein, 9 aa, Dengue virus
TANIFRGSY

SEQ ID NO: 253334 - protein, 9 aa, Dengue virus
YLAGAGLLF

SEQ ID NO: 253335 - protein, 9 aa, Dengue virus
AGLLFSIMK

SEQ ID NO: 253336 - protein, 9 aa, Dengue virus
HAVSRGTAK

SEQ ID NO: 253337 - protein, 9 aa, Dengue virus
WSYYCGGLK

SEQ ID NO: 253338 - protein, 9 aa, Dengue virus
STYGWNLVR

SEQ ID NO: 253339 - protein, 9 aa, Dengue virus
TYGWNLVRL

SEQ ID NO: 253340 - protein, 9 aa, Dengue virus
RLQSGVDVF

SEQ ID NO: 253341 - protein, 9 aa, Dengue virus
VLNPYMPSV

SEQ ID NO: 253342 - protein, 9 aa, Dengue virus
MTSRMLLNR

SEQ ID NO: 253343 - protein, 9 aa, Dengue virus
RTWAYHGSY

SEQ ID NO: 253344 - protein, 9 aa, Dengue virus
SSMVNGVVR

SEQ ID NO: 253345 - protein, 9 aa, Dengue virus
SMVNGVVRL

SEQ ID NO: 253346 - protein, 9 aa, Dengue virus
RLLTKPWDV

SEQ ID NO: 253347 - protein, 9 aa, Dengue virus
LAMTDTTPF

SEQ ID NO: 253348 - protein, 9 aa, Dengue virus
KLGEFGRAK

SEQ ID NO: 253349 - protein, 9 aa, Dengue virus
YMWLGARYL

SEQ ID NO: 253350 - protein, 9 aa, Dengue virus
WLGARYLEF

SEQ ID NO: 253351 - protein, 9 aa, Dengue virus
GFMNEDHWF

SEQ ID NO: 253352 - protein, 9 aa, Dengue virus
FMNEDHWFS

SEQ ID NO: 253353 - protein, 9 aa, Dengue virus
IYADDTAGW

SEQ ID NO: 253354 - protein, 9 aa, Dengue virus
LTYQNKVVK

SEQ ID NO: 253355 - protein, 9 aa, Dengue virus
AVMDIISRK

SEQ ID NO: 253356 - protein, 9 aa, Dengue virus
KSYAQMWQL

SEQ ID NO: 253357 - protein, 9 aa, Dengue virus
YAQMWQLMY

SEQ ID NO: 253358 - protein, 9 aa, Dengue virus
AQMWQLMYF

SEQ ID NO: 253359 - protein, 9 aa, Dengue virus
DLRLASMAI

SEQ ID NO: 253360 - protein, 9 aa, Dengue virus
GSLIGLSSR

SEQ ID NO: 253361 - protein, 9 aa, Dengue virus
SLIGLSSRA

SEQ ID NO: 253362 - protein, 9 aa, Dengue virus
MLKRVRNRV

SEQ ID NO: 253363 - protein, 9 aa, Dengue virus
LTKRFSLGM

SEQ ID NO: 253364 - protein, 9 aa, Dengue virus
GPLKLFMAL

SEQ ID NO: 253365 - protein, 9 aa, Dengue virus
KLFMALVAF

SEQ ID NO: 253366 - protein, 9 aa, Dengue virus
LFMALVAFL

SEQ ID NO: 253367 - protein, 9 aa, Dengue virus
VAFLRFLTI

SEQ ID NO: 253368 - protein, 9 aa, Dengue virus
PTLDIELQK

SEQ ID NO: 253369 - protein, 9 aa, Dengue virus
WLVHRQWFL

SEQ ID NO: 253370 - protein, 9 aa, Dengue virus
RQWFLDLPL

SEQ ID NO: 253371 - protein, 9 aa, Dengue virus
WFLNLPLPW

SEQ ID NO: 253372 - protein, 9 aa, Dengue virus
VTFKVPHAK

SEQ ID NO: 253373 - protein, 9 aa, Dengue virus
AMHSALTGA

SEQ ID NO: 253374 - protein, 9 aa, Dengue virus
MRGAKRMAI

SEQ ID NO: 253375 - protein, 9 aa, Dengue virus
FQPESPSKL

SEQ ID NO: 253376 - protein, 9 aa, Dengue virus
SPARLASAI

SEQ ID NO: 253377 - protein, 9 aa, Dengue virus
WPRSHTLWS

SEQ ID NO: 253378 - protein, 9 aa, Dengue virus
SQHNHRPGY

SEQ ID NO: 253379 - protein, 9 aa, Dengue virus
PLNEAIMAV

SEQ ID NO: 253380 - protein, 9 aa, Dengue virus
SILLSSLLK

SEQ ID NO: 253381 - protein, 9 aa, Dengue virus
SLLKNDVPL

SEQ ID NO: 253382 - protein, 9 aa, Dengue virus
GPLIAGGML

SEQ ID NO: 253383 - protein, 9 aa, Dengue virus
TSADLTVEK

SEQ ID NO: 253384 - protein, 9 aa, Dengue virus
NVFHTMWHV

SEQ ID NO: 253385 - protein, 9 aa, Dengue virus
QVLAIEPGK

SEQ ID NO: 253386 - protein, 9 aa, Dengue virus
FRKRNLTIM

SEQ ID NO: 253387 - protein, 9 aa, Dengue virus
LPAIIREAI

SEQ ID NO: 253388 - protein, 9 aa, Dengue virus
ALKGLPIRY

SEQ ID NO: 253389 - protein, 9 aa, Dengue virus
MPIRYQTTA

SEQ ID NO: 253390 - protein, 9 aa, Dengue virus
VPNYNMIIM

SEQ ID NO: 253391 - protein, 9 aa, Dengue virus
MIIMDEAHF

SEQ ID NO: 253392 - protein, 9 aa, Dengue virus
VIMDEAHFT

SEQ ID NO: 253393 - protein, 9 aa, Dengue virus
FTDPSSIAA

SEQ ID NO: 253394 - protein, 9 aa, Dengue virus
FMTATPPGA

SEQ ID NO: 253395 - protein, 9 aa, Dengue virus
KTFDSEYVK

SEQ ID NO: 253396 - protein, 9 aa, Dengue virus
MPVTHSSAA

SEQ ID NO: 253397 - protein, 9 aa, Dengue virus
SMFEPEREK

SEQ ID NO: 253398 - protein, 9 aa, Dengue virus
EARKTFVEL

SEQ ID NO: 253399 - protein, 9 aa, Dengue virus
KTFVELMKR

SEQ ID NO: 253400 - protein, 9 aa, Dengue virus
KVASEGIKY

SEQ ID NO: 253401 - protein, 9 aa, Dengue virus
RPRWLDARV

SEQ ID NO: 253402 - protein, 9 aa, Dengue virus
RIYSDPLAL

SEQ ID NO: 253403 - protein, 9 aa, Dengue virus
AYRHAMEEL

SEQ ID NO: 253404 - protein, 9 aa, Dengue virus
IVLEFFMMV

SEQ ID NO: 253405 - protein, 9 aa, Dengue virus
QLIYVILTI

SEQ ID NO: 253406 - protein, 9 aa, Dengue virus
TLYAVATTF

SEQ ID NO: 253407 - protein, 9 aa, Dengue virus
NQAAILMGL

SEQ ID NO: 253408 - protein, 9 aa, Dengue virus
ATVLMGLGK

SEQ ID NO: 253409 - protein, 9 aa, Dengue virus
MGLGRGWPL

SEQ ID NO: 253410 - protein, 9 aa, Dengue virus
ILLMRTTWA

SEQ ID NO: 253411 - protein, 9 aa, Dengue virus
LLMRTTWAF

SEQ ID NO: 253412 - protein, 9 aa, Dengue virus
AGLAFSLMK

SEQ ID NO: 253413 - protein, 9 aa, Dengue virus
HAVSRGSSK

SEQ ID NO: 253414 - protein, 9 aa, Dengue virus
WSYYMATLK

SEQ ID NO: 253415 - protein, 9 aa, Dengue virus
STYGWNIVK

SEQ ID NO: 253416 - protein, 9 aa, Dengue virus
TYGWNIVKL

SEQ ID NO: 253417 - protein, 9 aa, Dengue virus
KLMSGKDVF

SEQ ID NO: 253418 - protein, 9 aa, Dengue virus
ILNPYMPSV

SEQ ID NO: 253419 - protein, 9 aa, Dengue virus
MVSRLLLNR

SEQ ID NO: 253420 - protein, 9 aa, Dengue virus
SSMINGVVK

SEQ ID NO: 253421 - protein, 9 aa, Dengue virus
SMINGVVKL

SEQ ID NO: 253422 - protein, 9 aa, Dengue virus
IAMTDTTPF

SEQ ID NO: 253423 - protein, 9 aa, Dengue virus
FLNEDHWFG

SEQ ID NO: 253424 - protein, 9 aa, Dengue virus
TVMDVISRR

SEQ ID NO: 253425 - protein, 9 aa, Dengue virus
KSYAQMWSL

SEQ ID NO: 253426 - protein, 9 aa, Dengue virus
YAQMWTLMY

SEQ ID NO: 253427 - protein, 9 aa, Dengue virus
AQMWTLMYF

SEQ ID NO: 253428 - protein, 9 aa, Dengue virus
DLRLASNAI

SEQ ID NO: 253429 - protein, 9 aa, Dengue virus
GSLIGLTAR

SEQ ID NO: 253430 - protein, 9 aa, Dengue virus
SLIGLTARA

SEQ ID NO: 253431 - protein, 9 aa, Dengue virus
LAKRFSRGL

SEQ ID NO: 253432 - protein, 9 aa, Dengue virus
GPMKMVMAF

SEQ ID NO: 253433 - protein, 9 aa, Dengue virus
KMVMAFIAF

SEQ ID NO: 253434 - protein, 9 aa, Dengue virus
MVMAFIAFL

SEQ ID NO: 253435 - protein, 9 aa, Dengue virus
PTLDFELTK

SEQ ID NO: 253436 - protein, 9 aa, Dengue virus
KQWFLNLPL

SEQ ID NO: 253437 - protein, 9 aa, Dengue virus
VTFKNPHAK

SEQ ID NO: 253438 - protein, 9 aa, Dengue virus
FQPESPARV

SEQ ID NO: 253439 - protein, 9 aa, Dengue virus
SPKRLATAI

SEQ ID NO: 253440 - protein, 9 aa, Dengue virus
SQHNNRPGY

SEQ ID NO: 253441 - protein, 9 aa, Dengue virus
PLNEGIMAI

SEQ ID NO: 253442 - protein, 9 aa, Dengue virus
SILASSLLR

SEQ ID NO: 253443 - protein, 9 aa, Dengue virus
SLLRNDVPM

SEQ ID NO: 253444 - protein, 9 aa, Dengue virus
RSADLELEK

SEQ ID NO: 253445 - protein, 9 aa, Dengue virus
FRKRRLTIM

SEQ ID NO: 253446 - protein, 9 aa, Dengue virus
VPNYNLVIM

SEQ ID NO: 253447 - protein, 9 aa, Dengue virus
LVIMDEAHF

SEQ ID NO: 253448 - protein, 9 aa, Dengue virus
FTDPCSVAA

SEQ ID NO: 253449 - protein, 9 aa, Dengue virus
KTFDSEYIK

SEQ ID NO: 253450 - protein, 9 aa, Dengue virus
MPVTAASAA

SEQ ID NO: 253451 - protein, 9 aa, Dengue virus
ESRKTFVEL

SEQ ID NO: 253452 - protein, 9 aa, Dengue virus
KVAAEGINY

SEQ ID NO: 253453 - protein, 9 aa, Dengue virus
RPKWLDARV

SEQ ID NO: 253454 - protein, 9 aa, Dengue virus
AYRHAVEEL

SEQ ID NO: 253455 - protein, 9 aa, Dengue virus
QLAYVVIGI

SEQ ID NO: 253456 - protein, 9 aa, Dengue virus
NQAVVLMGL

SEQ ID NO: 253457 - protein, 9 aa, Dengue virus
AVVLMGLDK

SEQ ID NO: 253458 - protein, 9 aa, Dengue virus
LLLMRTSWA

SEQ ID NO: 253459 - protein, 9 aa, Dengue virus
LLMRTSWAL

SEQ ID NO: 253460 - protein, 9 aa, Dengue virus
AGLAFSIMK

SEQ ID NO: 253461 - protein, 9 aa, Dengue virus
STYGWNLVK

SEQ ID NO: 253462 - protein, 9 aa, Dengue virus
KLHSGKDVF

SEQ ID NO: 253463 - protein, 9 aa, Dengue virus
VLNPYMPAV

SEQ ID NO: 253464 - protein, 9 aa, Dengue virus
TTSKMLLNR

SEQ ID NO: 253465 - protein, 9 aa, Dengue virus
TVMDIISRR

SEQ ID NO: 253466 - protein, 9 aa, Dengue virus
KSYAQMWTL

SEQ ID NO: 253467 - protein, 9 aa, Dengue virus
YAQMWALMY

SEQ ID NO: 253468 - protein, 9 aa, Dengue virus
AQMWALMYF

SEQ ID NO: 253469 - protein, 9 aa, Dengue virus
LVKRFSSGL

SEQ ID NO: 253470 - protein, 9 aa, Dengue virus
KLFMAFVAF

SEQ ID NO: 253471 - protein, 9 aa, Dengue virus
PLNEAVMAV

SEQ ID NO: 253472 - protein, 9 aa, Dengue virus
SSADLSLER

SEQ ID NO: 253473 - protein, 9 aa, Dengue virus
KTFDTEYTK

SEQ ID NO: 253474 - protein, 9 aa, Dengue virus
RVAAEGINY

SEQ ID NO: 253475 - protein, 9 aa, Dengue virus
AYTHALSEL

SEQ ID NO: 253476 - protein, 9 aa, Dengue virus
QLIYVILAI

SEQ ID NO: 253477 - protein, 9 aa, Dengue virus
ATVLMGLGR

SEQ ID NO: 253478 - protein, 9 aa, Dengue virus
LLMRTSWAF

SEQ ID NO: 253479 - protein, 9 aa, Dengue virus
KLYSGKDVF

SEQ ID NO: 253480 - protein, 9 aa, Dengue virus
TISKMLLNR

SEQ ID NO: 253481 - protein, 9 aa, Dengue virus
KAYAQMWAL

SEQ ID NO: 253482 - protein, 15 aa, Dengue virus
LMGLDKGWPLHRMDI

SEQ ID NO: 253483 - protein, 15 aa, Dengue virus
FGKAKGSRAIWYMWL

SEQ ID NO: 253484 - protein, 15 aa, Dengue virus
PGRFWNTTIAVSMAN

SEQ ID NO: 253485 - protein, 15 aa, Dengue virus
HGSYEVKPTGSASSM

SEQ ID NO: 253486 - protein, 15 aa, Dengue virus
WTLYAVATTFITPML

SEQ ID NO: 253487 - protein, 15 aa, Dengue virus
PMPVTASSAAQRRGR

SEQ ID NO: 253488 - protein, 15 aa, Dengue virus
DFVEGLSGATWVDVV

SEQ ID NO: 253489 - protein, 15 aa, Dengue virus
GAMHSALAGATEIQM

SEQ ID NO: 253490 - protein, 15 aa, Dengue virus
EATAKGARRMAILGD

SEQ ID NO: 253491 - protein, 15 aa, Dengue virus
SGSASSMVNGVVKLL

SEQ ID NO: 253492 - protein, 15 aa, Dengue virus
GPERVILAGPIPVTP

SEQ ID NO: 253493 - protein, 15 aa, Dengue virus
RRDKRSVALVPHVGM

SEQ ID NO: 253494 - protein, 15 aa, Dengue virus
CGRGGWSYYMATLKN

SEQ ID NO: 253495 - protein, 15 aa, Dengue virus
GDLPVWLAHKVASEG

SEQ ID NO: 253496 - protein, 15 aa, Dengue virus
TPMLRHTIENTSANL

SEQ ID NO: 253497 - protein, 15 aa, Dengue virus
FQPESPARVASAILN

SEQ ID NO: 253498 - protein, 15 aa, Dengue virus
LDIDLRPASAWTLYA

SEQ ID NO: 253499 - protein, 15 aa, Dengue virus
NGTGNIVASVNTTSR

SEQ ID NO: 253500 - protein, 15 aa, Dengue virus
PHVGMGLETRAQTWM

SEQ ID NO: 253501 - protein, 15 aa, Dengue virus
RGDLPVWLAYKVASE

SEQ ID NO: 253502 - protein, 15 aa, Dengue virus
EMGANFRADRVIDPR

SEQ ID NO: 253503 - protein, 15 aa, Dengue virus
CHATFTTRLLSSTRV

SEQ ID NO: 253504 - protein, 15 aa, Dengue virus
WPLNEAVMAVGVVSI

SEQ ID NO: 253505 - protein, 15 aa, Dengue virus
GSRDFVEGVSGGTWV

SEQ ID NO: 253506 - protein, 15 aa, Dengue virus
NQATVLMGLGRGWPL

SEQ ID NO: 253507 - protein, 15 aa, Dengue virus
KKLKPRWLDARIYAD

SEQ ID NO: 253508 - protein, 15 aa, Dengue virus
VLMGLDKGWPLSKMD

SEQ ID NO: 253509 - protein, 15 aa, Dengue virus
AGPMPVTHSSAAQRR

SEQ ID NO: 253510 - protein, 15 aa, Dengue virus
LPIRYQTPAVKSEHT

SEQ ID NO: 253511 - protein, 15 aa, Dengue virus
DTRTETWMSSEGAWK

SEQ ID NO: 253512 - protein, 15 aa, Dengue virus
GKFWNTTIAVSTANI

SEQ ID NO: 253513 - protein, 15 aa, Dengue virus
SILASALLKNDIPMT

SEQ ID NO: 253514 - protein, 15 aa, Dengue virus
VSQLAKRFSRGMLQG

SEQ ID NO: 253515 - protein, 15 aa, Dengue virus
FTMRLLSPVRVPNYN

SEQ ID NO: 253516 - protein, 15 aa, Dengue virus
PLVAGGLLTVCYVLS

SEQ ID NO: 253517 - protein, 15 aa, Dengue virus
AAIANQAVVLMGLGK

SEQ ID NO: 253518 - protein, 15 aa, Dengue virus
LMKRGDLPVWLAYKV

SEQ ID NO: 253519 - protein, 15 aa, Dengue virus
GYWIESQKNGSWKLA

SEQ ID NO: 253520 - protein, 15 aa, Dengue virus
DLRPASAWTLYAVAT

SEQ ID NO: 253521 - protein, 15 aa, Dengue virus
GEFGKAKGSRAIWYM

SEQ ID NO: 253522 - protein, 15 aa, Dengue virus
GQGPMKMVMAFIAFL

SEQ ID NO: 253523 - protein, 15 aa, Dengue virus
PTVEAGRTLRVLNLV

SEQ ID NO: 253524 - protein, 15 aa, Dengue virus
SIAARGYISTRVGMG

SEQ ID NO: 253525 - protein, 15 aa, Dengue virus
ASSMVNGVVKLLTKP

SEQ ID NO: 253526 - protein, 15 aa, Dengue virus
LGQVMLLVLCAVQLL

SEQ ID NO: 253527 - protein, 15 aa, Dengue virus
DGEERVILAGPMPVT

SEQ ID NO: 253528 - protein, 15 aa, Dengue virus
HAKHQWMTTEDMLKV

SEQ ID NO: 253529 - protein, 15 aa, Dengue virus
VLMGLGRGWPIHRVD

SEQ ID NO: 253530 - protein, 15 aa, Dengue virus
VQVLALEPGKNPKHV

SEQ ID NO: 253531 - protein, 15 aa, Dengue virus
VGNRDFVEGLSGATW

SEQ ID NO: 253532 - protein, 15 aa, Dengue virus
GAWVDLVLEHGGCVT

SEQ ID NO: 253533 - protein, 15 aa, Dengue virus
MVHRQWFFDLPLPWT

SEQ ID NO: 253534 - protein, 15 aa, Dengue virus
VREAIRRGLRTLILA

SEQ ID NO: 253535 - protein, 15 aa, Dengue virus
MGEAAGIFMTATPPG

SEQ ID NO: 253536 - protein, 15 aa, Dengue virus
DHWFSRENSYSGVEG

SEQ ID NO: 253537 - protein, 15 aa, Dengue virus
GKELKCGSGIFVIDN

SEQ ID NO: 253538 - protein, 15 aa, Dengue virus
QPESPARLASAILNA

SEQ ID NO: 253539 - protein, 15 aa, Dengue virus
CASQILLMRTSWAFC

SEQ ID NO: 253540 - protein, 15 aa, Dengue virus
MLKRARNRVSTPQGL

SEQ ID NO: 253541 - protein, 15 aa, Dengue virus
GCYSQVNPLTLTAAV

SEQ ID NO: 253542 - protein, 15 aa, Dengue virus
CRSCTMPPLRFRGED

SEQ ID NO: 253543 - protein, 15 aa, Dengue virus
LMSAAIKDSKAVHAD

SEQ ID NO: 253544 - protein, 15 aa, Dengue virus
MCTLMAMDLGEFCED

SEQ ID NO: 253545 - protein, 15 aa, Dengue virus
SPIRVPNYNLVIMDE

SEQ ID NO: 253546 - protein, 15 aa, Dengue virus
RFSTGLLNGKGPLRM

SEQ ID NO: 253547 - protein, 15 aa, Dengue virus
GWSLRETACLGKSYA

SEQ ID NO: 253548 - protein, 15 aa, Dengue virus
MGCYSQVNPTTLTAS

SEQ ID NO: 253549 - protein, 15 aa, Dengue virus
TTIAVSMANIFRGSY

SEQ ID NO: 253550 - protein, 15 aa, Dengue virus
TGHLKCKVRMEKLRI

SEQ ID NO: 253551 - protein, 15 aa, Dengue virus
SKLMSAAIKDQRAVH

SEQ ID NO: 253552 - protein, 15 aa, Dengue virus
GKTVWFVPSIKSGND

SEQ ID NO: 253553 - protein, 15 aa, Dengue virus
IAGGMLIACYVITGT

SEQ ID NO: 253554 - protein, 15 aa, Dengue virus
CVTTMAKNKPTLDIE

SEQ ID NO: 253555 - protein, 15 aa, Dengue virus
MLLILCTGQLLMMRT

SEQ ID NO: 253556 - protein, 15 aa, Dengue virus
VLMGLGKGWPISKMD

SEQ ID NO: 253557 - protein, 15 aa, Dengue virus
NVSLAAIANQAVVLM

SEQ ID NO: 253558 - protein, 15 aa, Dengue virus
RTETWMSSEGAWKHA

SEQ ID NO: 253559 - protein, 15 aa, Dengue virus
MGLGKGWPLHRMDIG

SEQ ID NO: 253560 - protein, 15 aa, Dengue virus
TVLGSQEGAMHSALT

SEQ ID NO: 253561 - protein, 15 aa, Dengue virus
IQPQWIAASIILEFF

SEQ ID NO: 253562 - protein, 15 aa, Dengue virus
KELKCGSGIFITDNV

SEQ ID NO: 253563 - protein, 15 aa, Dengue virus
MGANFRADRVIDPRR

SEQ ID NO: 253564 - protein, 15 aa, Dengue virus
IFVVDNVHTRTEQYK

SEQ ID NO: 253565 - protein, 15 aa, Dengue virus
HAHWTEAKMLLDNIY

SEQ ID NO: 253566 - protein, 15 aa, Dengue virus
EKKKLKPRWLDARIY

SEQ ID NO: 253567 - protein, 15 aa, Dengue virus
QEGAMHSALAGATEV

SEQ ID NO: 253568 - protein, 15 aa, Dengue virus
EPIPMSTYGWNLVRL

SEQ ID NO: 253569 - protein, 15 aa, Dengue virus
CLGKAYAQMWSLMYF

SEQ ID NO: 253570 - protein, 15 aa, Dengue virus
TIVTPMLRHTIENST

SEQ ID NO: 253571 - protein, 15 aa, Dengue virus
GPSLRTTTVSGKLIH

SEQ ID NO: 253572 - protein, 15 aa, Dengue virus
YEVKATGSASSMING

SEQ ID NO: 253573 - protein, 15 aa, Dengue virus
DCWCNATSTWVMYGT

SEQ ID NO: 253574 - protein, 15 aa, Dengue virus
RMDLGVPLLALGCYS

SEQ ID NO: 253575 - protein, 15 aa, Dengue virus
ALCEVLTLATGPVMT

SEQ ID NO: 253576 - protein, 15 aa, Dengue virus
VASVNTTSRLLLNRF

SEQ ID NO: 253577 - protein, 15 aa, Dengue virus
EEFTRKVRSNAAIGA

SEQ ID NO: 253578 - protein, 15 aa, Dengue virus
TTIAKNKPTLDIELQ

SEQ ID NO: 253579 - protein, 15 aa, Dengue virus
ALLALNDMGKVRKDI

SEQ ID NO: 253580 - protein, 15 aa, Dengue virus
PPTAGILKRWGTIKK

SEQ ID NO: 253581 - protein, 15 aa, Dengue virus
FKKKNLTIMDLHPGA

SEQ ID NO: 253582 - protein, 15 aa, Dengue virus
SSPNPTVEAGRTLRV

SEQ ID NO: 253583 - protein, 15 aa, Dengue virus
PNPTVEAGRTLRVLS

SEQ ID NO: 253584 - protein, 15 aa, Dengue virus
LSSLLRNDVPLAGPL

SEQ ID NO: 253585 - protein, 15 aa, Dengue virus
GGSWVDIVLEHGSCV

SEQ ID NO: 253586 - protein, 15 aa, Dengue virus
DLMCHATFTMRLLSP

SEQ ID NO: 253587 - protein, 15 aa, Dengue virus
NQTWQIEKASLIEVK

SEQ ID NO: 253588 - protein, 15 aa, Dengue virus
KSYAQMWALMYFHRR

SEQ ID NO: 253589 - protein, 15 aa, Dengue virus
IVREAIKRKLRTLVL

SEQ ID NO: 253590 - protein, 15 aa, Dengue virus
LASSLLRNDVPMAGP

SEQ ID NO: 253591 - protein, 15 aa, Dengue virus
ASIAARGYISTRVGM

SEQ ID NO: 253592 - protein, 15 aa, Dengue virus
GAMHTALTGATEIQT

SEQ ID NO: 253593 - protein, 15 aa, Dengue virus
YKEGVFHTMWHVTRG

SEQ ID NO: 253594 - protein, 15 aa, Dengue virus
LSSLLKNDVPLAGPL

SEQ ID NO: 253595 - protein, 15 aa, Dengue virus
EVPFCSHHFHQLIMK

SEQ ID NO: 253596 - protein, 15 aa, Dengue virus
RGDLPVWLAHKVASE

SEQ ID NO: 253597 - protein, 15 aa, Dengue virus
TYGLNTFTNMEAQLI

SEQ ID NO: 253598 - protein, 15 aa, Dengue virus
AYGVLFSGVSWTMKI

SEQ ID NO: 253599 - protein, 15 aa, Dengue virus
PLQWIASAIVLEFFM

SEQ ID NO: 253600 - protein, 15 aa, Dengue virus
ALVPHVGMGLETRAQ

SEQ ID NO: 253601 - protein, 15 aa, Dengue virus
HQWMTTEDMLSVWNR

SEQ ID NO: 253602 - protein, 15 aa, Dengue virus
DSKFEKQLGQVMLLI

SEQ ID NO: 253603 - protein, 15 aa, Dengue virus
IYRIKQKGIFGKTQV

SEQ ID NO: 253604 - protein, 15 aa, Dengue virus
NMCTLMAMDLGEMCE

SEQ ID NO: 253605 - protein, 15 aa, Dengue virus
GVRSTTRLENLLWKQ

SEQ ID NO: 253606 - protein, 15 aa, Dengue virus
ALRGLPIRYQTPAVK

SEQ ID NO: 253607 - protein, 15 aa, Dengue virus
ERLRRMAISGDDCVV

SEQ ID NO: 253608 - protein, 15 aa, Dengue virus
HAKHEWMTTEDMLKV

SEQ ID NO: 253609 - protein, 15 aa, Dengue virus
KCGSGIFVVDNVHTR

SEQ ID NO: 253610 - protein, 15 aa, Dengue virus
GQLLLMRTSWAFCEA

SEQ ID NO: 253611 - protein, 15 aa, Dengue virus
AIIREAIKRKLRTLI

SEQ ID NO: 253612 - protein, 15 aa, Dengue virus
LQWIASAIILEFFMM

SEQ ID NO: 253613 - protein, 15 aa, Dengue virus
NDIAACLRKSGKRVI

SEQ ID NO: 253614 - protein, 15 aa, Dengue virus
REKRSVALAPHVGMG

SEQ ID NO: 253615 - protein, 15 aa, Dengue virus
YVLSGSSADLSLEKA

SEQ ID NO: 253616 - protein, 15 aa, Dengue virus
ACLRKSGKRVIQLSR

SEQ ID NO: 253617 - protein, 15 aa, Dengue virus
EARKTFVELMRRGDL

SEQ ID NO: 253618 - protein, 15 aa, Dengue virus
VLLMRTTWALCEALT

SEQ ID NO: 253619 - protein, 15 aa, Dengue virus
DDVDCWCNATSAWVM

SEQ ID NO: 253620 - protein, 15 aa, Dengue virus
AAEMEEALKGLPIRY

SEQ ID NO: 253621 - protein, 15 aa, Dengue virus
ISLAAIANQATVLMG

SEQ ID NO: 253622 - protein, 15 aa, Dengue virus
VDVVLEHGSCVTTMA

SEQ ID NO: 253623 - protein, 15 aa, Dengue virus
LLALGCYSQVNPLTL

SEQ ID NO: 253624 - protein, 15 aa, Dengue virus
KMFEATARGARRMAI

SEQ ID NO: 253625 - protein, 15 aa, Dengue virus
NGKRVIQLSRKTFDT

SEQ ID NO: 253626 - protein, 15 aa, Dengue virus
TEQYKFQPESPARVA

SEQ ID NO: 253627 - protein, 15 aa, Dengue virus
YAGHLKCKVRMERLR

SEQ ID NO: 253628 - protein, 15 aa, Dengue virus
APTRVVASEMAEALK

SEQ ID NO: 253629 - protein, 15 aa, Dengue virus
WTEQYQFQADSPKRL

SEQ ID NO: 253630 - protein, 15 aa, Dengue virus
TLILAPTRVVASEMA

SEQ ID NO: 253631 - protein, 15 aa, Dengue virus
CEALTLATGPVSTLW

SEQ ID NO: 253632 - protein, 15 aa, Dengue virus
KLGEFGRAKGSRAIW

SEQ ID NO: 253633 - protein, 15 aa, Dengue virus
GVGIHMENVFHTMWH

SEQ ID NO: 253634 - protein, 15 aa, Dengue virus
IPLQWIASAIVLEFF

SEQ ID NO: 253635 - protein, 15 aa, Dengue virus
KKVRTNAAIGAVFVD

SEQ ID NO: 253636 - protein, 15 aa, Dengue virus
NFRADRVIDPRRCLK

SEQ ID NO: 253637 - protein, 15 aa, Dengue virus
TRAQTWMSSEGAWKH

SEQ ID NO: 253638 - protein, 15 aa, Dengue virus
PVWLAYKVAAEGINY

SEQ ID NO: 253639 - protein, 15 aa, Dengue virus
MGLGKGWPIHRMDLG

SEQ ID NO: 253640 - protein, 15 aa, Dengue virus
CGIRSTTRLENVMWK

SEQ ID NO: 253641 - protein, 15 aa, Dengue virus
VTYSLNTFTNMEVQL

SEQ ID NO: 253642 - protein, 15 aa, Dengue virus
DGEFRLRGEQRKTFV

SEQ ID NO: 253643 - protein, 15 aa, Dengue virus
MGLGRGWPIHRVDLG

SEQ ID NO: 253644 - protein, 15 aa, Dengue virus
EFINKVRSNAALGAV

SEQ ID NO: 253645 - protein, 15 aa, Dengue virus
QQLTKRFSLGLLSGR

SEQ ID NO: 253646 - protein, 15 aa, Dengue virus
RSNAALGAIFQEEQG

SEQ ID NO: 253647 - protein, 15 aa, Dengue virus
WSLRETACLGKAYAQ

SEQ ID NO: 253648 - protein, 15 aa, Dengue virus
GRFWNTTIAVSTANI

SEQ ID NO: 253649 - protein, 15 aa, Dengue virus
SLTAIANQAVVLMGL

SEQ ID NO: 253650 - protein, 15 aa, Dengue virus
GAMHSALTGATEVDS

SEQ ID NO: 253651 - protein, 15 aa, Dengue virus
RLCTKAEFCKKVRSN

SEQ ID NO: 253652 - protein, 15 aa, Dengue virus
ATTIITPMLRHTIEN

SEQ ID NO: 253653 - protein, 15 aa, Dengue virus
NMCTLIAMDLGELCE

SEQ ID NO: 253654 - protein, 15 aa, Dengue virus
VAGGLLLAAYVMTGR

SEQ ID NO: 253655 - protein, 15 aa, Dengue virus
NQAAVLMGLGKGWPL

SEQ ID NO: 253656 - protein, 15 aa, Dengue virus
VVLMGLGKGWPIHRM

SEQ ID NO: 253657 - protein, 15 aa, Dengue virus
PASAWTLYAVATTFI

SEQ ID NO: 253658 - protein, 15 aa, Dengue virus
RDFVEGVSGGSWVDL

SEQ ID NO: 253659 - protein, 15 aa, Dengue virus
EPVPMSTYGWNIVKL

SEQ ID NO: 253660 - protein, 15 aa, Dengue virus
TWLVHRQWFLNLPLP

SEQ ID NO: 253661 - protein, 15 aa, Dengue virus
SAAIKDSKAVHADMG

SEQ ID NO: 253662 - protein, 15 aa, Dengue virus
GLVKRFSSELLSGRG

SEQ ID NO: 253663 - protein, 15 aa, Dengue virus
TAYGVLFSGVSWTMK

SEQ ID NO: 253664 - protein, 15 aa, Dengue virus
EMEEALKGLPIRYQT

SEQ ID NO: 253665 - protein, 15 aa, Dengue virus
KPVILPDGPERVILA

SEQ ID NO: 253666 - protein, 15 aa, Dengue virus
NWQEVPFCSHHFHQL

SEQ ID NO: 253667 - protein, 15 aa, Dengue virus
RHTIENSTANVSLAA

SEQ ID NO: 253668 - protein, 15 aa, Dengue virus
VSSVNMISRMLLNRF

SEQ ID NO: 253669 - protein, 15 aa, Dengue virus
SYAQMWTLMYFHRRD

SEQ ID NO: 253670 - protein, 15 aa, Dengue virus
QVVTYGLNTFTNMEV

SEQ ID NO: 253671 - protein, 15 aa, Dengue virus
EGNPGKFWNTTIAVS

SEQ ID NO: 253672 - protein, 15 aa, Dengue virus
GEYRLRGEARKTFVE

SEQ ID NO: 253673 - protein, 15 aa, Dengue virus
LKNDIPMTGPLVAGG

SEQ ID NO: 253674 - protein, 15 aa, Dengue virus
GLYGNGVVTTSGTYV

SEQ ID NO: 253675 - protein, 15 aa, Dengue virus
NFRAERVIDPRRCMK

SEQ ID NO: 253676 - protein, 15 aa, Dengue virus
GWSLKETACLGKSYA

SEQ ID NO: 253677 - protein, 15 aa, Dengue virus
LRVLSIPPTAGVLAR

SEQ ID NO: 253678 - protein, 15 aa, Dengue virus
DGEYRLKGEARKTFV

SEQ ID NO: 253679 - protein, 15 aa, Dengue virus
SEMAEALKGMPIRYQ

SEQ ID NO: 253680 - protein, 15 aa, Dengue virus
TGSASSMINGVVKLL

SEQ ID NO: 253681 - protein, 15 aa, Dengue virus
GSGIFVTNEVHTWTE

SEQ ID NO: 253682 - protein, 15 aa, Dengue virus
TIENTSANLSLTAIA

SEQ ID NO: 253683 - protein, 15 aa, Dengue virus
AKRMAILGETAWDFG

SEQ ID NO: 253684 - protein, 15 aa, Dengue virus
FNMLKRERNRVSTGS

SEQ ID NO: 253685 - protein, 15 aa, Dengue virus
RMAILGDTAWDFGSV

SEQ ID NO: 253686 - protein, 15 aa, Dengue virus
ESTYRGAKRMAILGE

SEQ ID NO: 253687 - protein, 15 aa, Dengue virus
FKLTYQNKVVRVQRP

SEQ ID NO: 253688 - protein, 15 aa, Dengue virus
QRGLLGKTQVGVGIH

SEQ ID NO: 253689 - protein, 15 aa, Dengue virus
MKRGDLPVWLAYRVA

SEQ ID NO: 253690 - protein, 15 aa, Dengue virus
HGSYETKQTGSASSM

SEQ ID NO: 253691 - protein, 15 aa, Dengue virus
GCYSQVNPLTLIAAV

SEQ ID NO: 253692 - protein, 15 aa, Dengue virus
ANVSLAAIANQATVL

SEQ ID NO: 253693 - protein, 15 aa, Dengue virus
LCASQILLMRTSWAF

SEQ ID NO: 253694 - protein, 15 aa, Dengue virus
DELIGRARISQGAGW

SEQ ID NO: 253695 - protein, 15 aa, Dengue virus
VYNMMGKREKKLGEF

SEQ ID NO: 253696 - protein, 15 aa, Dengue virus
GAAYTALFGGVSWMV

SEQ ID NO: 253697 - protein, 15 aa, Dengue virus
VREAIKRGLRTLILA

SEQ ID NO: 253698 - protein, 15 aa, Dengue virus
TWVDVVLEHGGCVTT

SEQ ID NO: 253699 - protein, 15 aa, Dengue virus
WSYYCGGLKNVKEVR

SEQ ID NO: 253700 - protein, 15 aa, Dengue virus
RHTIENTTANISLAA

SEQ ID NO: 253701 - protein, 15 aa, Dengue virus
MGYWIESRLNDTWKI

SEQ ID NO: 253702 - protein, 15 aa, Dengue virus
VRSTTRMENLLWKQV

SEQ ID NO: 253703 - protein, 15 aa, Dengue virus
AGHLKCRLKMDKLEL

SEQ ID NO: 253704 - protein, 15 aa, Dengue virus
GAKRMAILGDTAWDF

SEQ ID NO: 253705 - protein, 15 aa, Dengue virus
LLIACYVITGRSADL

SEQ ID NO: 253706 - protein, 15 aa, Dengue virus
RDKRSVALVPHVGMG

SEQ ID NO: 253707 - protein, 15 aa, Dengue virus
WLVHKQWFLNLPLPW

SEQ ID NO: 253708 - protein, 15 aa, Dengue virus
FCVKVLNPYMPAVIE

SEQ ID NO: 253709 - protein, 15 aa, Dengue virus
RGSAKLRWFVERNMV

SEQ ID NO: 253710 - protein, 15 aa, Dengue virus
SLTAIANQAAILMGL

SEQ ID NO: 253711 - protein, 15 aa, Dengue virus
RPASAWTLYAVATTF

SEQ ID NO: 253712 - protein, 15 aa, Dengue virus
RELKCGSGIFITNNV

SEQ ID NO: 253713 - protein, 15 aa, Dengue virus
VELMKRGDLPVWLAY

SEQ ID NO: 253714 - protein, 15 aa, Dengue virus
LCVGQLLLMRTSWAF

SEQ ID NO: 253715 - protein, 15 aa, Dengue virus
IYRILQRGLLGKTQV

SEQ ID NO: 253716 - protein, 15 aa, Dengue virus
QDVVVLGSQEGAMHS

SEQ ID NO: 253717 - protein, 15 aa, Dengue virus
GGLLLAAYVMTGRSA

SEQ ID NO: 253718 - protein, 15 aa, Dengue virus
LGSQEGAMRTALTGA

SEQ ID NO: 253719 - protein, 15 aa, Dengue virus
KFEKQLGQVMLLILC

SEQ ID NO: 253720 - protein, 15 aa, Dengue virus
TTWALCEALTLATGP

SEQ ID NO: 253721 - protein, 15 aa, Dengue virus
VHADMGYWIESSKNQ

SEQ ID NO: 253722 - protein, 15 aa, Dengue virus
GNIVSSVNMISRMLI

SEQ ID NO: 253723 - protein, 15 aa, Dengue virus
YQGKTVWFVPSIKAG

SEQ ID NO: 253724 - protein, 15 aa, Dengue virus
SVNTTSRLLINRFTM

SEQ ID NO: 253725 - protein, 15 aa, Dengue virus
SGKTRKYLPAIVREA

SEQ ID NO: 253726 - protein, 15 aa, Dengue virus
SRDFVEGVSGGSWVD

SEQ ID NO: 253727 - protein, 15 aa, Dengue virus
DMGYWIESQKNGSWK

SEQ ID NO: 253728 - protein, 15 aa, Dengue virus
FLAIPPTAGILKRWG

SEQ ID NO: 253729 - protein, 15 aa, Dengue virus
EDGIYRIKQKGIFGK

SEQ ID NO: 253730 - protein, 15 aa, Dengue virus
EALKGLPIRYQTPAI

SEQ ID NO: 253731 - protein, 15 aa, Dengue virus
HFHKIFMKDGREIVV

SEQ ID NO: 253732 - protein, 15 aa, Dengue virus
LPSIVREAIKRGLRT

SEQ ID NO: 253733 - protein, 15 aa, Dengue virus
GCGLFGKGSLLTCAK

SEQ ID NO: 253734 - protein, 15 aa, Dengue virus
RTTWSIHATHQWMTT

SEQ ID NO: 253735 - protein, 15 aa, Dengue virus
VMLLVLCAVQLLLMR

SEQ ID NO: 253736 - protein, 15 aa, Dengue virus
MGANFKAGRVIDPRR

SEQ ID NO: 253737 - protein, 15 aa, Dengue virus
RMVLAFITFLRVLSI

SEQ ID NO: 253738 - protein, 15 aa, Dengue virus
QTTAIKAEHTGREIV

SEQ ID NO: 253739 - protein, 15 aa, Dengue virus
GKELKCGSGIFVTDE

SEQ ID NO: 253740 - protein, 15 aa, Dengue virus
DVRKDLISYGGGWKL

SEQ ID NO: 253741 - protein, 15 aa, Dengue virus
YRTWAYHGSYEAPSS

SEQ ID NO: 253742 - protein, 15 aa, Dengue virus
NGVVTRSGTYVSSIA

SEQ ID NO: 253743 - protein, 15 aa, Dengue virus
LEDGAYRIMQRGLFG

SEQ ID NO: 253744 - protein, 15 aa, Dengue virus
QWIASAIILEFFMMV

SEQ ID NO: 253745 - protein, 15 aa, Dengue virus
QWCGSLIGLTSRATW

SEQ ID NO: 253746 - protein, 15 aa, Dengue virus
GSWVDIVLEHGSCVT

SEQ ID NO: 253747 - protein, 15 aa, Dengue virus
TWTEQYKFQADSPSK

SEQ ID NO: 253748 - protein, 15 aa, Dengue virus
AMHTALTGATEIQTS

SEQ ID NO: 253749 - protein, 15 aa, Dengue virus
IENTSANLSLTAIAN

SEQ ID NO: 253750 - protein, 15 aa, Dengue virus
QYQFQADSPKRLASA

SEQ ID NO: 253751 - protein, 15 aa, Dengue virus
GKMFEATARGARRMA

SEQ ID NO: 253752 - protein, 15 aa, Dengue virus
TSRTTWSIHAKHEWM

SEQ ID NO: 253753 - protein, 15 aa, Dengue virus
ASAWTLYAVATTIIT

SEQ ID NO: 253754 - protein, 15 aa, Dengue virus
PLNEGVMAVGLVSLL

SEQ ID NO: 253755 - protein, 15 aa, Dengue virus
KTVWFVPSIKSGNDI

SEQ ID NO: 253756 - protein, 15 aa, Dengue virus
QVMLLVLCVTQVLLM

SEQ ID NO: 253757 - protein, 15 aa, Dengue virus
SALNDTWKMERASFI

SEQ ID NO: 253758 - protein, 15 aa, Dengue virus
QFCVKILNPYMPSVV

SEQ ID NO: 253759 - protein, 15 aa, Dengue virus
PLAGPLIAGGMLIAC

SEQ ID NO: 253760 - protein, 15 aa, Dengue virus
FCESLTLATGPVLTL

SEQ ID NO: 253761 - protein, 15 aa, Dengue virus
IVASVNTTSRLLLNR

SEQ ID NO: 253762 - protein, 15 aa, Dengue virus
FHRRDLRLAANAICS

SEQ ID NO: 253763 - protein, 15 aa, Dengue virus
ARNRVSTPQGLVKRF

SEQ ID NO: 253764 - protein, 15 aa, Dengue virus
KGSRAIWYMWLGARY

SEQ ID NO: 253765 - protein, 15 aa, Dengue virus
PMKMVMAFIAFLRFL

SEQ ID NO: 253766 - protein, 15 aa, Dengue virus
KGLFSGQGPMKLVMA

SEQ ID NO: 253767 - protein, 15 aa, Dengue virus
SYLAGAGLLFSIMKN

SEQ ID NO: 253768 - protein, 15 aa, Dengue virus
RMAILGDTAWDFGSI

SEQ ID NO: 253769 - protein, 15 aa, Dengue virus
MSTYGWNLVRLQSGV

SEQ ID NO: 253770 - protein, 15 aa, Dengue virus
RTTWALCEVITLATG

SEQ ID NO: 253771 - protein, 15 aa, Dengue virus
ETCVYNMMGKREKKL

SEQ ID NO: 253772 - protein, 15 aa, Dengue virus
ELIGRARISQGAGWS

SEQ ID NO: 253773 - protein, 15 aa, Dengue virus
SCVTTIAKSKPTLDI

SEQ ID NO: 253774 - protein, 15 aa, Dengue virus
GPLVAGGLLIACYVI

SEQ ID NO: 253775 - protein, 15 aa, Dengue virus
CGNGIFVADNVHTRT

SEQ ID NO: 253776 - protein, 15 aa, Dengue virus
ESCVYNMMGKREKKL

SEQ ID NO: 253777 - protein, 15 aa, Dengue virus
FRGSYLAGAGLLFSI

SEQ ID NO: 253778 - protein, 15 aa, Dengue virus
DMGYWIESSKNQTWQ

SEQ ID NO: 253779 - protein, 15 aa, Dengue virus
RILQRGLLGKTQVGV

SEQ ID NO: 253780 - protein, 15 aa, Dengue virus
GKFWNTTIAVSMANI

SEQ ID NO: 253781 - protein, 15 aa, Dengue virus
PIRYQTTAIKAEHTG

SEQ ID NO: 253782 - protein, 15 aa, Dengue virus
LMGLGKGWPISKVDI

SEQ ID NO: 253783 - protein, 15 aa, Dengue virus
NTTIAVSTANIFRGS

SEQ ID NO: 253784 - protein, 15 aa, Dengue virus
LMSAAVKDQRAVHAD

SEQ ID NO: 253785 - protein, 15 aa, Dengue virus
SAAVKDQRAVHADMG

SEQ ID NO: 253786 - protein, 15 aa, Dengue virus
VVKLLTKPWDVIPMV

SEQ ID NO: 253787 - protein, 15 aa, Dengue virus
LMGLGKGWPISKMDI

SEQ ID NO: 253788 - protein, 15 aa, Dengue virus
SLIGLSSRATWAQNI

SEQ ID NO: 253789 - protein, 15 aa, Dengue virus
CWCNLTSTWVTYGTC

SEQ ID NO: 253790 - protein, 15 aa, Dengue virus
NYNLVVMDEAHFTDP

SEQ ID NO: 253791 - protein, 15 aa, Dengue virus
WLGARFLEFEALGFM

SEQ ID NO: 253792 - protein, 15 aa, Dengue virus
TDGEERVILAGPIPV

SEQ ID NO: 253793 - protein, 15 aa, Dengue virus
SYAQMWALMYFHRRD

SEQ ID NO: 253794 - protein, 15 aa, Dengue virus
VITLATGPLSTLWEG

SEQ ID NO: 253795 - protein, 15 aa, Dengue virus
RFSSELLSGRGPLKL

SEQ ID NO: 253796 - protein, 15 aa, Dengue virus
IRSATRMENLLWKQI

SEQ ID NO: 253797 - protein, 15 aa, Dengue virus
GEDGCWYGMEIRPIN

SEQ ID NO: 253798 - protein, 15 aa, Dengue virus
LNEGIMAIGIVSILA

SEQ ID NO: 253799 - protein, 15 aa, Dengue virus
CGSGIFITNEVHTWT

SEQ ID NO: 253800 - protein, 15 aa, Dengue virus
LMCHATFTMRLLSPV

SEQ ID NO: 253801 - protein, 15 aa, Dengue virus
NMCTLMAIDLGEMCE

SEQ ID NO: 253802 - protein, 15 aa, Dengue virus
LSPIRVPNYNLVVMD

SEQ ID NO: 253803 - protein, 15 aa, Dengue virus
RVPNYNMVIMDEAHF

SEQ ID NO: 253804 - protein, 15 aa, Dengue virus
QWMTTEDMLTVWNRV

SEQ ID NO: 253805 - protein, 15 aa, Dengue virus
SLETLMLVALLATVT

SEQ ID NO: 253806 - protein, 15 aa, Dengue virus
TTANISLTAIANQAT

SEQ ID NO: 253807 - protein, 15 aa, Dengue virus
AGIMKNPTVDGIVAI

SEQ ID NO: 253808 - protein, 15 aa, Dengue virus
KCESCVYNMMGKREK

SEQ ID NO: 253809 - protein, 15 aa, Dengue virus
RVIQLSRKTFDTEYP

SEQ ID NO: 253810 - protein, 15 aa, Dengue virus
NEGVMAVGLVSLLGS

SEQ ID NO: 253811 - protein, 15 aa, Dengue virus
LQGQGPMKMVMAFIA

SEQ ID NO: 253812 - protein, 15 aa, Dengue virus
QLLMMRTTWALCEVI

SEQ ID NO: 253813 - protein, 15 aa, Dengue virus
AWLVHKQWFFDLPLP

SEQ ID NO: 253814 - protein, 15 aa, Dengue virus
QLGQVMLLVLCAVQL

SEQ ID NO: 253815 - protein, 15 aa, Dengue virus
EYRLRGEARKTFVEL

SEQ ID NO: 253816 - protein, 15 aa, Dengue virus
VVKLLTKPWDVVPMV

SEQ ID NO: 253817 - protein, 15 aa, Dengue virus
RDFVEGVSGGTWVDV

SEQ ID NO: 253818 - protein, 15 aa, Dengue virus
SRTTWSIHAKHEWMT

SEQ ID NO: 253819 - protein, 15 aa, Dengue virus
DYGFGVFTTNIWLKL

SEQ ID NO: 253820 - protein, 15 aa, Dengue virus
REAIRRGLRTLILAP

SEQ ID NO: 253821 - protein, 15 aa, Dengue virus
VASVNTTSRLLINRF

SEQ ID NO: 253822 - protein, 15 aa, Dengue virus
PNYNLIVMDEAHFTD

SEQ ID NO: 253823 - protein, 15 aa, Dengue virus
QDVIVLGSQEGAMRT

SEQ ID NO: 253824 - protein, 15 aa, Dengue virus
HQWMTTEDMLTVWNR

SEQ ID NO: 253825 - protein, 15 aa, Dengue virus
QQGILGKTQVGVGVF

SEQ ID NO: 253826 - protein, 15 aa, Dengue virus
HWFSRENSLSGVEGE

SEQ ID NO: 253827 - protein, 15 aa, Dengue virus
GVCGVRSTTRLENLL

SEQ ID NO: 253828 - protein, 15 aa, Dengue virus
YMATLKNVREVKGLT

SEQ ID NO: 253829 - protein, 15 aa, Dengue virus
LEPSWASVKKDLISY

SEQ ID NO: 253830 - protein, 15 aa, Dengue virus
TFTMRLLSPVRVPNY

SEQ ID NO: 253831 - protein, 15 aa, Dengue virus
CGSGIFVTDNVHTWT

SEQ ID NO: 253832 - protein, 15 aa, Dengue virus
WNTTIAVSTANIFRG

SEQ ID NO: 253833 - protein, 15 aa, Dengue virus
LRFLTIPPTAGILAR

SEQ ID NO: 253834 - protein, 15 aa, Dengue virus
EEALKGMPIRYQTPA

SEQ ID NO: 253835 - protein, 15 aa, Dengue virus
GSGIFVVDNVHTRTE

SEQ ID NO: 253836 - protein, 15 aa, Dengue virus
QYIYMGQPLNNDEDH

SEQ ID NO: 253837 - protein, 15 aa, Dengue virus
TTRLLSSTRVPNYNL

SEQ ID NO: 253838 - protein, 15 aa, Dengue virus
VNGVVKLLTKPWDVI

SEQ ID NO: 253839 - protein, 15 aa, Dengue virus
NGCGLFGKGSLVTCA

SEQ ID NO: 253840 - protein, 15 aa, Dengue virus
KELKCGSGIFVTDEV

SEQ ID NO: 253841 - protein, 15 aa, Dengue virus
DTWKMERASFIEVKN

SEQ ID NO: 253842 - protein, 15 aa, Dengue virus
MLLVLCVTQVLLMRT

SEQ ID NO: 253843 - protein, 15 aa, Dengue virus
VQVIALEPGKNPRAV

SEQ ID NO: 253844 - protein, 15 aa, Dengue virus
RAIWYMWLGARYLEF

SEQ ID NO: 253845 - protein, 15 aa, Dengue virus
ASQILLMRTTWAFCE

SEQ ID NO: 253846 - protein, 15 aa, Dengue virus
DWDYVVTTDISEMGA

SEQ ID NO: 253847 - protein, 15 aa, Dengue virus
VGVVSILASSFLRND

SEQ ID NO: 253848 - protein, 15 aa, Dengue virus
ELPESLETLMLVALL

SEQ ID NO: 253849 - protein, 15 aa, Dengue virus
DHRLMSAAIKDSKAV

SEQ ID NO: 253850 - protein, 15 aa, Dengue virus
LLILCASQILLMRTT

SEQ ID NO: 253851 - protein, 15 aa, Dengue virus
GITVIDLEPVIYDSK

SEQ ID NO: 253852 - protein, 15 aa, Dengue virus
EEALKGLPIRYQTPA

SEQ ID NO: 253853 - protein, 15 aa, Dengue virus
KRRLTIMDLHPGAGK

SEQ ID NO: 253854 - protein, 15 aa, Dengue virus
NGKKVIQLSRKTFDT

SEQ ID NO: 253855 - protein, 15 aa, Dengue virus
ESLETLMLVALIAVL

SEQ ID NO: 253856 - protein, 15 aa, Dengue virus
WLVHRQWFLDLPLPW

SEQ ID NO: 253857 - protein, 15 aa, Dengue virus
REKRSVALVPHVGMG

SEQ ID NO: 253858 - protein, 15 aa, Dengue virus
HRRDLRLAANAICSA

SEQ ID NO: 253859 - protein, 15 aa, Dengue virus
INGVVRLLTKPWDVL

SEQ ID NO: 253860 - protein, 15 aa, Dengue virus
SLAAIANQATVLMGL

SEQ ID NO: 253861 - protein, 15 aa, Dengue virus
CVTQVLLMRTTWALC

SEQ ID NO: 253862 - protein, 15 aa, Dengue virus
GSGIFVTDNVHTWTE

SEQ ID NO: 253863 - protein, 15 aa, Dengue virus
LEDGIYRIKQKGIFG

SEQ ID NO: 253864 - protein, 15 aa, Dengue virus
VTTSGTYVSAIAQTE

SEQ ID NO: 253865 - protein, 15 aa, Dengue virus
TIITPMLRHTIENTS

SEQ ID NO: 253866 - protein, 15 aa, Dengue virus
ERNRVSTGSQLAKRF

SEQ ID NO: 253867 - protein, 15 aa, Dengue virus
MGANFKAERVIDPRR

SEQ ID NO: 253868 - protein, 15 aa, Dengue virus
RVILAGPMPVTAASA

SEQ ID NO: 253869 - protein, 15 aa, Dengue virus
ATTVLTPMLRHSIEN

SEQ ID NO: 253870 - protein, 15 aa, Dengue virus
KTFVELMRRGDLPVW

SEQ ID NO: 253871 - protein, 15 aa, Dengue virus
SSPNPTIEAGRTLRV

SEQ ID NO: 253872 - protein, 15 aa, Dengue virus
RVVLAGPMPVTHSSA

SEQ ID NO: 253873 - protein, 15 aa, Dengue virus
MTTEDMLKVWNRVWI

SEQ ID NO: 253874 - protein, 15 aa, Dengue virus
RDFVEGVSGGTWVDI

SEQ ID NO: 253875 - protein, 15 aa, Dengue virus
AVSMANIFRGSYLAG

SEQ ID NO: 253876 - protein, 15 aa, Dengue virus
PERVILAGPMPVTVA

SEQ ID NO: 253877 - protein, 15 aa, Dengue virus
PMKLVMAFIAFLRFL

SEQ ID NO: 253878 - protein, 15 aa, Dengue virus
GVSGNIVSSVNTISK

SEQ ID NO: 253879 - protein, 15 aa, Dengue virus
GNGVVTRSGAYVSAI

SEQ ID NO: 253880 - protein, 15 aa, Dengue virus
VWFVPSIKAGNDIAA

SEQ ID NO: 253881 - protein, 15 aa, Dengue virus
AEMEEALRGLPIRYQ

SEQ ID NO: 253882 - protein, 15 aa, Dengue virus
LKGLPIRYQTPAIRA

SEQ ID NO: 253883 - protein, 15 aa, Dengue virus
PRWLDARIYADPMAL

SEQ ID NO: 253884 - protein, 15 aa, Dengue virus
PRWLDARVYSDPLAL

SEQ ID NO: 253885 - protein, 15 aa, Dengue virus
WTLYAVATTIITPML

SEQ ID NO: 253886 - protein, 15 aa, Dengue virus
IRSTTRLENLMWKQI

SEQ ID NO: 253887 - protein, 15 aa, Dengue virus
QGILGKTQVGVGVFQ

SEQ ID NO: 253888 - protein, 15 aa, Dengue virus
VDLMCHATFTMRLLS

SEQ ID NO: 253889 - protein, 15 aa, Dengue virus
CTLMAMDLGEMCEDT

SEQ ID NO: 253890 - protein, 15 aa, Dengue virus
LVTFKNAHAKRQDVI

SEQ ID NO: 253891 - protein, 15 aa, Dengue virus
QLMYFHRRDLRLASM

SEQ ID NO: 253892 - protein, 15 aa, Dengue virus
SINMLKRVRNRVSTV

SEQ ID NO: 253893 - protein, 15 aa, Dengue virus
GNGCGLFGKGSLITC

SEQ ID NO: 253894 - protein, 15 aa, Dengue virus
NDVPMAGPLVAGGLL

SEQ ID NO: 253895 - protein, 15 aa, Dengue virus
DEGVYRIKQQGILGK

SEQ ID NO: 253896 - protein, 15 aa, Dengue virus
PKFEKQLGQVMLLVL

SEQ ID NO: 253897 - protein, 15 aa, Dengue virus
GGLLIACYVITGTSA

SEQ ID NO: 253898 - protein, 15 aa, Dengue virus
VTRSGTYVSSIAQTE

SEQ ID NO: 253899 - protein, 15 aa, Dengue virus
TYSLNTFTNMEAQLI

SEQ ID NO: 253900 - protein, 15 aa, Dengue virus
VDLVLEHGGCVTTIA

SEQ ID NO: 253901 - protein, 15 aa, Dengue virus
LFSGQGPMKLVMAFI

SEQ ID NO: 253902 - protein, 15 aa, Dengue virus
NIVSSVNMVSRMLLN

SEQ ID NO: 253903 - protein, 15 aa, Dengue virus
WVDLVLEHGGCVTTM

SEQ ID NO: 253904 - protein, 15 aa, Dengue virus
IITPMLRHTIENTSA

SEQ ID NO: 253905 - protein, 15 aa, Dengue virus
NMEAQLIRQMEGEGV

SEQ ID NO: 253906 - protein, 15 aa, Dengue virus
VPMSTYGWNIVKLHS

SEQ ID NO: 253907 - protein, 15 aa, Dengue virus
IVSSVNMVSRMLLNR

SEQ ID NO: 253908 - protein, 15 aa, Dengue virus
IGVPLLAIGCYSQVN

SEQ ID NO: 253909 - protein, 15 aa, Dengue virus
VSTPQGLVKRFSTGL

SEQ ID NO: 253910 - protein, 15 aa, Dengue virus
AWLVHKQWFLNLPLP

SEQ ID NO: 253911 - protein, 15 aa, Dengue virus
ETLMLVALLATVTGG

SEQ ID NO: 253912 - protein, 15 aa, Dengue virus
CGIRSVTRLENIMWK

SEQ ID NO: 253913 - protein, 15 aa, Dengue virus
AVMAVGVVSILASSF

SEQ ID NO: 253914 - protein, 15 aa, Dengue virus
PLNEGIMAIGIVSIL

SEQ ID NO: 253915 - protein, 15 aa, Dengue virus
KGWPIHKMDLGVPLL

SEQ ID NO: 253916 - protein, 15 aa, Dengue virus
IFITNNVHTWTEQYK

SEQ ID NO: 253917 - protein, 15 aa, Dengue virus
QADSPKRLATAIAGA

SEQ ID NO: 253918 - protein, 15 aa, Dengue virus
EVITLATGPLSTLWE

SEQ ID NO: 253919 - protein, 15 aa, Dengue virus
LEFFLIVLLIPEPDR

SEQ ID NO: 253920 - protein, 15 aa, Dengue virus
DVKKDLISYGGGWRF

SEQ ID NO: 253921 - protein, 15 aa, Dengue virus
CEVLTLATGPVMTLW

SEQ ID NO: 253922 - protein, 15 aa, Dengue virus
EKKKLKPRWLDARVY

SEQ ID NO: 253923 - protein, 15 aa, Dengue virus
DVVLEHGSCVTTMAK

SEQ ID NO: 253924 - protein, 15 aa, Dengue virus
MRLLSPVRVPNYNLI

SEQ ID NO: 253925 - protein, 15 aa, Dengue virus
EQRKTFVDLMRRGDL

SEQ ID NO: 253926 - protein, 15 aa, Dengue virus
VPFCSHHFHELVMKD

SEQ ID NO: 253927 - protein, 15 aa, Dengue virus
CYVITGTSADLELEK

SEQ ID NO: 253928 - protein, 15 aa, Dengue virus
RGGWSYYCAGLKKVT

SEQ ID NO: 253929 - protein, 15 aa, Dengue virus
FRKRRLTIMDLHPGA

SEQ ID NO: 253930 - protein, 15 aa, Dengue virus
FEKQLGQVMLLVLCA

SEQ ID NO: 253931 - protein, 15 aa, Dengue virus
TVLMGLGKGWPISKM

SEQ ID NO: 253932 - protein, 15 aa, Dengue virus
HQWMTTEDMLKVWNR

SEQ ID NO: 253933 - protein, 15 aa, Dengue virus
GMLIACYVITGTSAD

SEQ ID NO: 253934 - protein, 15 aa, Dengue virus
DAKFEKQLGQIMLLI

SEQ ID NO: 253935 - protein, 15 aa, Dengue virus
VQLLLMRTSWALCEV

SEQ ID NO: 253936 - protein, 15 aa, Dengue virus
CGRGGWSYYCAGLKK

SEQ ID NO: 253937 - protein, 15 aa, Dengue virus
DIDLRPASAWTLYAV

SEQ ID NO: 253938 - protein, 15 aa, Dengue virus
LGEFGRAKGSRAIWY

SEQ ID NO: 253939 - protein, 15 aa, Dengue virus
MLRHTIENTSANLSL

SEQ ID NO: 253940 - protein, 15 aa, Dengue virus
CGVRSTTRLENLLWK

SEQ ID NO: 253941 - protein, 15 aa, Dengue virus
DLPVWLAYKVAAEGI

SEQ ID NO: 253942 - protein, 15 aa, Dengue virus
VSLAAIANQATVLMG

SEQ ID NO: 253943 - protein, 15 aa, Dengue virus
GLPIRYQTTAVKSEH

SEQ ID NO: 253944 - protein, 15 aa, Dengue virus
LIAGGMLIACYVITG

SEQ ID NO: 253945 - protein, 15 aa, Dengue virus
HRGPSLRTTTASGKL

SEQ ID NO: 253946 - protein, 15 aa, Dengue virus
KGESRKTFVELMKRG

SEQ ID NO: 253947 - protein, 15 aa, Dengue virus
IETLMLLTLLATVTG

SEQ ID NO: 253948 - protein, 15 aa, Dengue virus
MAVGLVSILLSSLLR

SEQ ID NO: 253949 - protein, 15 aa, Dengue virus
LTLATGPITTLWEGN

SEQ ID NO: 253950 - protein, 15 aa, Dengue virus
QKNGSWKLARASFIE

SEQ ID NO: 253951 - protein, 15 aa, Dengue virus
GSASSMVNGVVRLLT

SEQ ID NO: 253952 - protein, 15 aa, Dengue virus
SGNIVSSVNTISKML

SEQ ID NO: 253953 - protein, 15 aa, Dengue virus
AVVLMGLGKGWPIHR

SEQ ID NO: 253954 - protein, 15 aa, Dengue virus
GIFITNNVHTWTEQY

SEQ ID NO: 253955 - protein, 15 aa, Dengue virus
VTTMAKNKPTLDFEL

SEQ ID NO: 253956 - protein, 15 aa, Dengue virus
AVATTVLTPMLRHSI

SEQ ID NO: 253957 - protein, 15 aa, Dengue virus
KKLRPRWLDARVYSD

SEQ ID NO: 253958 - protein, 15 aa, Dengue virus
TFTNMEVQLIRQMEA

SEQ ID NO: 253959 - protein, 15 aa, Dengue virus
GLPIRYQTTAIKAEH

SEQ ID NO: 253960 - protein, 15 aa, Dengue virus
GVYKEGVFHTMWHVT

SEQ ID NO: 253961 - protein, 15 aa, Dengue virus
CDSKLMSAAVKDQRA

SEQ ID NO: 253962 - protein, 15 aa, Dengue virus
LMVLLVPEPEKQRTP

SEQ ID NO: 253963 - protein, 15 aa, Dengue virus
NLIRCPLSRNSTHEM

SEQ ID NO: 253964 - protein, 15 aa, Dengue virus
VATTIVTPMLRHTIE

SEQ ID NO: 253965 - protein, 15 aa, Dengue virus
KRGSSIGKMLEATAK

SEQ ID NO: 253966 - protein, 15 aa, Dengue virus
HATFTTRLLSSTRVP

SEQ ID NO: 253967 - protein, 15 aa, Dengue virus
LLNGKGPLRMVLAFI

SEQ ID NO: 253968 - protein, 15 aa, Dengue virus
PMVTQLAMTDTTPFG

SEQ ID NO: 253969 - protein, 15 aa, Dengue virus
VVTYSLNTFTNMEAQ

SEQ ID NO: 253970 - protein, 15 aa, Dengue virus
PMPVTHASAAQRRGR

SEQ ID NO: 253971 - protein, 15 aa, Dengue virus
SNRDFVEGVSGGAWV

SEQ ID NO: 253972 - protein, 15 aa, Dengue virus
VLAFITFLRVLSIPP

SEQ ID NO: 253973 - protein, 15 aa, Dengue virus
EMEEALRGLPIRYQT

SEQ ID NO: 253974 - protein, 15 aa, Dengue virus
GNRDFVEGVSGGAWV

SEQ ID NO: 253975 - protein, 15 aa, Dengue virus
LCASQILLMRTTWAF

SEQ ID NO: 253976 - protein, 15 aa, Dengue virus
TSWAFCEVLTLATGP

SEQ ID NO: 253977 - protein, 15 aa, Dengue virus
VWNRVWIQDNPNMID

SEQ ID NO: 253978 - protein, 15 aa, Dengue virus
TACLGKAYAQMWSLM

SEQ ID NO: 253979 - protein, 15 aa, Dengue virus
CWCNATSTWVMYGTC

SEQ ID NO: 253980 - protein, 15 aa, Dengue virus
RGLLGKTQVGVGIHI

SEQ ID NO: 253981 - protein, 15 aa, Dengue virus
WPIHRVDLGVPLLAL

SEQ ID NO: 253982 - protein, 15 aa, Dengue virus
AKKQEVVVLGSQEGA

SEQ ID NO: 253983 - protein, 15 aa, Dengue virus
EDQWCGSLIGLTSRA

SEQ ID NO: 253984 - protein, 15 aa, Dengue virus
EDGCWYGMEIRPINE

SEQ ID NO: 253985 - protein, 15 aa, Dengue virus
PFCSHHFHELVMKDG

SEQ ID NO: 253986 - protein, 15 aa, Dengue virus
SLRTTTVTGKIITEW

SEQ ID NO: 253987 - protein, 15 aa, Dengue virus
GVCGIRSVTRLENIM

SEQ ID NO: 253988 - protein, 15 aa, Dengue virus
MCTLIAMDLGELCED

SEQ ID NO: 253989 - protein, 15 aa, Dengue virus
LLMRTSWALCEVLTL

SEQ ID NO: 253990 - protein, 15 aa, Dengue virus
APHVGMGLETRAQTW

SEQ ID NO: 253991 - protein, 15 aa, Dengue virus
PERVILAGPMPVTAA

SEQ ID NO: 253992 - protein, 15 aa, Dengue virus
MINGVVKLLTKPWDV

SEQ ID NO: 253993 - protein, 15 aa, Dengue virus
EQRKTFVDLMKRGDL

SEQ ID NO: 253994 - protein, 15 aa, Dengue virus
GSWKLARASFIEVKS

SEQ ID NO: 253995 - protein, 15 aa, Dengue virus
LKNDVPLAGPMVAGG

SEQ ID NO: 253996 - protein, 15 aa, Dengue virus
CCRSCTLPPLRYLGE

SEQ ID NO: 253997 - protein, 15 aa, Dengue virus
EFIKKVRTNAAIGAV

SEQ ID NO: 253998 - protein, 15 aa, Dengue virus
DTRAQTWMSSEGAWK

SEQ ID NO: 253999 - protein, 15 aa, Dengue virus
GIFVVDNVHTWTEQY

SEQ ID NO: 254000 - protein, 15 aa, Dengue virus
STYGWNIVKLHSGKD

SEQ ID NO: 254001 - protein, 15 aa, Dengue virus
QYKFQPESPARVASA

SEQ ID NO: 254002 - protein, 15 aa, Dengue virus
RELKCGSGIFITDNV

SEQ ID NO: 254003 - protein, 15 aa, Dengue virus
KIVGLYGNGVVTRSG

SEQ ID NO: 254004 - protein, 15 aa, Dengue virus
SIGKMFEATARGARR

SEQ ID NO: 254005 - protein, 15 aa, Dengue virus
SKFEKQLGQVMLLVL

SEQ ID NO: 254006 - protein, 15 aa, Dengue virus
QGQGPMKMVMAFIAF

SEQ ID NO: 254007 - protein, 15 aa, Dengue virus
EHRRDKRSVALVPHV

SEQ ID NO: 254008 - protein, 15 aa, Dengue virus
SLRTTTVSGKLIHEW

SEQ ID NO: 254009 - protein, 15 aa, Dengue virus
LSEGVYRIKQRGILG

SEQ ID NO: 254010 - protein, 15 aa, Dengue virus
SRTTWSIHAHHQWMT

SEQ ID NO: 254011 - protein, 15 aa, Dengue virus
LNEGVMAVGLVSLLG

SEQ ID NO: 254012 - protein, 15 aa, Dengue virus
TWSIHATHEWMTTED

SEQ ID NO: 254013 - protein, 15 aa, Dengue virus
RETACLGKSYAQMWQ

SEQ ID NO: 254014 - protein, 15 aa, Dengue virus
RGAKRMAILGETAWD

SEQ ID NO: 254015 - protein, 15 aa, Dengue virus
KGEARKTFVELMKRG

SEQ ID NO: 254016 - protein, 15 aa, Dengue virus
SLLKNDVPLAGPLIA

SEQ ID NO: 254017 - protein, 15 aa, Dengue virus
KAEFCKKVRSNAAMG

SEQ ID NO: 254018 - protein, 15 aa, Dengue virus
YAVATTIITPMLRHT

SEQ ID NO: 254019 - protein, 15 aa, Dengue virus
RGSAKIRWIVERGMV

SEQ ID NO: 254020 - protein, 15 aa, Dengue virus
RLLSSTRVPNYNLIV

SEQ ID NO: 254021 - protein, 15 aa, Dengue virus
CWYGMEIRPVSEKEE

SEQ ID NO: 254022 - protein, 15 aa, Dengue virus
SLRETACLGKAYAQM

SEQ ID NO: 254023 - protein, 15 aa, Dengue virus
FSGQGPMKLVMAFIA

SEQ ID NO: 254024 - protein, 15 aa, Dengue virus
LNGKGPLRMVLAFIT

SEQ ID NO: 254025 - protein, 15 aa, Dengue virus
RVRNRVSTVQQLTKR

SEQ ID NO: 254026 - protein, 15 aa, Dengue virus
TDGPERVILAGPMPV

SEQ ID NO: 254027 - protein, 15 aa, Dengue virus
RKSGKKVIQLSRKTF

SEQ ID NO: 254028 - protein, 15 aa, Dengue virus
GSLIGLTSRATWAKN

SEQ ID NO: 254029 - protein, 15 aa, Dengue virus
EKKKLRPKWLDARTY

SEQ ID NO: 254030 - protein, 15 aa, Dengue virus
IVSSVNTISKMLLNR

SEQ ID NO: 254031 - protein, 15 aa, Dengue virus
GRGPLKLFMAFVAFL

SEQ ID NO: 254032 - protein, 15 aa, Dengue virus
NKCTLMAIDLGEMCD

SEQ ID NO: 254033 - protein, 15 aa, Dengue virus
GNRDFVEGLSGATWV

SEQ ID NO: 254034 - protein, 15 aa, Dengue virus
TTVLTPMLRHSIENS

SEQ ID NO: 254035 - protein, 15 aa, Dengue virus
ENSWSGVEGEGLHRL

SEQ ID NO: 254036 - protein, 15 aa, Dengue virus
VMLLVLCVTQVLLMR

SEQ ID NO: 254037 - protein, 15 aa, Dengue virus
AVNMTSRMLLNRFTM

SEQ ID NO: 254038 - protein, 15 aa, Dengue virus
VCYVLSGSSADLSLE

SEQ ID NO: 254039 - protein, 15 aa, Dengue virus
RGSYLAGAGLAFSLI

SEQ ID NO: 254040 - protein, 15 aa, Dengue virus
ILTLWEGNPGRFWNT

SEQ ID NO: 254041 - protein, 15 aa, Dengue virus
HSIENSSVNVSLTAI

SEQ ID NO: 254042 - protein, 15 aa, Dengue virus
GRGGWSYYCAGLKKV

SEQ ID NO: 254043 - protein, 15 aa, Dengue virus
CLGKSYAQMWQLMYF

SEQ ID NO: 254044 - protein, 15 aa, Dengue virus
AGIMKNPTVDGITVI

SEQ ID NO: 254045 - protein, 15 aa, Dengue virus
KKNLTIMDLHPGAGK

SEQ ID NO: 254046 - protein, 15 aa, Dengue virus
TSRTTWSIHATHQWM

SEQ ID NO: 254047 - protein, 15 aa, Dengue virus
SRTTWSIHAKHQWMT

SEQ ID NO: 254048 - protein, 15 aa, Dengue virus
LAKRFSKGLFSGQGP

SEQ ID NO: 254049 - protein, 15 aa, Dengue virus
DGIYRIKQKGIFGKT

SEQ ID NO: 254050 - protein, 15 aa, Dengue virus
CVTTMAKNKPTLDFE

SEQ ID NO: 254051 - protein, 15 aa, Dengue virus
VRSNAAIGAVFTDEN

SEQ ID NO: 254052 - protein, 15 aa, Dengue virus
RTTWAFCEVLTLATG

SEQ ID NO: 254053 - protein, 15 aa, Dengue virus
HKIFMKDGREIVVPC

SEQ ID NO: 254054 - protein, 15 aa, Dengue virus
LSPVRVPNYNMVIMD

SEQ ID NO: 254055 - protein, 15 aa, Dengue virus
LRGLPIRYQTPAVKS

SEQ ID NO: 254056 - protein, 15 aa, Dengue virus
CESLTLATGPVLTLW

SEQ ID NO: 254057 - protein, 15 aa, Dengue virus
LMMRTTWALCEVITL

SEQ ID NO: 254058 - protein, 15 aa, Dengue virus
VMAFIAFLRFLTIPP

SEQ ID NO: 254059 - protein, 15 aa, Dengue virus
KETACLGKSYAQMWQ

SEQ ID NO: 254060 - protein, 15 aa, Dengue virus
KRRLTIMDLHPGSGK

SEQ ID NO: 254061 - protein, 15 aa, Dengue virus
LTAIANQAAVLMGLD

SEQ ID NO: 254062 - protein, 15 aa, Dengue virus
ILPSIVREAIKRGLR

SEQ ID NO: 254063 - protein, 15 aa, Dengue virus
QTWQIEKASLIEVKT

SEQ ID NO: 254064 - protein, 15 aa, Dengue virus
LNEGIMAVGMVSILA

SEQ ID NO: 254065 - protein, 15 aa, Dengue virus
LGARFLEFEALGFMN

SEQ ID NO: 254066 - protein, 15 aa, Dengue virus
LLKNDIPMTGPLVAG

SEQ ID NO: 254067 - protein, 15 aa, Dengue virus
LLVLCAVQLLLMRTS

SEQ ID NO: 254068 - protein, 15 aa, Dengue virus
VSGVSGNIVSSVNTI

SEQ ID NO: 254069 - protein, 15 aa, Dengue virus
SVALVPHVGMGLETR

SEQ ID NO: 254070 - protein, 15 aa, Dengue virus
EGVCGIRSVTRLENI

SEQ ID NO: 254071 - protein, 15 aa, Dengue virus
VVLGSQEGAMHSALA

SEQ ID NO: 254072 - protein, 15 aa, Dengue virus
QPQWIASAIILEFFL

SEQ ID NO: 254073 - protein, 15 aa, Dengue virus
WTEQYKFQPESPARL

SEQ ID NO: 254074 - protein, 15 aa, Dengue virus
GCYSQVNPTTLTASL

SEQ ID NO: 254075 - protein, 15 aa, Dengue virus
KELKCGSGIFVIDNV

SEQ ID NO: 254076 - protein, 15 aa, Dengue virus
AIVREAIKRKLRTLV

SEQ ID NO: 254077 - protein, 15 aa, Dengue virus
GSASSMINGVVKLLT

SEQ ID NO: 254078 - protein, 15 aa, Dengue virus
RTPQDNQLAYVVIGL

SEQ ID NO: 254079 - protein, 15 aa, Dengue virus
LMVLLIPEPEKQRTP

SEQ ID NO: 254080 - protein, 15 aa, Dengue virus
LTIMDLHPGAGKTKR

SEQ ID NO: 254081 - protein, 15 aa, Dengue virus
CGGLKNVKEVRGFTK

SEQ ID NO: 254082 - protein, 15 aa, Dengue virus
FRKRRLTIMDLHPGS

SEQ ID NO: 254083 - protein, 15 aa, Dengue virus
QGAGWSLRETACLGK

SEQ ID NO: 254084 - protein, 15 aa, Dengue virus
MRHTIENTTANISLA

SEQ ID NO: 254085 - protein, 15 aa, Dengue virus
DGEERVVLAGPMPVT

SEQ ID NO: 254086 - protein, 15 aa, Dengue virus
NGVVTRSGAYVSAIA

SEQ ID NO: 254087 - protein, 15 aa, Dengue virus
MLRHSIENSSVNVSL

SEQ ID NO: 254088 - protein, 15 aa, Dengue virus
LDNIYTPEGIIPTLF

SEQ ID NO: 254089 - protein, 15 aa, Dengue virus
VDIGVPLLAMGCYSQ

SEQ ID NO: 254090 - protein, 15 aa, Dengue virus
YAQMWALMYFHRRDL

SEQ ID NO: 254091 - protein, 15 aa, Dengue virus
PMLRHTIENTSANLS

SEQ ID NO: 254092 - protein, 15 aa, Dengue virus
SVNTTSRLLLNRFTM

SEQ ID NO: 254093 - protein, 15 aa, Dengue virus
WALCEALTLATGPIT

SEQ ID NO: 254094 - protein, 15 aa, Dengue virus
MLQGQGPMKMVMAFI

SEQ ID NO: 254095 - protein, 15 aa, Dengue virus
AQMWQLMYFHRRDLR

SEQ ID NO: 254096 - protein, 15 aa, Dengue virus
HGSCVTTIAKSKPTL

SEQ ID NO: 254097 - protein, 15 aa, Dengue virus
CGTGNIVSAVNMTSK

SEQ ID NO: 254098 - protein, 15 aa, Dengue virus
LAFITFLRVLSIPPT

SEQ ID NO: 254099 - protein, 15 aa, Dengue virus
AIPPTAGILKRWGQL

SEQ ID NO: 254100 - protein, 15 aa, Dengue virus
GLFSGQGPMKLVMAF

SEQ ID NO: 254101 - protein, 15 aa, Dengue virus
MVTFKVPHAKKQDVV

SEQ ID NO: 254102 - protein, 15 aa, Dengue virus
SWPLNEGIMAVGMVS

SEQ ID NO: 254103 - protein, 15 aa, Dengue virus
LRKSGKRVIQLSRKT

SEQ ID NO: 254104 - protein, 15 aa, Dengue virus
RGWPIHRVDLGVPLL

SEQ ID NO: 254105 - protein, 15 aa, Dengue virus
HGSYEVKATGSASSM

SEQ ID NO: 254106 - protein, 15 aa, Dengue virus
QILLMRTSWAFCESL

SEQ ID NO: 254107 - protein, 15 aa, Dengue virus
GSPGRFWNTTIAVST

SEQ ID NO: 254108 - protein, 15 aa, Dengue virus
GEARKTFVELMKRGD

SEQ ID NO: 254109 - protein, 15 aa, Dengue virus
VTTIAKNKPTLDIEL

SEQ ID NO: 254110 - protein, 15 aa, Dengue virus
LSSTRVPNYNLIVMD

SEQ ID NO: 254111 - protein, 15 aa, Dengue virus
RTTWALCEALTLATG

SEQ ID NO: 254112 - protein, 15 aa, Dengue virus
LHRMDIGVPLLAIGC

SEQ ID NO: 254113 - protein, 15 aa, Dengue virus
VYRIKQRGILGRSQV

SEQ ID NO: 254114 - protein, 15 aa, Dengue virus
KETACLGKSYAQMWA

SEQ ID NO: 254115 - protein, 15 aa, Dengue virus
CLGKAYAQMWALMYF

SEQ ID NO: 254116 - protein, 15 aa, Dengue virus
QLAKRFSKGLFSGQG

SEQ ID NO: 254117 - protein, 15 aa, Dengue virus
NTFTNMEAQLIRQME

SEQ ID NO: 254118 - protein, 15 aa, Dengue virus
TTMAKNKPTLDIELQ

SEQ ID NO: 254119 - protein, 15 aa, Dengue virus
PTRVVASEMAEALKG

SEQ ID NO: 254120 - protein, 15 aa, Dengue virus
VRSNAALGAVFTDEN

SEQ ID NO: 254121 - protein, 15 aa, Dengue virus
GEYRLKGEARKTFVE

SEQ ID NO: 254122 - protein, 15 aa, Dengue virus
SKNQTWQIEKASLIE

SEQ ID NO: 254123 - protein, 15 aa, Dengue virus
ENSSVNVSLTAIANQ

SEQ ID NO: 254124 - protein, 15 aa, Dengue virus
SYLAGAGLAFSLIKN

SEQ ID NO: 254125 - protein, 15 aa, Dengue virus
VREALKRRLRTLILA

SEQ ID NO: 254126 - protein, 15 aa, Dengue virus
RGLRTLILAPTRVVA

SEQ ID NO: 254127 - protein, 15 aa, Dengue virus
ASSLLRNDVPMAGPL

SEQ ID NO: 254128 - protein, 15 aa, Dengue virus
TTANISLAAIANQAT

SEQ ID NO: 254129 - protein, 15 aa, Dengue virus
SRLNDTWKIEKASFI

SEQ ID NO: 254130 - protein, 15 aa, Dengue virus
ADMGYWIESALNDTW

SEQ ID NO: 254131 - protein, 15 aa, Dengue virus
KRKLRTLILAPTRVV

SEQ ID NO: 254132 - protein, 15 aa, Dengue virus
GGLLIACYVITGRSA

SEQ ID NO: 254133 - protein, 15 aa, Dengue virus
RHTIENTSANLSLAA

SEQ ID NO: 254134 - protein, 15 aa, Dengue virus
RIYADPMALKDFKEF

SEQ ID NO: 254135 - protein, 15 aa, Dengue virus
IDGEYRLRGEARKTF

SEQ ID NO: 254136 - protein, 15 aa, Dengue virus
YYCAGLKKVTEVKGY

SEQ ID NO: 254137 - protein, 15 aa, Dengue virus
VTKSGTYVSAITQAE

SEQ ID NO: 254138 - protein, 15 aa, Dengue virus
DTRAQTWMSSEGAWR

SEQ ID NO: 254139 - protein, 15 aa, Dengue virus
EERVILAGPMPVTHA

SEQ ID NO: 254140 - protein, 15 aa, Dengue virus
TFVELMRRGDLPVWL

SEQ ID NO: 254141 - protein, 15 aa, Dengue virus
LTLATGPVLTLWEGN

SEQ ID NO: 254142 - protein, 15 aa, Dengue virus
MGLGRGWPLHRVDLG

SEQ ID NO: 254143 - protein, 15 aa, Dengue virus
GCGLFGKGGIVTCAM

SEQ ID NO: 254144 - protein, 15 aa, Dengue virus
VSTVSQLAKRFSRGM

SEQ ID NO: 254145 - protein, 15 aa, Dengue virus
LAAIANQAAILMGLG

SEQ ID NO: 254146 - protein, 15 aa, Dengue virus
GTAYGVLFSGVSWTM

SEQ ID NO: 254147 - protein, 15 aa, Dengue virus
ANVSLAAIANQAVVL

SEQ ID NO: 254148 - protein, 15 aa, Dengue virus
IGAIALDFKPGTSGS

SEQ ID NO: 254149 - protein, 15 aa, Dengue virus
ENVFHTMWHVTRGAV

SEQ ID NO: 254150 - protein, 15 aa, Dengue virus
FVELMRRGDLPVWLA

SEQ ID NO: 254151 - protein, 15 aa, Dengue virus
STGSQLAKRFSKGLF

SEQ ID NO: 254152 - protein, 15 aa, Dengue virus
YQFQADSPKRLASAI

SEQ ID NO: 254153 - protein, 15 aa, Dengue virus
IMTIDLDPVVYDSKF

SEQ ID NO: 254154 - protein, 15 aa, Dengue virus
RVPNYNLVIMDEAHF

SEQ ID NO: 254155 - protein, 15 aa, Dengue virus
NEAIMAVGLVSILLS

SEQ ID NO: 254156 - protein, 15 aa, Dengue virus
GVVKLLTKPWDVLPM

SEQ ID NO: 254157 - protein, 15 aa, Dengue virus
ELPDTIETLMLLTLI

SEQ ID NO: 254158 - protein, 15 aa, Dengue virus
WNRVWIQDNPNMIDK

SEQ ID NO: 254159 - protein, 15 aa, Dengue virus
ETWKLEKASFIEVKT

SEQ ID NO: 254160 - protein, 15 aa, Dengue virus
GWPISKVDIGVPLLA

SEQ ID NO: 254161 - protein, 15 aa, Dengue virus
RNDVPLAGPLIAGGM

SEQ ID NO: 254162 - protein, 15 aa, Dengue virus
KGSRAIWYMWLGARF

SEQ ID NO: 254163 - protein, 15 aa, Dengue virus
PLAGPMVAGGLLLAA

SEQ ID NO: 254164 - protein, 15 aa, Dengue virus
GSYEVKATGSASSMI

SEQ ID NO: 254165 - protein, 15 aa, Dengue virus
TLVTFKNPHAKRQDV

SEQ ID NO: 254166 - protein, 15 aa, Dengue virus
EALKRRLRTLILAPT

SEQ ID NO: 254167 - protein, 15 aa, Dengue virus
EKRSVALTPHSGTGL

SEQ ID NO: 254168 - protein, 15 aa, Dengue virus
ANFKAGRVIDPRRCL

SEQ ID NO: 254169 - protein, 15 aa, Dengue virus
EFRLRGEQRKTFVDL

SEQ ID NO: 254170 - protein, 15 aa, Dengue virus
GSSLLKNDVPLAGPM

SEQ ID NO: 254171 - protein, 15 aa, Dengue virus
FLRFLTIPPTAGILA

SEQ ID NO: 254172 - protein, 15 aa, Dengue virus
VVVLGSQEGAMHTAL

SEQ ID NO: 254173 - protein, 15 aa, Dengue virus
PNYNLIIMDEAHFTD

SEQ ID NO: 254174 - protein, 15 aa, Dengue virus
TEDMLSVWNRVWIRD

SEQ ID NO: 254175 - protein, 15 aa, Dengue virus
ANDWDFVVTTDISEM

SEQ ID NO: 254176 - protein, 15 aa, Dengue virus
EKKLGEFGRAKGSRA

SEQ ID NO: 254177 - protein, 15 aa, Dengue virus
GKAKGSRAIWYMWLG

SEQ ID NO: 254178 - protein, 15 aa, Dengue virus
KVIQLSRKTFDTEYQ

SEQ ID NO: 254179 - protein, 15 aa, Dengue virus
GWSYYMATLKNVREV

SEQ ID NO: 254180 - protein, 15 aa, Dengue virus
KGLPIRYQTPAIRAE

SEQ ID NO: 254181 - protein, 15 aa, Dengue virus
AAIANQATVLMGLGK

SEQ ID NO: 254182 - protein, 15 aa, Dengue virus
WLDARIYSDPLALRE

SEQ ID NO: 254183 - protein, 15 aa, Dengue virus
VVYDSKFEKQLGQVM

SEQ ID NO: 254184 - protein, 15 aa, Dengue virus
VGLVSILLSSLLKND

SEQ ID NO: 254185 - protein, 15 aa, Dengue virus
AIMAVGLVSILLSSL

SEQ ID NO: 254186 - protein, 15 aa, Dengue virus
MGEDGCWYGMEIRPI

SEQ ID NO: 254187 - protein, 15 aa, Dengue virus
KKLGEFGRAKGSRAI

SEQ ID NO: 254188 - protein, 15 aa, Dengue virus
STLWEGSPGRFWNTT

SEQ ID NO: 254189 - protein, 15 aa, Dengue virus
AIANQAVVLMGLGRG

SEQ ID NO: 254190 - protein, 15 aa, Dengue virus
YKFQADSPSKLASAI

SEQ ID NO: 254191 - protein, 15 aa, Dengue virus
TVIDLEPVIYDSKFE

SEQ ID NO: 254192 - protein, 15 aa, Dengue virus
TEQYKFQPESPKRLS

SEQ ID NO: 254193 - protein, 15 aa, Dengue virus
TREEFIKKVRTNAAI

SEQ ID NO: 254194 - protein, 15 aa, Dengue virus
DDVDCWCNATSTWVM

SEQ ID NO: 254195 - protein, 15 aa, Dengue virus
SSVNMVSRMLLNRFT

SEQ ID NO: 254196 - protein, 15 aa, Dengue virus
IFVIDNVHTWTEQYK

SEQ ID NO: 254197 - protein, 15 aa, Dengue virus
IANQATVLMGLGKGW

SEQ ID NO: 254198 - protein, 15 aa, Dengue virus
NTFTNMEVQLIRQME

SEQ ID NO: 254199 - protein, 15 aa, Dengue virus
SQLAKRFSKGLFSGQ

SEQ ID NO: 254200 - protein, 15 aa, Dengue virus
RELKCGSGIFITNEV

SEQ ID NO: 254201 - protein, 15 aa, Dengue virus
AYTALFGGVSWMVRI

SEQ ID NO: 254202 - protein, 15 aa, Dengue virus
WVDVVLEHGGCVTTM

SEQ ID NO: 254203 - protein, 15 aa, Dengue virus
PTSRTTWSIHAHHQW

SEQ ID NO: 254204 - protein, 15 aa, Dengue virus
TVSQLAKRFSRGMLQ

SEQ ID NO: 254205 - protein, 15 aa, Dengue virus
AVGLVSILLSSLLRN

SEQ ID NO: 254206 - protein, 15 aa, Dengue virus
TKPWDVVPTVTQMAM

SEQ ID NO: 254207 - protein, 15 aa, Dengue virus
RTSWAFCESLTLATG

SEQ ID NO: 254208 - protein, 15 aa, Dengue virus
SSTRVPNYNLIVMDE

SEQ ID NO: 254209 - protein, 15 aa, Dengue virus
DGIVAIDLDPISYDA

SEQ ID NO: 254210 - protein, 15 aa, Dengue virus
HFHQLIMKDGRVLVV

SEQ ID NO: 254211 - protein, 15 aa, Dengue virus
EIGAIALDFSPGTSG

SEQ ID NO: 254212 - protein, 15 aa, Dengue virus
DIAACLRKNGKRVIQ

SEQ ID NO: 254213 - protein, 15 aa, Dengue virus
IFKLTYQNKVVKVLR

SEQ ID NO: 254214 - protein, 15 aa, Dengue virus
SWAFCEVLTLATGPI

SEQ ID NO: 254215 - protein, 15 aa, Dengue virus
CDSKLMSAAVKDNRA

SEQ ID NO: 254216 - protein, 15 aa, Dengue virus
VDLHPASAWTLYAVA

SEQ ID NO: 254217 - protein, 15 aa, Dengue virus
VTYSLNTFTNMEAQL

SEQ ID NO: 254218 - protein, 15 aa, Dengue virus
NGCGLFGKGSLITCA

SEQ ID NO: 254219 - protein, 15 aa, Dengue virus
GNLIRCPLSRNSTHE

SEQ ID NO: 254220 - protein, 15 aa, Dengue virus
GEDGCWYGMEIRPLK

SEQ ID NO: 254221 - protein, 15 aa, Dengue virus
SELPETLETLLLLAL

SEQ ID NO: 254222 - protein, 15 aa, Dengue virus
KVRTNAAIGAVFVDE

SEQ ID NO: 254223 - protein, 15 aa, Dengue virus
ELQWIASAIVLEFFL

SEQ ID NO: 254224 - protein, 15 aa, Dengue virus
VAGGLLIACYVITGR

SEQ ID NO: 254225 - protein, 15 aa, Dengue virus
PHWIAASIILEFFLM

SEQ ID NO: 254226 - protein, 15 aa, Dengue virus
ETRAQTWMSAEGAWR

SEQ ID NO: 254227 - protein, 15 aa, Dengue virus
AEALKGLPIRYQTTA

SEQ ID NO: 254228 - protein, 15 aa, Dengue virus
IRYQTPAVKSEHTGR

SEQ ID NO: 254229 - protein, 15 aa, Dengue virus
CESCVYNMMGKREKK

SEQ ID NO: 254230 - protein, 15 aa, Dengue virus
GEYRLRGEQRKTFVE

SEQ ID NO: 254231 - protein, 15 aa, Dengue virus
SRTTWSIHASHEWMT

SEQ ID NO: 254232 - protein, 15 aa, Dengue virus
RVLSIPPTAGVLARW

SEQ ID NO: 254233 - protein, 15 aa, Dengue virus
CETCVYNMMGKREKK

SEQ ID NO: 254234 - protein, 15 aa, Dengue virus
FINKVRSNAALGAVF

SEQ ID NO: 254235 - protein, 15 aa, Dengue virus
DYGFGVFTTNIWLRL

SEQ ID NO: 254236 - protein, 15 aa, Dengue virus
IPPTAGILARWGSFK

SEQ ID NO: 254237 - protein, 15 aa, Dengue virus
INKVRSNAALGAVFT

SEQ ID NO: 254238 - protein, 15 aa, Dengue virus
QPESPARLATAIAGA

SEQ ID NO: 254239 - protein, 15 aa, Dengue virus
TGQLLMMRTTWALCE

SEQ ID NO: 254240 - protein, 15 aa, Dengue virus
AKGARRMAILGDTAW

SEQ ID NO: 254241 - protein, 15 aa, Dengue virus
FPTSRTTWSIHAKHE

SEQ ID NO: 254242 - protein, 15 aa, Dengue virus
YSGVEGEGLHRLGYI

SEQ ID NO: 254243 - protein, 15 aa, Dengue virus
GEIGAIALDFSPGTS

SEQ ID NO: 254244 - protein, 15 aa, Dengue virus
GNDIAACLRKNGKRV

SEQ ID NO: 254245 - protein, 15 aa, Dengue virus
GKSYAQMWQLMYFHR

SEQ ID NO: 254246 - protein, 15 aa, Dengue virus
SSVNMISRMLLNRFT

SEQ ID NO: 254247 - protein, 15 aa, Dengue virus
KLFMALVAFLRFLAI

SEQ ID NO: 254248 - protein, 15 aa, Dengue virus
GIRSTTRLENLMWKQ

SEQ ID NO: 254249 - protein, 15 aa, Dengue virus
GANFKAGRVIDPRRC

SEQ ID NO: 254250 - protein, 15 aa, Dengue virus
MVNGVVRLLTKPWDV

SEQ ID NO: 254251 - protein, 15 aa, Dengue virus
SEMAEALKGLPIRYQ

SEQ ID NO: 254252 - protein, 15 aa, Dengue virus
RDKRSVALAPHVGMG

SEQ ID NO: 254253 - protein, 15 aa, Dengue virus
NIVSSVNMISRMLIN

SEQ ID NO: 254254 - protein, 15 aa, Dengue virus
NRVWIQDNPNMIDKT

SEQ ID NO: 254255 - protein, 15 aa, Dengue virus
RKVRSNAAIGAVFTD

SEQ ID NO: 254256 - protein, 15 aa, Dengue virus
ENDQYIYMGQPLNND

SEQ ID NO: 254257 - protein, 15 aa, Dengue virus
SGIFVTDEVHTWTEQ

SEQ ID NO: 254258 - protein, 15 aa, Dengue virus
EGAMRTALTGATEIQ

SEQ ID NO: 254259 - protein, 15 aa, Dengue virus
YDAKFEKQLGQIMLL

SEQ ID NO: 254260 - protein, 15 aa, Dengue virus
GKTKRYLPAIVREAL

SEQ ID NO: 254261 - protein, 15 aa, Dengue virus
IANQAAVLMGLDKGW

SEQ ID NO: 254262 - protein, 15 aa, Dengue virus
KRFSTGLLNGKGPLR

SEQ ID NO: 254263 - protein, 15 aa, Dengue virus
NSTHEMYWVSGATGN

SEQ ID NO: 254264 - protein, 15 aa, Dengue virus
DISEMGANFRAERVI

SEQ ID NO: 254265 - protein, 15 aa, Dengue virus
NGCGLFGKGGVVTCA

SEQ ID NO: 254266 - protein, 15 aa, Dengue virus
YNMMGKREKKLGEFG

SEQ ID NO: 254267 - protein, 15 aa, Dengue virus
GSYEVKPTGSASSMI

SEQ ID NO: 254268 - protein, 15 aa, Dengue virus
RNDVPMAGPLVAGGL

SEQ ID NO: 254269 - protein, 15 aa, Dengue virus
VILAGPIPVTPSSAA

SEQ ID NO: 254270 - protein, 15 aa, Dengue virus
EGRTLRVLKMVEPWL

SEQ ID NO: 254271 - protein, 15 aa, Dengue virus
SAWTLYAVATTFITP

SEQ ID NO: 254272 - protein, 15 aa, Dengue virus
GVFQEGTFHTMWHVT

SEQ ID NO: 254273 - protein, 15 aa, Dengue virus
VYRIKQQGILGKTQV

SEQ ID NO: 254274 - protein, 15 aa, Dengue virus
YMWLGARFLEFEALG

SEQ ID NO: 254275 - protein, 15 aa, Dengue virus
AIANQAAVLMGLDKG

SEQ ID NO: 254276 - protein, 15 aa, Dengue virus
CVYNMMGKREKKLGE

SEQ ID NO: 254277 - protein, 15 aa, Dengue virus
FESTYRGAKRMAILG

SEQ ID NO: 254278 - protein, 15 aa, Dengue virus
ALGCYSQVNPLTLTA

SEQ ID NO: 254279 - protein, 15 aa, Dengue virus
PVPMSTYGWNIVKLH

SEQ ID NO: 254280 - protein, 15 aa, Dengue virus
LGQVMLLILCASQIL

SEQ ID NO: 254281 - protein, 15 aa, Dengue virus
VPSIKAGNDIAACLR

SEQ ID NO: 254282 - protein, 15 aa, Dengue virus
AFCEALTLATGPVST

SEQ ID NO: 254283 - protein, 15 aa, Dengue virus
VNMISRMLLNRFTTR

SEQ ID NO: 254284 - protein, 15 aa, Dengue virus
DGAYRIMQRGLFGYS

SEQ ID NO: 254285 - protein, 15 aa, Dengue virus
VPMSTYGWNIVKLMS

SEQ ID NO: 254286 - protein, 15 aa, Dengue virus
TVLTPMLRHSIENSS

SEQ ID NO: 254287 - protein, 15 aa, Dengue virus
EAIKRKLRTLILAPT

SEQ ID NO: 254288 - protein, 15 aa, Dengue virus
LCEALTLATGPITTL

SEQ ID NO: 254289 - protein, 15 aa, Dengue virus
NRDFVEGVSGGTWVD

SEQ ID NO: 254290 - protein, 15 aa, Dengue virus
HHFHQLIMKDGRVLV

SEQ ID NO: 254291 - protein, 15 aa, Dengue virus
AGKTKRYLPAIVREA

SEQ ID NO: 254292 - protein, 15 aa, Dengue virus
RRDLRLAANAICSAV

SEQ ID NO: 254293 - protein, 15 aa, Dengue virus
RYQTTAIKAEHTGRE

SEQ ID NO: 254294 - protein, 15 aa, Dengue virus
AAYTALFGGVSWMVR

SEQ ID NO: 254295 - protein, 15 aa, Dengue virus
GRARVSQGAGWSLKE

SEQ ID NO: 254296 - protein, 15 aa, Dengue virus
RKNGKRVIQLSRKTF

SEQ ID NO: 254297 - protein, 15 aa, Dengue virus
ARVYADPMALKDFKE

SEQ ID NO: 254298 - protein, 15 aa, Dengue virus
SMINGVVRLLTKPWD

SEQ ID NO: 254299 - protein, 15 aa, Dengue virus
ETACLGKSYAQMWTL

SEQ ID NO: 254300 - protein, 15 aa, Dengue virus
TPQDNQLIYVILTIL

SEQ ID NO: 254301 - protein, 15 aa, Dengue virus
ALVAFLRFLAIPPTA

SEQ ID NO: 254302 - protein, 15 aa, Dengue virus
LLKNDVPLAGPMVAG

SEQ ID NO: 254303 - protein, 15 aa, Dengue virus
AGGMLIACYVITGTS

SEQ ID NO: 254304 - protein, 15 aa, Dengue virus
SKLMSAAVKDNRAVH

SEQ ID NO: 254305 - protein, 15 aa, Dengue virus
ASQILLMRTSWAFCE

SEQ ID NO: 254306 - protein, 15 aa, Dengue virus
DMGYWIESALNDTWK

SEQ ID NO: 254307 - protein, 15 aa, Dengue virus
QVPFCSHHFHELVMK

SEQ ID NO: 254308 - protein, 15 aa, Dengue virus
LMYADDTAGWDTRIT

SEQ ID NO: 254309 - protein, 15 aa, Dengue virus
TSRTTWSIHAHHQWM

SEQ ID NO: 254310 - protein, 15 aa, Dengue virus
DGCWYGMEIRPVSEK

SEQ ID NO: 254311 - protein, 15 aa, Dengue virus
CCRSCTLPPLRFKGE

SEQ ID NO: 254312 - protein, 15 aa, Dengue virus
GSSIGKMLEATAKGA

SEQ ID NO: 254313 - protein, 15 aa, Dengue virus
QATVLMGLGRGWPLH

SEQ ID NO: 254314 - protein, 15 aa, Dengue virus
PYKTWAYHGSYETKQ

SEQ ID NO: 254315 - protein, 15 aa, Dengue virus
YRLRGESRKTFVELM

SEQ ID NO: 254316 - protein, 15 aa, Dengue virus
TFTTRLLSSTRVPNY

SEQ ID NO: 254317 - protein, 15 aa, Dengue virus
SIENSSVNVSLTAIA

SEQ ID NO: 254318 - protein, 15 aa, Dengue virus
AVGLVSLLGSSLLKN

SEQ ID NO: 254319 - protein, 15 aa, Dengue virus
IGAVSLDFSPGTSGS

SEQ ID NO: 254320 - protein, 15 aa, Dengue virus
RSHTLWSNGVLESQM

SEQ ID NO: 254321 - protein, 15 aa, Dengue virus
LLSGRGPLKLFMAFV

SEQ ID NO: 254322 - protein, 15 aa, Dengue virus
SHTLWSNGVLESQML

SEQ ID NO: 254323 - protein, 15 aa, Dengue virus
MEEALKGMPIRYQTP

SEQ ID NO: 254324 - protein, 15 aa, Dengue virus
LTIMDLHPGSGKTRK

SEQ ID NO: 254325 - protein, 15 aa, Dengue virus
WSGVEGEGLHRLGYI

SEQ ID NO: 254326 - protein, 15 aa, Dengue virus
EQRKTFVELMKRGDL

SEQ ID NO: 254327 - protein, 15 aa, Dengue virus
QKGIFGKTQVGVGVQ

SEQ ID NO: 254328 - protein, 15 aa, Dengue virus
DFVEGVSGGAWVDLV

SEQ ID NO: 254329 - protein, 15 aa, Dengue virus
AIALDFSPGTSGSPI

SEQ ID NO: 254330 - protein, 15 aa, Dengue virus
ASVNTTSRLLLNRFT

SEQ ID NO: 254331 - protein, 15 aa, Dengue virus
DQWCGSLIGLTSRAT

SEQ ID NO: 254332 - protein, 15 aa, Dengue virus
LILAPTRVVASEMAE

SEQ ID NO: 254333 - protein, 15 aa, Dengue virus
KTWLVHRQWFLDLPL

SEQ ID NO: 254334 - protein, 15 aa, Dengue virus
AWTLYAVATTVLTPM

SEQ ID NO: 254335 - protein, 15 aa, Dengue virus
RSVALTPHSGTGLET

SEQ ID NO: 254336 - protein, 15 aa, Dengue virus
VVTRSGTYVSAIAQT

SEQ ID NO: 254337 - protein, 15 aa, Dengue virus
CCRSCTLPPLRYMGE

SEQ ID NO: 254338 - protein, 15 aa, Dengue virus
WTEQYKFQADSPKKL

SEQ ID NO: 254339 - protein, 15 aa, Dengue virus
VPFCSHHFHKIFMKD

SEQ ID NO: 254340 - protein, 15 aa, Dengue virus
SSELLSGRGPLKLFM

SEQ ID NO: 254341 - protein, 15 aa, Dengue virus
GNGVVTKSGTYVSAI

SEQ ID NO: 254342 - protein, 15 aa, Dengue virus
KRFSLGLLSGRGPLK

SEQ ID NO: 254343 - protein, 15 aa, Dengue virus
GDLPVWLSYKVASAG

SEQ ID NO: 254344 - protein, 15 aa, Dengue virus
ANCLRKNGKKVIQLS

SEQ ID NO: 254345 - protein, 15 aa, Dengue virus
VRSNAALGAIFQEEQ

SEQ ID NO: 254346 - protein, 15 aa, Dengue virus
MVNGVVKLLTKPWDV

SEQ ID NO: 254347 - protein, 15 aa, Dengue virus
EEFINKVRSNAALGA

SEQ ID NO: 254348 - protein, 15 aa, Dengue virus
IVSSVNMISRMLLNR

SEQ ID NO: 254349 - protein, 15 aa, Dengue virus
GLYGNGVVTRSGAYV

SEQ ID NO: 254350 - protein, 15 aa, Dengue virus
PSINMLKRVRNRVST

SEQ ID NO: 254351 - protein, 15 aa, Dengue virus
GIYRIKQKGIFGKTQ

SEQ ID NO: 254352 - protein, 15 aa, Dengue virus
LSELPETLETLLLLA

SEQ ID NO: 254353 - protein, 15 aa, Dengue virus
PLHRVDLGVPLLAMG

SEQ ID NO: 254354 - protein, 15 aa, Dengue virus
ELPETLETLLLLALL

SEQ ID NO: 254355 - protein, 15 aa, Dengue virus
IGLYGNGVVTTSGTY

SEQ ID NO: 254356 - protein, 15 aa, Dengue virus
PASIAARGYISTRVG

SEQ ID NO: 254357 - protein, 15 aa, Dengue virus
THEMYWVSGVSGNIV

SEQ ID NO: 254358 - protein, 15 aa, Dengue virus
VCGIRSATRMENLLW

SEQ ID NO: 254359 - protein, 15 aa, Dengue virus
YAVSRGTSKIRWIVE

SEQ ID NO: 254360 - protein, 15 aa, Dengue virus
RGPSLRTTTASGKLV

SEQ ID NO: 254361 - protein, 15 aa, Dengue virus
PLKLFMALVAFLRFL

SEQ ID NO: 254362 - protein, 15 aa, Dengue virus
RGSSKIRWFVERNLV

SEQ ID NO: 254363 - protein, 15 aa, Dengue virus
EFFLMVLLVPEPEKQ

SEQ ID NO: 254364 - protein, 15 aa, Dengue virus
TWVDVVLEHGSCVTT

SEQ ID NO: 254365 - protein, 15 aa, Dengue virus
DARVYADPMALKDFK

SEQ ID NO: 254366 - protein, 15 aa, Dengue virus
WLGARFLEFEALGFL

SEQ ID NO: 254367 - protein, 15 aa, Dengue virus
SWHYDQENPYKTWAY

SEQ ID NO: 254368 - protein, 15 aa, Dengue virus
YGWNLVRLQSGVDVF

SEQ ID NO: 254369 - protein, 15 aa, Dengue virus
LNEAVMAVGVVSILA

SEQ ID NO: 254370 - protein, 15 aa, Dengue virus
GSSLRTTTVSGKLIH

SEQ ID NO: 254371 - protein, 15 aa, Dengue virus
SWPLNEAIMAVGLVS

SEQ ID NO: 254372 - protein, 15 aa, Dengue virus
LWCGSLIGLSSRATW

SEQ ID NO: 254373 - protein, 15 aa, Dengue virus
RVEMGEAAGIFMTAT

SEQ ID NO: 254374 - protein, 15 aa, Dengue virus
EDHWFSRGNSFSGVE

SEQ ID NO: 254375 - protein, 15 aa, Dengue virus
EQYKFQPESPARLAT

SEQ ID NO: 254376 - protein, 15 aa, Dengue virus
WTEQYKFQPESPKRL

SEQ ID NO: 254377 - protein, 15 aa, Dengue virus
NGVVKLLTKPWDVVP

SEQ ID NO: 254378 - protein, 15 aa, Dengue virus
RNRVSTVSQLAKRFS

SEQ ID NO: 254379 - protein, 15 aa, Dengue virus
KEAKMLLDNIYTPEG

SEQ ID NO: 254380 - protein, 15 aa, Dengue virus
QRKTFVDLMRRGDLP

SEQ ID NO: 254381 - protein, 15 aa, Dengue virus
IMAVGMVSILASALL

SEQ ID NO: 254382 - protein, 15 aa, Dengue virus
ELQWIASAIVLEFFM

SEQ ID NO: 254383 - protein, 15 aa, Dengue virus
LDVDLHPASAWTLYA

SEQ ID NO: 254384 - protein, 15 aa, Dengue virus
TFVDLMRRGDLPVWL

SEQ ID NO: 254385 - protein, 15 aa, Dengue virus
LMMRTTWALCESITL

SEQ ID NO: 254386 - protein, 15 aa, Dengue virus
VPMAGPLVAGGLLIA

SEQ ID NO: 254387 - protein, 15 aa, Dengue virus
NEDHWFSRGNSLSGV

SEQ ID NO: 254388 - protein, 15 aa, Dengue virus
KPRWLDARIYADPMA

SEQ ID NO: 254389 - protein, 15 aa, Dengue virus
MGLGKGWPIHKMDLG

SEQ ID NO: 254390 - protein, 15 aa, Dengue virus
LLIACYVITGTSADL

SEQ ID NO: 254391 - protein, 15 aa, Dengue virus
LKGMPIRYQTPAIRA

SEQ ID NO: 254392 - protein, 15 aa, Dengue virus
VNVSLTAIANQAAVL

SEQ ID NO: 254393 - protein, 15 aa, Dengue virus
PERVILAGPMPVTAS

SEQ ID NO: 254394 - protein, 15 aa, Dengue virus
WAFCEVLTLATGPIL

SEQ ID NO: 254395 - protein, 15 aa, Dengue virus
MKMVMAFIAFLRFLT

SEQ ID NO: 254396 - protein, 15 aa, Dengue virus
LVLEHGGCVTTMAKN

SEQ ID NO: 254397 - protein, 15 aa, Dengue virus
MDIGVPLLAMGCYSQ

SEQ ID NO: 254398 - protein, 15 aa, Dengue virus
CVGQLLLMRTSWAFC

SEQ ID NO: 254399 - protein, 15 aa, Dengue virus
PSPTVEAGRTLRVLN

SEQ ID NO: 254400 - protein, 15 aa, Dengue virus
DVIVLGSQEGAMRTA

SEQ ID NO: 254401 - protein, 15 aa, Dengue virus
CGSGIFVIDNVHTRT

SEQ ID NO: 254402 - protein, 15 aa, Dengue virus
DARIYADPMALKDFK

SEQ ID NO: 254403 - protein, 15 aa, Dengue virus
IVSILASSLLRNDVP

SEQ ID NO: 254404 - protein, 15 aa, Dengue virus
IPTSRTTWSIHATHQ

SEQ ID NO: 254405 - protein, 15 aa, Dengue virus
HRRDKRSVALAPHVG

SEQ ID NO: 254406 - protein, 15 aa, Dengue virus
ILCASQILLMRTTWA

SEQ ID NO: 254407 - protein, 15 aa, Dengue virus
YISTRVEMGEAAAIF

SEQ ID NO: 254408 - protein, 15 aa, Dengue virus
GALVRCPLSRNSTHE

SEQ ID NO: 254409 - protein, 15 aa, Dengue virus
EGVFHTMWHVTRGSV

SEQ ID NO: 254410 - protein, 15 aa, Dengue virus
AIANQATVLMGLGKG

SEQ ID NO: 254411 - protein, 15 aa, Dengue virus
SYAQMWQLMYFHRRD

SEQ ID NO: 254412 - protein, 15 aa, Dengue virus
HEMYWVSGVSGNIVS

SEQ ID NO: 254413 - protein, 15 aa, Dengue virus
TNDWDFVVTTDISEM

SEQ ID NO: 254414 - protein, 15 aa, Dengue virus
KGIFGKTQVGVGVQK

SEQ ID NO: 254415 - protein, 15 aa, Dengue virus
LTKRFSLGLLSGRGP

SEQ ID NO: 254416 - protein, 15 aa, Dengue virus
AACLRKSGKRVIQLS

SEQ ID NO: 254417 - protein, 15 aa, Dengue virus
IRYQTTATKTEHTGR

SEQ ID NO: 254418 - protein, 15 aa, Dengue virus
AAVKDQRAVHADMGY

SEQ ID NO: 254419 - protein, 15 aa, Dengue virus
SCVTTMAQGKPTLDI

SEQ ID NO: 254420 - protein, 15 aa, Dengue virus
ERKKLRPRWLDARIY

SEQ ID NO: 254421 - protein, 15 aa, Dengue virus
GNRDFVEGVSGGTWV

SEQ ID NO: 254422 - protein, 15 aa, Dengue virus
HPASAWTLYAVATTI

SEQ ID NO: 254423 - protein, 15 aa, Dengue virus
SRDFVEGVSGGAWVD

SEQ ID NO: 254424 - protein, 15 aa, Dengue virus
VGRARVSQGAGWSLK

SEQ ID NO: 254425 - protein, 15 aa, Dengue virus
AYVMTGRSADLELER

SEQ ID NO: 254426 - protein, 15 aa, Dengue virus
MFESTYRGAKRMAIL

SEQ ID NO: 254427 - protein, 15 aa, Dengue virus
TKPWDVLPMVTQIAM

SEQ ID NO: 254428 - protein, 15 aa, Dengue virus
QYKFQADSPKKLASA

SEQ ID NO: 254429 - protein, 15 aa, Dengue virus
QMAMTDTTPFGQQRV

SEQ ID NO: 254430 - protein, 15 aa, Dengue virus
GCVTTMAKNKPTLDF

SEQ ID NO: 254431 - protein, 15 aa, Dengue virus
ETTMRGAKRMAILGE

SEQ ID NO: 254432 - protein, 15 aa, Dengue virus
SASSMINGVVRLLTK

SEQ ID NO: 254433 - protein, 15 aa, Dengue virus
LLMMRTTWALCESIT

SEQ ID NO: 254434 - protein, 15 aa, Dengue virus
ACLGKSYAQMWTLMY

SEQ ID NO: 254435 - protein, 15 aa, Dengue virus
IEEGRTLRVLKMVEP

SEQ ID NO: 254436 - protein, 15 aa, Dengue virus
PIHRVDLGVPLLALG

SEQ ID NO: 254437 - protein, 15 aa, Dengue virus
VREAIKRKLRTLVLA

SEQ ID NO: 254438 - protein, 15 aa, Dengue virus
IHAKHQWMTTEDMLK

SEQ ID NO: 254439 - protein, 15 aa, Dengue virus
VEGEGLHKLGYILRD

SEQ ID NO: 254440 - protein, 15 aa, Dengue virus
RTEQYKFQPESPARL

SEQ ID NO: 254441 - protein, 15 aa, Dengue virus
IPYDPKFEKQLGQVM

SEQ ID NO: 254442 - protein, 15 aa, Dengue virus
HGSCVTTMAQGKPTL

SEQ ID NO: 254443 - protein, 15 aa, Dengue virus
TSWAFCESLTLATGP

SEQ ID NO: 254444 - protein, 15 aa, Dengue virus
PNYNMVIMDEAHFTD

SEQ ID NO: 254445 - protein, 15 aa, Dengue virus
KFQADSPKKLASAIL

SEQ ID NO: 254446 - protein, 15 aa, Dengue virus
LILAPTRVVAAEMEE

SEQ ID NO: 254447 - protein, 15 aa, Dengue virus
AAEMEEALKGMPIRY

SEQ ID NO: 254448 - protein, 15 aa, Dengue virus
HTIENTTANISLTAI

SEQ ID NO: 254449 - protein, 15 aa, Dengue virus
PFCSHHFHQLIMKDG

SEQ ID NO: 254450 - protein, 15 aa, Dengue virus
VCGIRSVTRLENIMW

SEQ ID NO: 254451 - protein, 15 aa, Dengue virus
SGVEGEGLHRLGYIL

SEQ ID NO: 254452 - protein, 15 aa, Dengue virus
SCVTTMAKNKPTLDF

SEQ ID NO: 254453 - protein, 15 aa, Dengue virus
ATFTMRLLSPVRVPN

SEQ ID NO: 254454 - protein, 15 aa, Dengue virus
MTTEDMLAVWNRVWI

SEQ ID NO: 254455 - protein, 15 aa, Dengue virus
LCTGQLLMMRTTWAL

SEQ ID NO: 254456 - protein, 15 aa, Dengue virus
PAIVREAIKRKLRTL

SEQ ID NO: 254457 - protein, 15 aa, Dengue virus
GSLIGLTSRATWAQN

SEQ ID NO: 254458 - protein, 15 aa, Dengue virus
FETTMRGAKRMAILG

SEQ ID NO: 254459 - protein, 15 aa, Dengue virus
SSLLRNDVPLAGPLI

SEQ ID NO: 254460 - protein, 15 aa, Dengue virus
WPKTHTLWSNGVLES

SEQ ID NO: 254461 - protein, 15 aa, Dengue virus
RTSWALCEVLTLATG

SEQ ID NO: 254462 - protein, 15 aa, Dengue virus
ESRTIRVLKMVEPWL

SEQ ID NO: 254463 - protein, 15 aa, Dengue virus
SGSASSMVNGVVRLL

SEQ ID NO: 254464 - protein, 15 aa, Dengue virus
LLSPVRVPNYNLIIM

SEQ ID NO: 254465 - protein, 15 aa, Dengue virus
TIAVSMANIFRGSYL

SEQ ID NO: 254466 - protein, 15 aa, Dengue virus
VCGIRSTTRLENVMW

SEQ ID NO: 254467 - protein, 15 aa, Dengue virus
LPAIVREALKRRLRT

SEQ ID NO: 254468 - protein, 15 aa, Dengue virus
WSLMYFHRRDLRLAA

SEQ ID NO: 254469 - protein, 15 aa, Dengue virus
ARYLEFEALGFMNED

SEQ ID NO: 254470 - protein, 15 aa, Dengue virus
DSKLMSAAVKDQRAV

SEQ ID NO: 254471 - protein, 15 aa, Dengue virus
VSLLGSSLLKNDVPL

SEQ ID NO: 254472 - protein, 15 aa, Dengue virus
NLSLAAIANQAAILM

SEQ ID NO: 254473 - protein, 15 aa, Dengue virus
VGVGIHMENVFHTMW

SEQ ID NO: 254474 - protein, 15 aa, Dengue virus
TWALCESITLATGPL

SEQ ID NO: 254475 - protein, 15 aa, Dengue virus
HAVSRGSSKLRWFVE

SEQ ID NO: 254476 - protein, 15 aa, Dengue virus
SAWTLYAVATTVLTP

SEQ ID NO: 254477 - protein, 15 aa, Dengue virus
AMGCYSQVNPTTLTA

SEQ ID NO: 254478 - protein, 15 aa, Dengue virus
LGCYSQVNPLTLTAA

SEQ ID NO: 254479 - protein, 15 aa, Dengue virus
LLILCASQILLMRTS

SEQ ID NO: 254480 - protein, 15 aa, Dengue virus
LVAFLRFLAIPPTAG

SEQ ID NO: 254481 - protein, 15 aa, Dengue virus
AWTLYAVATTIITPM

SEQ ID NO: 254482 - protein, 15 aa, Dengue virus
GQLLMMRTTWALCEV

SEQ ID NO: 254483 - protein, 15 aa, Dengue virus
ILMGLGKGWPLHRMD

SEQ ID NO: 254484 - protein, 15 aa, Dengue virus
NDIAACLRKNGKRVI

SEQ ID NO: 254485 - protein, 15 aa, Dengue virus
NISLTAIANQAVVLM

SEQ ID NO: 254486 - protein, 15 aa, Dengue virus
SGKRVIQLSRKTFDS

SEQ ID NO: 254487 - protein, 15 aa, Dengue virus
RIKQQGILGKTQVGV

SEQ ID NO: 254488 - protein, 15 aa, Dengue virus
RLTIMDLHPGSGKTR

SEQ ID NO: 254489 - protein, 15 aa, Dengue virus
RIYSDPLALREFKEF

SEQ ID NO: 254490 - protein, 15 aa, Dengue virus
GVPLLALGCYSQVNP

SEQ ID NO: 254491 - protein, 15 aa, Dengue virus
RGTSKIRWIVERGMI

SEQ ID NO: 254492 - protein, 15 aa, Dengue virus
KTWAYHGSYEVKPTG

SEQ ID NO: 254493 - protein, 15 aa, Dengue virus
AGGLLLAAYVMTGRS

SEQ ID NO: 254494 - protein, 15 aa, Dengue virus
AEMEEALKGLPIRYQ

SEQ ID NO: 254495 - protein, 15 aa, Dengue virus
DVRNDLISYGGGWKL

SEQ ID NO: 254496 - protein, 15 aa, Dengue virus
TSANLSLTAIANQAA

SEQ ID NO: 254497 - protein, 15 aa, Dengue virus
LMGLDKGWPLSKMDL

SEQ ID NO: 254498 - protein, 15 aa, Dengue virus
ELPESLETLMLVALI

SEQ ID NO: 254499 - protein, 15 aa, Dengue virus
DLRLASMAICSAVPT

SEQ ID NO: 254500 - protein, 15 aa, Dengue virus
RRDKRSVALAPHVGM

SEQ ID NO: 254501 - protein, 15 aa, Dengue virus
AIWYMWLGARYLEFE

SEQ ID NO: 254502 - protein, 15 aa, Dengue virus
WYMWLGARYLEFEAL

SEQ ID NO: 254503 - protein, 15 aa, Dengue virus
MLLVLCAVQLLLMRT

SEQ ID NO: 254504 - protein, 15 aa, Dengue virus
KVRSNAAMGAVFTEE

SEQ ID NO: 254505 - protein, 15 aa, Dengue virus
LPETMETLLLLGLMI

SEQ ID NO: 254506 - protein, 15 aa, Dengue virus
IAFLRFLAIPPTAGI

SEQ ID NO: 254507 - protein, 15 aa, Dengue virus
CGIRSTTRLENLMWK

SEQ ID NO: 254508 - protein, 15 aa, Dengue virus
EAIKRKLRTLVLAPT

SEQ ID NO: 254509 - protein, 15 aa, Dengue virus
TRAQTWMSAEGAWRQ

SEQ ID NO: 254510 - protein, 15 aa, Dengue virus
TRTQTWMSSEGAWKQ

SEQ ID NO: 254511 - protein, 15 aa, Dengue virus
SRKTFVELMKRGDLP

SEQ ID NO: 254512 - protein, 15 aa, Dengue virus
YSLNTFTNMEAQLIR

SEQ ID NO: 254513 - protein, 15 aa, Dengue virus
KFQPESPARLATAIA

SEQ ID NO: 254514 - protein, 15 aa, Dengue virus
VMAVGVVSILASSFL

SEQ ID NO: 254515 - protein, 15 aa, Dengue virus
EEGRTLRVLKMVEPW

SEQ ID NO: 254516 - protein, 15 aa, Dengue virus
STPQGLVKRFSTGLL

SEQ ID NO: 254517 - protein, 15 aa, Dengue virus
AMHSALTGATEVDSG

SEQ ID NO: 254518 - protein, 15 aa, Dengue virus
LPIRYQTTAVKSEHT

SEQ ID NO: 254519 - protein, 15 aa, Dengue virus
MGHLKCRLRMDKLQL

SEQ ID NO: 254520 - protein, 15 aa, Dengue virus
WPLHRVDLGVPLLAM

SEQ ID NO: 254521 - protein, 15 aa, Dengue virus
AVSTANIFRGSYLAG

SEQ ID NO: 254522 - protein, 15 aa, Dengue virus
SGIFVVDNVHTWTEQ

SEQ ID NO: 254523 - protein, 15 aa, Dengue virus
RRYLPAMVREAIRRG

SEQ ID NO: 254524 - protein, 15 aa, Dengue virus
EQYQFQADSPKRLAS

SEQ ID NO: 254525 - protein, 15 aa, Dengue virus
YNLIVMDEAHFTDPS

SEQ ID NO: 254526 - protein, 15 aa, Dengue virus
AIANQAAVLMGLGKG

SEQ ID NO: 254527 - protein, 15 aa, Dengue virus
GAMYADDTAGWDTRI

SEQ ID NO: 254528 - protein, 15 aa, Dengue virus
YQFQPESPARVASAI

SEQ ID NO: 254529 - protein, 15 aa, Dengue virus
TMRLLSPVRVPNYNL

SEQ ID NO: 254530 - protein, 15 aa, Dengue virus
MFETTMRGAKRMAIL

SEQ ID NO: 254531 - protein, 15 aa, Dengue virus
IMAVGLVSILLSSLL

SEQ ID NO: 254532 - protein, 15 aa, Dengue virus
RDLRLAANAICSAVP

SEQ ID NO: 254533 - protein, 15 aa, Dengue virus
VEGEGLHRLGYILRD

SEQ ID NO: 254534 - protein, 15 aa, Dengue virus
KVRSNAAIGAVFTDE

SEQ ID NO: 254535 - protein, 15 aa, Dengue virus
FQADSPKRLASAIQK

SEQ ID NO: 254536 - protein, 15 aa, Dengue virus
YFHRRDLRLASNAIC

SEQ ID NO: 254537 - protein, 15 aa, Dengue virus
IGKMFEATARGARRM

SEQ ID NO: 254538 - protein, 15 aa, Dengue virus
ANCLRKSGKKVIQLS

SEQ ID NO: 254539 - protein, 15 aa, Dengue virus
ALVRCPLSRNSTHEM

SEQ ID NO: 254540 - protein, 15 aa, Dengue virus
QAAVLMGLGKGWPLS

SEQ ID NO: 254541 - protein, 15 aa, Dengue virus
KGARRMAILGDTAWD

SEQ ID NO: 254542 - protein, 15 aa, Dengue virus
ESTYRGAKRMAILGD

SEQ ID NO: 254543 - protein, 15 aa, Dengue virus
VQVLAIEPGKNPKNV

SEQ ID NO: 254544 - protein, 15 aa, Dengue virus
QLLLMRTSWAFCEAL

SEQ ID NO: 254545 - protein, 15 aa, Dengue virus
VPHVGMGLETRAQTW

SEQ ID NO: 254546 - protein, 15 aa, Dengue virus
PPTAGILKRWGQLKK

SEQ ID NO: 254547 - protein, 15 aa, Dengue virus
KNDIPMTGPLVAGGL

SEQ ID NO: 254548 - protein, 15 aa, Dengue virus
DVKKDMISYGGGWRL

SEQ ID NO: 254549 - protein, 15 aa, Dengue virus
THEMYWVSCGTGNIV

SEQ ID NO: 254550 - protein, 15 aa, Dengue virus
LNTFTNMEVQLIRQM

SEQ ID NO: 254551 - protein, 15 aa, Dengue virus
PSSVAARGYISTRVE

SEQ ID NO: 254552 - protein, 15 aa, Dengue virus
NQDELIGRARISQGA

SEQ ID NO: 254553 - protein, 15 aa, Dengue virus
GKSYAQMWTLMYFHR

SEQ ID NO: 254554 - protein, 15 aa, Dengue virus
IGAGVYKEGVFHTMW

SEQ ID NO: 254555 - protein, 15 aa, Dengue virus
TAIANQAAVLMGLDK

SEQ ID NO: 254556 - protein, 15 aa, Dengue virus
GARFLEFEALGFLNE

SEQ ID NO: 254557 - protein, 15 aa, Dengue virus
LIACYVITGRSADLE

SEQ ID NO: 254558 - protein, 15 aa, Dengue virus
MDLGVPLLALGCYSQ

SEQ ID NO: 254559 - protein, 15 aa, Dengue virus
DLVLEHGGCVTTMAK

SEQ ID NO: 254560 - protein, 15 aa, Dengue virus
GWPIHKMDLGVPLLA

SEQ ID NO: 254561 - protein, 15 aa, Dengue virus
CCRSCTMPPLRFRGE

SEQ ID NO: 254562 - protein, 15 aa, Dengue virus
MYFHRRDLRLASNAI

SEQ ID NO: 254563 - protein, 15 aa, Dengue virus
LTLATGPILTLWEGN

SEQ ID NO: 254564 - protein, 15 aa, Dengue virus
VPLLALGCYSQVNPL

SEQ ID NO: 254565 - protein, 15 aa, Dengue virus
RTSWAFCEALTLATG

SEQ ID NO: 254566 - protein, 15 aa, Dengue virus
PLSKMDLGVPLLALG

SEQ ID NO: 254567 - protein, 15 aa, Dengue virus
SIVREAIKRGLRTLI

SEQ ID NO: 254568 - protein, 15 aa, Dengue virus
WPLNEGIMAVGMVSI

SEQ ID NO: 254569 - protein, 15 aa, Dengue virus
GGNLIRCPLSRNSTH

SEQ ID NO: 254570 - protein, 15 aa, Dengue virus
LTYQNKVVKVLRPTP

SEQ ID NO: 254571 - protein, 15 aa, Dengue virus
EQYQFQPESPARVAS

SEQ ID NO: 254572 - protein, 15 aa, Dengue virus
KGWPISKMDIGVPLL

SEQ ID NO: 254573 - protein, 15 aa, Dengue virus
SRGMLQGQGPMKMVM

SEQ ID NO: 254574 - protein, 15 aa, Dengue virus
PETLETLLLLALLGA

SEQ ID NO: 254575 - protein, 15 aa, Dengue virus
PLNEAIMAVGLVSIL

SEQ ID NO: 254576 - protein, 15 aa, Dengue virus
ARGYISTRVEMGEAA

SEQ ID NO: 254577 - protein, 15 aa, Dengue virus
NEDHWFSRGNSFSGV

SEQ ID NO: 254578 - protein, 15 aa, Dengue virus
SGIFVVDNVHTRTEQ

SEQ ID NO: 254579 - protein, 15 aa, Dengue virus
RGSSLRTTTVSGKLI

SEQ ID NO: 254580 - protein, 15 aa, Dengue virus
VALAPHVGLGLDTRT

SEQ ID NO: 254581 - protein, 15 aa, Dengue virus
DHWFSRENSLSGVEG

SEQ ID NO: 254582 - protein, 15 aa, Dengue virus
YAQMWSLMYFHRRDL

SEQ ID NO: 254583 - protein, 15 aa, Dengue virus
ALKGLPIRYQTPAIR

SEQ ID NO: 254584 - protein, 15 aa, Dengue virus
GRFWNTTIAVSMANI

SEQ ID NO: 254585 - protein, 15 aa, Dengue virus
KFWNTTIAVSMANIF

SEQ ID NO: 254586 - protein, 15 aa, Dengue virus
GERKKLRPRWLDARI

SEQ ID NO: 254587 - protein, 15 aa, Dengue virus
SYYCGGLKNVTEVRG

SEQ ID NO: 254588 - protein, 15 aa, Dengue virus
PMSTYGWNIVKLMSG

SEQ ID NO: 254589 - protein, 15 aa, Dengue virus
KFWNTTIAVSTANIF

SEQ ID NO: 254590 - protein, 15 aa, Dengue virus
VSILASSFLRNDVPM

SEQ ID NO: 254591 - protein, 15 aa, Dengue virus
ETLMLLTLIAVLTGG

SEQ ID NO: 254592 - protein, 15 aa, Dengue virus
KPWDVLPMVTQIAMT

SEQ ID NO: 254593 - protein, 15 aa, Dengue virus
ENTTANISLAAIANQ

SEQ ID NO: 254594 - protein, 15 aa, Dengue virus
PTIEESRTIRVLKMV

SEQ ID NO: 254595 - protein, 15 aa, Dengue virus
TSANLSLAAIANQAA

SEQ ID NO: 254596 - protein, 15 aa, Dengue virus
MMRTTWALCEVITLA

SEQ ID NO: 254597 - protein, 15 aa, Dengue virus
KCGNGIFVADNVHTR

SEQ ID NO: 254598 - protein, 15 aa, Dengue virus
NMEVQLIRQMEAEGV

SEQ ID NO: 254599 - protein, 15 aa, Dengue virus
YGNGVVTRSGAYVSA

SEQ ID NO: 254600 - protein, 15 aa, Dengue virus
LTLATGPVSTLWEGN

SEQ ID NO: 254601 - protein, 15 aa, Dengue virus
GVCGIRSATRMENLL

SEQ ID NO: 254602 - protein, 15 aa, Dengue virus
RGPLKLFMALVAFLR

SEQ ID NO: 254603 - protein, 15 aa, Dengue virus
AVLMGLDKGWPLSKM

SEQ ID NO: 254604 - protein, 15 aa, Dengue virus
KHAVSRGSSKIRWFV

SEQ ID NO: 254605 - protein, 15 aa, Dengue virus
QPQWIASSIILEFFL

SEQ ID NO: 254606 - protein, 15 aa, Dengue virus
NPTVEAGRTLRVLSL

SEQ ID NO: 254607 - protein, 15 aa, Dengue virus
LLKNDVPLAGPLIAG

SEQ ID NO: 254608 - protein, 15 aa, Dengue virus
WDVVPMVTQLAMTDT

SEQ ID NO: 254609 - protein, 15 aa, Dengue virus
KRGDLPVWLAYKVAA

SEQ ID NO: 254610 - protein, 15 aa, Dengue virus
LAKRFSRGMLQGQGP

SEQ ID NO: 254611 - protein, 15 aa, Dengue virus
KKKLKPRWLDARIYA

SEQ ID NO: 254612 - protein, 15 aa, Dengue virus
TTWSIHAHHQWMTTE

SEQ ID NO: 254613 - protein, 15 aa, Dengue virus
DVIPMVTQMAMTDTT

SEQ ID NO: 254614 - protein, 15 aa, Dengue virus
MRTSWALCEVLTLAT

SEQ ID NO: 254615 - protein, 15 aa, Dengue virus
SSLLKNDVPLAGPLI

SEQ ID NO: 254616 - protein, 15 aa, Dengue virus
AMVREAIRRGLRTLI

SEQ ID NO: 254617 - protein, 15 aa, Dengue virus
IGIVSILASSLLRND

SEQ ID NO: 254618 - protein, 15 aa, Dengue virus
AAAGIMKNPTVDGIV

SEQ ID NO: 254619 - protein, 15 aa, Dengue virus
GARRMAILGDTAWDF

SEQ ID NO: 254620 - protein, 15 aa, Dengue virus
GIVSILASSLLRNDV

SEQ ID NO: 254621 - protein, 15 aa, Dengue virus
MRLLSPVRVPNYNMV

SEQ ID NO: 254622 - protein, 15 aa, Dengue virus
YWVSCGTGNIVSAVN

SEQ ID NO: 254623 - protein, 15 aa, Dengue virus
IANQAAILMGLGKGW

SEQ ID NO: 254624 - protein, 15 aa, Dengue virus
VWFVPSIKTGNDIAA

SEQ ID NO: 254625 - protein, 15 aa, Dengue virus
ISTRVEMGEAAAIFM

SEQ ID NO: 254626 - protein, 15 aa, Dengue virus
VPNYNLIVMDEAHFT

SEQ ID NO: 254627 - protein, 15 aa, Dengue virus
GWSYYCGGLKNVKEV

SEQ ID NO: 254628 - protein, 15 aa, Dengue virus
EAGRTLRVLSLVENW

SEQ ID NO: 254629 - protein, 15 aa, Dengue virus
AGWSLRETACLGKSY

SEQ ID NO: 254630 - protein, 15 aa, Dengue virus
QEGAMHSALTGATEI

SEQ ID NO: 254631 - protein, 15 aa, Dengue virus
RAAAGIMKNPTVDGI

SEQ ID NO: 254632 - protein, 15 aa, Dengue virus
MYAGHLKCKVRMERL

SEQ ID NO: 254633 - protein, 15 aa, Dengue virus
QFQADSPKRLATAIA

SEQ ID NO: 254634 - protein, 15 aa, Dengue virus
RRDLRLASMAICSAV

SEQ ID NO: 254635 - protein, 15 aa, Dengue virus
NASGNIVSSVNMISR

SEQ ID NO: 254636 - protein, 15 aa, Dengue virus
MDIGVPLLAIGCYSQ

SEQ ID NO: 254637 - protein, 15 aa, Dengue virus
QPESPKRLSAAIGKA

SEQ ID NO: 254638 - protein, 15 aa, Dengue virus
IVREAIKRGLRTLIL

SEQ ID NO: 254639 - protein, 15 aa, Dengue virus
DGEYRLRGEQRKTFV

SEQ ID NO: 254640 - protein, 15 aa, Dengue virus
GICGIRSTTRLENLM

SEQ ID NO: 254641 - protein, 15 aa, Dengue virus
AGRTLRVLNLVENWL

SEQ ID NO: 254642 - protein, 15 aa, Dengue virus
LLVLCVTQVLLMRTT

SEQ ID NO: 254643 - protein, 15 aa, Dengue virus
VSTGSQLAKRFSKGL

SEQ ID NO: 254644 - protein, 15 aa, Dengue virus
QILLMRTTWAFCEVL

SEQ ID NO: 254645 - protein, 15 aa, Dengue virus
TGNIVSSVNMVSRML

SEQ ID NO: 254646 - protein, 15 aa, Dengue virus
FSSELLSGRGPLKLF

SEQ ID NO: 254647 - protein, 15 aa, Dengue virus
VAAEMEEALKGLPIR

SEQ ID NO: 254648 - protein, 15 aa, Dengue virus
DQYVFMGEPLENDED

SEQ ID NO: 254649 - protein, 15 aa, Dengue virus
CGSLIGLTSRATWAK

SEQ ID NO: 254650 - protein, 15 aa, Dengue virus
SRGSSKIRWFVERNL

SEQ ID NO: 254651 - protein, 15 aa, Dengue virus
QLGQVMLLILCASQI

SEQ ID NO: 254652 - protein, 15 aa, Dengue virus
LLVTFKNPHAKRQDV

SEQ ID NO: 254653 - protein, 15 aa, Dengue virus
GRARVSQGAGWSLRE

SEQ ID NO: 254654 - protein, 15 aa, Dengue virus
TGNIVSAVNMTSKML

SEQ ID NO: 254655 - protein, 15 aa, Dengue virus
KELKCGSGIFVTDNV

SEQ ID NO: 254656 - protein, 15 aa, Dengue virus
ALIALNDMGKIRKDI

SEQ ID NO: 254657 - protein, 15 aa, Dengue virus
RKTFVDLMKRGDLPV

SEQ ID NO: 254658 - protein, 15 aa, Dengue virus
VRVPNYNLIIMDEAH

SEQ ID NO: 254659 - protein, 15 aa, Dengue virus
FVELMKRGDLPVWLA

SEQ ID NO: 254660 - protein, 15 aa, Dengue virus
AAIKDSKAVHADMGY

SEQ ID NO: 254661 - protein, 15 aa, Dengue virus
EESRTIRVLKMVEPW

SEQ ID NO: 254662 - protein, 15 aa, Dengue virus
IPMSTYGWNLVRLQS

SEQ ID NO: 254663 - protein, 15 aa, Dengue virus
SLVRCPLSRNSTHEM

SEQ ID NO: 254664 - protein, 15 aa, Dengue virus
MRTTWAFCEVLTLAT

SEQ ID NO: 254665 - protein, 15 aa, Dengue virus
NPTVDGIVAIDLDPI

SEQ ID NO: 254666 - protein, 15 aa, Dengue virus
LKPVILTDGPERVIL

SEQ ID NO: 254667 - protein, 15 aa, Dengue virus
EERVVLAGPMPVTHS

SEQ ID NO: 254668 - protein, 15 aa, Dengue virus
LASALLKNDIPMTGP

SEQ ID NO: 254669 - protein, 15 aa, Dengue virus
EKRSVALAPHVGLGL

SEQ ID NO: 254670 - protein, 15 aa, Dengue virus
RDFVEGVSGGSWVDI

SEQ ID NO: 254671 - protein, 15 aa, Dengue virus
NQAAILMGLDKGWPL

SEQ ID NO: 254672 - protein, 15 aa, Dengue virus
RGSGQVVTYSLNTFT

SEQ ID NO: 254673 - protein, 15 aa, Dengue virus
NLIIMDEAHFTDPAS

SEQ ID NO: 254674 - protein, 15 aa, Dengue virus
NDTWKIEKASFIEIK

SEQ ID NO: 254675 - protein, 15 aa, Dengue virus
PMVAGGLLLAAYVMT

SEQ ID NO: 254676 - protein, 15 aa, Dengue virus
DIPMTGPLVAGGLLT

SEQ ID NO: 254677 - protein, 15 aa, Dengue virus
MATLKNVREVKGLTK

SEQ ID NO: 254678 - protein, 15 aa, Dengue virus
LGCYSQVNPLTLIAA

SEQ ID NO: 254679 - protein, 15 aa, Dengue virus
STYRGAKRMAILGET

SEQ ID NO: 254680 - protein, 15 aa, Dengue virus
GWNLVKLHSGVDVFY

SEQ ID NO: 254681 - protein, 15 aa, Dengue virus
GGWSYYMATLKNVRE

SEQ ID NO: 254682 - protein, 15 aa, Dengue virus
QFCIKVLNPYMPTVI

SEQ ID NO: 254683 - protein, 15 aa, Dengue virus
AAILMGLGKGWPLHR

SEQ ID NO: 254684 - protein, 15 aa, Dengue virus
SSMVNGVVKLLTKPW

SEQ ID NO: 254685 - protein, 15 aa, Dengue virus
KVWNRVWIQDNPNMI

SEQ ID NO: 254686 - protein, 15 aa, Dengue virus
MRTSWAFCESLTLAT

SEQ ID NO: 254687 - protein, 15 aa, Dengue virus
FHTMWHVTRGSVICH

SEQ ID NO: 254688 - protein, 15 aa, Dengue virus
VTTDISEMGANFRAE

SEQ ID NO: 254689 - protein, 15 aa, Dengue virus
MRRGDLPVWLAYKVA

SEQ ID NO: 254690 - protein, 15 aa, Dengue virus
GNDIANCLRKNGKKV

SEQ ID NO: 254691 - protein, 15 aa, Dengue virus
TFLRVLSIPPTAGVL

SEQ ID NO: 254692 - protein, 15 aa, Dengue virus
TRRYLPAMVREAIRR

SEQ ID NO: 254693 - protein, 15 aa, Dengue virus
LMGLGKGWPLHRMDI

SEQ ID NO: 254694 - protein, 15 aa, Dengue virus
EKRSVALAPHVGMGL

SEQ ID NO: 254695 - protein, 15 aa, Dengue virus
SVKKDLISYGGGWRL

SEQ ID NO: 254696 - protein, 15 aa, Dengue virus
KEGVFHTMWHVTRGS

SEQ ID NO: 254697 - protein, 15 aa, Dengue virus
LKPRWLDARIYADPM

SEQ ID NO: 254698 - protein, 15 aa, Dengue virus
RKTFVELMKRGDLPV

SEQ ID NO: 254699 - protein, 15 aa, Dengue virus
LAGPLIAGGMLIACY

SEQ ID NO: 254700 - protein, 15 aa, Dengue virus
SLLFLNDMGKVRKDI

SEQ ID NO: 254701 - protein, 15 aa, Dengue virus
SLTAIANQAAVLMGL

SEQ ID NO: 254702 - protein, 15 aa, Dengue virus
IMLLILCTGQLLMMR

SEQ ID NO: 254703 - protein, 15 aa, Dengue virus
TANVSLAAIANQATV

SEQ ID NO: 254704 - protein, 15 aa, Dengue virus
HWIAASIILEFFLMV

SEQ ID NO: 254705 - protein, 15 aa, Dengue virus
HEMYWVSNASGNIVS

SEQ ID NO: 254706 - protein, 15 aa, Dengue virus
AGPMPVTAASAAQRR

SEQ ID NO: 254707 - protein, 15 aa, Dengue virus
GLVKRFSTGLLNGKG

SEQ ID NO: 254708 - protein, 15 aa, Dengue virus
YLPAMVREAIRRGLR

SEQ ID NO: 254709 - protein, 15 aa, Dengue virus
RAQTWMSSEGAWKHV

SEQ ID NO: 254710 - protein, 15 aa, Dengue virus
RWLDARVYADPMALK

SEQ ID NO: 254711 - protein, 15 aa, Dengue virus
CWYGMEIRPLKEKEE

SEQ ID NO: 254712 - protein, 15 aa, Dengue virus
SYEVKPTGSASSMIN

SEQ ID NO: 254713 - protein, 15 aa, Dengue virus
EGIMAVGMVSILASA

SEQ ID NO: 254714 - protein, 15 aa, Dengue virus
REKRSVALTPHSGMG

SEQ ID NO: 254715 - protein, 15 aa, Dengue virus
IAACLRKSGKRVIQL

SEQ ID NO: 254716 - protein, 15 aa, Dengue virus
ESLETLMLVALLATV

SEQ ID NO: 254717 - protein, 15 aa, Dengue virus
LDARIYADPMALKDF

SEQ ID NO: 254718 - protein, 15 aa, Dengue virus
WGNGCGLFGKGSLIT

SEQ ID NO: 254719 - protein, 15 aa, Dengue virus
SRAIWYMWLGARFLE

SEQ ID NO: 254720 - protein, 15 aa, Dengue virus
LLALNDMGKVRKDIQ

SEQ ID NO: 254721 - protein, 15 aa, Dengue virus
ATYGWNLVKLHSGVD

SEQ ID NO: 254722 - protein, 15 aa, Dengue virus
EGNPGRFWNTTIAVS

SEQ ID NO: 254723 - protein, 15 aa, Dengue virus
KTKRILPSIVREAIK

SEQ ID NO: 254724 - protein, 15 aa, Dengue virus
PWDVIPMVTQMAMTD

SEQ ID NO: 254725 - protein, 15 aa, Dengue virus
GWSYYCGGLKNVTEV

SEQ ID NO: 254726 - protein, 15 aa, Dengue virus
TIEESRTIRVLKMVE

SEQ ID NO: 254727 - protein, 15 aa, Dengue virus
RHTIENTTANISLTA

SEQ ID NO: 254728 - protein, 15 aa, Dengue virus
QYKFQPESPKRLSAA

SEQ ID NO: 254729 - protein, 15 aa, Dengue virus
GGSLVRCPLSRNSTH

SEQ ID NO: 254730 - protein, 15 aa, Dengue virus
AEFCKKVRSNAAMGA

SEQ ID NO: 254731 - protein, 15 aa, Dengue virus
FEKQLGQVMLLILCA

SEQ ID NO: 254732 - protein, 15 aa, Dengue virus
VTKNGGYVSGIAQTN

SEQ ID NO: 254733 - protein, 15 aa, Dengue virus
SGKKVIQLSRKTFDS

SEQ ID NO: 254734 - protein, 15 aa, Dengue virus
DVDCWCNATSAWVMY

SEQ ID NO: 254735 - protein, 15 aa, Dengue virus
WALCEVLTLATGPVM

SEQ ID NO: 254736 - protein, 15 aa, Dengue virus
EDGAYRIMQRGLFGY

SEQ ID NO: 254737 - protein, 15 aa, Dengue virus
VEDYGFGVFTTNIWL

SEQ ID NO: 254738 - protein, 15 aa, Dengue virus
AVKDQRAVHADMGYW

SEQ ID NO: 254739 - protein, 15 aa, Dengue virus
NQAVVLMGLDKGWPI

SEQ ID NO: 254740 - protein, 15 aa, Dengue virus
ATHQWMTTEDMLSVW

SEQ ID NO: 254741 - protein, 15 aa, Dengue virus
HADMGYWIESSKNQT

SEQ ID NO: 254742 - protein, 15 aa, Dengue virus
KTFVELMKRGDLPVW

SEQ ID NO: 254743 - protein, 15 aa, Dengue virus
TKYAVSRGTSKIRWI

SEQ ID NO: 254744 - protein, 15 aa, Dengue virus
GEAAGIFMTATPPGS

SEQ ID NO: 254745 - protein, 15 aa, Dengue virus
VTVLGSQEGAMHSAL

SEQ ID NO: 254746 - protein, 15 aa, Dengue virus
EQYKFQADSPSKLAS

SEQ ID NO: 254747 - protein, 15 aa, Dengue virus
MSAAVKDNRAVHADM

SEQ ID NO: 254748 - protein, 15 aa, Dengue virus
QEVPFCSHHFHQLIM

SEQ ID NO: 254749 - protein, 15 aa, Dengue virus
CGLFGKGSLITCAKF

SEQ ID NO: 254750 - protein, 15 aa, Dengue virus
GSGIFITNEVHTWTE

SEQ ID NO: 254751 - protein, 15 aa, Dengue virus
PTSRTTWSIHATHQW

SEQ ID NO: 254752 - protein, 15 aa, Dengue virus
TTWALCESITLATGP

SEQ ID NO: 254753 - protein, 15 aa, Dengue virus
GVEGEGLHRLGYILR

SEQ ID NO: 254754 - protein, 15 aa, Dengue virus
KTRKYLPAIVREAIK

SEQ ID NO: 254755 - protein, 15 aa, Dengue virus
AAEMEEALRGLPIRY

SEQ ID NO: 254756 - protein, 15 aa, Dengue virus
AVATTFITPMLRHSI

SEQ ID NO: 254757 - protein, 15 aa, Dengue virus
GLVSILLSSLLRNDV

SEQ ID NO: 254758 - protein, 15 aa, Dengue virus
YHGSYEVKATGSASS

SEQ ID NO: 254759 - protein, 15 aa, Dengue virus
LTYQNKVVRVQRPTP

SEQ ID NO: 254760 - protein, 15 aa, Dengue virus
CYVITGRSADLELEK

SEQ ID NO: 254761 - protein, 15 aa, Dengue virus
DLHPASAWTLYAVAT

SEQ ID NO: 254762 - protein, 15 aa, Dengue virus
AEMEEALKGMPIRYQ

SEQ ID NO: 254763 - protein, 15 aa, Dengue virus
QRKTFVELMKRGDLP

SEQ ID NO: 254764 - protein, 15 aa, Dengue virus
IACYVITGRSADLEL

SEQ ID NO: 254765 - protein, 15 aa, Dengue virus
YGWNIVKLHSGKDVF

SEQ ID NO: 254766 - protein, 15 aa, Dengue virus
IYGAAFSGVSWIMKI

SEQ ID NO: 254767 - protein, 15 aa, Dengue virus
MFAGHLKCRLKMDKL

SEQ ID NO: 254768 - protein, 15 aa, Dengue virus
LLDNIYTPEGIIPTL

SEQ ID NO: 254769 - protein, 15 aa, Dengue virus
MWLGARFLEFEALGF

SEQ ID NO: 254770 - protein, 15 aa, Dengue virus
TITLLVKLALITVSG

SEQ ID NO: 254771 - protein, 15 aa, Dengue virus
CESITLATGPLSTLW

SEQ ID NO: 254772 - protein, 15 aa, Dengue virus
EVQVLAIEPGKNPKH

SEQ ID NO: 254773 - protein, 15 aa, Dengue virus
KGLPIRYQTTAVKSE

SEQ ID NO: 254774 - protein, 15 aa, Dengue virus
ACLGKSYAQMWALMY

SEQ ID NO: 254775 - protein, 15 aa, Dengue virus
MLKRERNRVSTGSQL

SEQ ID NO: 254776 - protein, 15 aa, Dengue virus
YIYMGQPLNNDEDHA

SEQ ID NO: 254777 - protein, 15 aa, Dengue virus
GIMKNPTVDGIVAID

SEQ ID NO: 254778 - protein, 15 aa, Dengue virus
AILMGLGKGWPLHRM

SEQ ID NO: 254779 - protein, 15 aa, Dengue virus
LAPHVGMGLETRAQT

SEQ ID NO: 254780 - protein, 15 aa, Dengue virus
ISTRVEMGEAAGIFM

SEQ ID NO: 254781 - protein, 15 aa, Dengue virus
VPNYNLIIMDEAHFT

SEQ ID NO: 254782 - protein, 15 aa, Dengue virus
LETLMLVALLATVTG

SEQ ID NO: 254783 - protein, 15 aa, Dengue virus
IGAIALDFSPGTSGS

SEQ ID NO: 254784 - protein, 15 aa, Dengue virus
VEDYGFGVFSTNIWL

SEQ ID NO: 254785 - protein, 15 aa, Dengue virus
QLLMMRTTWALCESI

SEQ ID NO: 254786 - protein, 15 aa, Dengue virus
STANVSLAAIANQAV

SEQ ID NO: 254787 - protein, 15 aa, Dengue virus
YLPAIVREAIKRKLR

SEQ ID NO: 254788 - protein, 15 aa, Dengue virus
GPMPVTHASAAQRRG

SEQ ID NO: 254789 - protein, 15 aa, Dengue virus
ATTIVTPMLRHTIEN

SEQ ID NO: 254790 - protein, 15 aa, Dengue virus
VLMGLGKGWPIHKMD

SEQ ID NO: 254791 - protein, 15 aa, Dengue virus
GKMFETTMRGAKRMA

SEQ ID NO: 254792 - protein, 15 aa, Dengue virus
YNLIIMDEAHFTDPA

SEQ ID NO: 254793 - protein, 15 aa, Dengue virus
AGKTKRILPSIVREA

SEQ ID NO: 254794 - protein, 15 aa, Dengue virus
RREKRSVALVPHVGM

SEQ ID NO: 254795 - protein, 15 aa, Dengue virus
MANIFRGSYLAGAGL

SEQ ID NO: 254796 - protein, 15 aa, Dengue virus
PSLRTTTVTGKIITE

SEQ ID NO: 254797 - protein, 15 aa, Dengue virus
SGIFITDNVHTWTEQ

SEQ ID NO: 254798 - protein, 15 aa, Dengue virus
KVVGLYGNGVVTKSG

SEQ ID NO: 254799 - protein, 15 aa, Dengue virus
PMLRHTIENSTANVS

SEQ ID NO: 254800 - protein, 15 aa, Dengue virus
DNIYTPEGIIPTLFG

SEQ ID NO: 254801 - protein, 15 aa, Dengue virus
WFPTSRTTWSIHAKH

SEQ ID NO: 254802 - protein, 15 aa, Dengue virus
ASSMINGVVKLLTKP

SEQ ID NO: 254803 - protein, 15 aa, Dengue virus
FTNMEVQLIRQMEAE

SEQ ID NO: 254804 - protein, 15 aa, Dengue virus
LGKSYAQMWTLMYFH

SEQ ID NO: 254805 - protein, 15 aa, Dengue virus
RQDVIVLGSQEGAMR

SEQ ID NO: 254806 - protein, 15 aa, Dengue virus
PLSTLWEGSPGRFWN

SEQ ID NO: 254807 - protein, 15 aa, Dengue virus
TCVYNMMGKREKKLG

SEQ ID NO: 254808 - protein, 15 aa, Dengue virus
FIAFLRFLTIPPTAG

SEQ ID NO: 254809 - protein, 15 aa, Dengue virus
YWVSGVSGNIVSSVN

SEQ ID NO: 254810 - protein, 15 aa, Dengue virus
NGVVTRSGTYVSAIA

SEQ ID NO: 254811 - protein, 15 aa, Dengue virus
LCEVITLATGPLSTL

SEQ ID NO: 254812 - protein, 15 aa, Dengue virus
LKNDVPLAGPLIAGG

SEQ ID NO: 254813 - protein, 15 aa, Dengue virus
EQYQFQADSPKRLAT

SEQ ID NO: 254814 - protein, 15 aa, Dengue virus
DGITVIDLEPVIYDS

SEQ ID NO: 254815 - protein, 15 aa, Dengue virus
ALKGMPIRYQTPAIR

SEQ ID NO: 254816 - protein, 15 aa, Dengue virus
LMYFHRRDLRLAANA

SEQ ID NO: 254817 - protein, 15 aa, Dengue virus
ALKGLPIRYQTTAVK

SEQ ID NO: 254818 - protein, 15 aa, Dengue virus
WTLYAVATTIVTPML

SEQ ID NO: 254819 - protein, 15 aa, Dengue virus
YGWNLVKLMSGKDVF

SEQ ID NO: 254820 - protein, 15 aa, Dengue virus
GRELKCGSGIFITNN

SEQ ID NO: 254821 - protein, 15 aa, Dengue virus
AQTWMSSEGAWKHVQ

SEQ ID NO: 254822 - protein, 15 aa, Dengue virus
DLLVTFKTAHAKKQE

SEQ ID NO: 254823 - protein, 15 aa, Dengue virus
VPLLAMGCYSQVNPT

SEQ ID NO: 254824 - protein, 15 aa, Dengue virus
RTTWSIHAKHEWMTT

SEQ ID NO: 254825 - protein, 15 aa, Dengue virus
NIYTPEGIIPTLFGP

SEQ ID NO: 254826 - protein, 15 aa, Dengue virus
ASGNIVSSVNMISRM

SEQ ID NO: 254827 - protein, 15 aa, Dengue virus
LRPRWLDARTYSDPL

SEQ ID NO: 254828 - protein, 15 aa, Dengue virus
IEPSWADVRNDLISY

SEQ ID NO: 254829 - protein, 15 aa, Dengue virus
LDEGVYRIKQQGILG

SEQ ID NO: 254830 - protein, 15 aa, Dengue virus
ERMVTFKVPHAKKQD

SEQ ID NO: 254831 - protein, 15 aa, Dengue virus
GNPGRFWNTTIAVSM

SEQ ID NO: 254832 - protein, 15 aa, Dengue virus
ELLVTFKNPHAKRQD

SEQ ID NO: 254833 - protein, 15 aa, Dengue virus
IETLMLLTLIAVLTG

SEQ ID NO: 254834 - protein, 15 aa, Dengue virus
TYRGAKRMAILGETA

SEQ ID NO: 254835 - protein, 15 aa, Dengue virus
NPGKFWNTTIAVSMA

SEQ ID NO: 254836 - protein, 15 aa, Dengue virus
GVFHTMWHVTRGAVL

SEQ ID NO: 254837 - protein, 15 aa, Dengue virus
REDLWCGSLIGLSSR

SEQ ID NO: 254838 - protein, 15 aa, Dengue virus
EVVVLGSQEGAMHTA

SEQ ID NO: 254839 - protein, 15 aa, Dengue virus
PIPMSTYGWNLVRLQ

SEQ ID NO: 254840 - protein, 15 aa, Dengue virus
DLGVPLLALGCYSQV

SEQ ID NO: 254841 - protein, 15 aa, Dengue virus
TRTETWMSSEGAWKH

SEQ ID NO: 254842 - protein, 15 aa, Dengue virus
FKNAHAKRQDVIVLG

SEQ ID NO: 254843 - protein, 15 aa, Dengue virus
NIVSSVNTISKMLLN

SEQ ID NO: 254844 - protein, 15 aa, Dengue virus
ELMKRGDLPVWLAYK

SEQ ID NO: 254845 - protein, 15 aa, Dengue virus
FKLTYQNKVVKVLRP

SEQ ID NO: 254846 - protein, 15 aa, Dengue virus
WPLNEGIMAIGIVSI

SEQ ID NO: 254847 - protein, 15 aa, Dengue virus
CVTTIAKSKPTLDIE

SEQ ID NO: 254848 - protein, 15 aa, Dengue virus
STVSQLAKRFSRGML

SEQ ID NO: 254849 - protein, 15 aa, Dengue virus
AIYGAAFSGVSWIMK

SEQ ID NO: 254850 - protein, 15 aa, Dengue virus
GQVMLLILCASQILL

SEQ ID NO: 254851 - protein, 15 aa, Dengue virus
HWFSRENSYSGVEGE

SEQ ID NO: 254852 - protein, 15 aa, Dengue virus
KVRSNAAIGAVFVDE

SEQ ID NO: 254853 - protein, 15 aa, Dengue virus
LVSLLGSSLLKNDVP

SEQ ID NO: 254854 - protein, 15 aa, Dengue virus
TRKYLPAIVREAIKR

SEQ ID NO: 254855 - protein, 15 aa, Dengue virus
FMGHLKCRLRMDKLQ

SEQ ID NO: 254856 - protein, 15 aa, Dengue virus
DPKFEKQLGQVMLLV

SEQ ID NO: 254857 - protein, 15 aa, Dengue virus
CGLFGKGSLVTCAKF

SEQ ID NO: 254858 - protein, 15 aa, Dengue virus
GEAAAIFMTATPPGA

SEQ ID NO: 254859 - protein, 15 aa, Dengue virus
SPSPTVEAGRTLRVL

SEQ ID NO: 254860 - protein, 15 aa, Dengue virus
MGEAAAIFMTATPPG

SEQ ID NO: 254861 - protein, 15 aa, Dengue virus
EAIMAVGLVSILLSS

SEQ ID NO: 254862 - protein, 15 aa, Dengue virus
NIVSSVNMISRMLLN

SEQ ID NO: 254863 - protein, 15 aa, Dengue virus
SSMINGVVRLLTKPW

SEQ ID NO: 254864 - protein, 15 aa, Dengue virus
PTVEAGRTLRVLSLV

SEQ ID NO: 254865 - protein, 15 aa, Dengue virus
GSLIGLTARATWATN

SEQ ID NO: 254866 - protein, 15 aa, Dengue virus
YWVSGATGNIVSSVN

SEQ ID NO: 254867 - protein, 15 aa, Dengue virus
LPAIIREAIKRKLRT

SEQ ID NO: 254868 - protein, 15 aa, Dengue virus
VGLVSLLGSSLLKND

SEQ ID NO: 254869 - protein, 15 aa, Dengue virus
EQYKFQPESPARLAS

SEQ ID NO: 254870 - protein, 15 aa, Dengue virus
GCWYGMEIRPINEKE

SEQ ID NO: 254871 - protein, 15 aa, Dengue virus
SILLSSLLKNDVPLA

SEQ ID NO: 254872 - protein, 15 aa, Dengue virus
WALCESITLATGPLS

SEQ ID NO: 254873 - protein, 15 aa, Dengue virus
VYDSKFEKQLGQVML

SEQ ID NO: 254874 - protein, 15 aa, Dengue virus
RDFVEGVSGGAWVDL

SEQ ID NO: 254875 - protein, 15 aa, Dengue virus
SRTTWSIHATHQWMT

SEQ ID NO: 254876 - protein, 15 aa, Dengue virus
GLPIRYQTPAIRAEH

SEQ ID NO: 254877 - protein, 15 aa, Dengue virus
GKTRKYLPAIIREAI

SEQ ID NO: 254878 - protein, 15 aa, Dengue virus
DVDCWCNATSAWVTY

SEQ ID NO: 254879 - protein, 15 aa, Dengue virus
TEQYKFQADSPKKLA

SEQ ID NO: 254880 - protein, 15 aa, Dengue virus
TKPWDVIPMVTQMAM

SEQ ID NO: 254881 - protein, 15 aa, Dengue virus
VLALEPGKNPKHVQT

SEQ ID NO: 254882 - protein, 15 aa, Dengue virus
LTPMLRHSIENSSVN

SEQ ID NO: 254883 - protein, 15 aa, Dengue virus
AIGIVSILASSLLRN

SEQ ID NO: 254884 - protein, 15 aa, Dengue virus
WALCEVITLATGPLS

SEQ ID NO: 254885 - protein, 15 aa, Dengue virus
PIRYQTTAVKSEHTG

SEQ ID NO: 254886 - protein, 15 aa, Dengue virus
QGLVKRFSTGLLNGK

SEQ ID NO: 254887 - protein, 15 aa, Dengue virus
GSRAIWYMWLGARYL

SEQ ID NO: 254888 - protein, 15 aa, Dengue virus
GNIVSAVNMTSKMLL

SEQ ID NO: 254889 - protein, 15 aa, Dengue virus
GGAMYADDTAGWDTR

SEQ ID NO: 254890 - protein, 15 aa, Dengue virus
KGMPIRYQTTAVKSE

SEQ ID NO: 254891 - protein, 15 aa, Dengue virus
LRFLAIPPTAGILKR

SEQ ID NO: 254892 - protein, 15 aa, Dengue virus
PMSTYGWNLVRLQSG

SEQ ID NO: 254893 - protein, 15 aa, Dengue virus
TYRGAKRMAILGDTA

SEQ ID NO: 254894 - protein, 15 aa, Dengue virus
VSSVNMISRMLINRF

SEQ ID NO: 254895 - protein, 15 aa, Dengue virus
TRHAVSRGSAKLQWI

SEQ ID NO: 254896 - protein, 15 aa, Dengue virus
SYETKQTGSASSMVN

SEQ ID NO: 254897 - protein, 15 aa, Dengue virus
NGCGLFGKGSLLTCA

SEQ ID NO: 254898 - protein, 15 aa, Dengue virus
VTFKTAHAKKQEVVV

SEQ ID NO: 254899 - protein, 15 aa, Dengue virus
SIAARGYISTRVEMG

SEQ ID NO: 254900 - protein, 15 aa, Dengue virus
TNMEAQLIRQMESEG

SEQ ID NO: 254901 - protein, 15 aa, Dengue virus
CDHRLMSAAVKDERA

SEQ ID NO: 254902 - protein, 15 aa, Dengue virus
AYRHAMEELPDTIET

SEQ ID NO: 254903 - protein, 15 aa, Dengue virus
GRGGWSYYCGGLKNV

SEQ ID NO: 254904 - protein, 15 aa, Dengue virus
GKRVIQLSRKTFDSE

SEQ ID NO: 254905 - protein, 15 aa, Dengue virus
SSLLRNDVPMAGPLV

SEQ ID NO: 254906 - protein, 15 aa, Dengue virus
LMGLGKGWPIHKMDL

SEQ ID NO: 254907 - protein, 15 aa, Dengue virus
KNGSWKLARASFIEV

SEQ ID NO: 254908 - protein, 15 aa, Dengue virus
TDISEMGANFRAERV

SEQ ID NO: 254909 - protein, 15 aa, Dengue virus
ATFTTRLLSSTRVPN

SEQ ID NO: 254910 - protein, 15 aa, Dengue virus
LRETACLGKSYAQMW

SEQ ID NO: 254911 - protein, 15 aa, Dengue virus
MYWISNGTGNIVASV

SEQ ID NO: 254912 - protein, 15 aa, Dengue virus
EDHWFSRENSYSGVE

SEQ ID NO: 254913 - protein, 15 aa, Dengue virus
RVILAGPMPVTVASA

SEQ ID NO: 254914 - protein, 15 aa, Dengue virus
CVTTIAKNKPTLDIE

SEQ ID NO: 254915 - protein, 15 aa, Dengue virus
YKFQADSPKRLATAI

SEQ ID NO: 254916 - protein, 15 aa, Dengue virus
GPMVAGGLLLAAYVM

SEQ ID NO: 254917 - protein, 15 aa, Dengue virus
SVNTISKMLLNRFTT

SEQ ID NO: 254918 - protein, 15 aa, Dengue virus
IGRARISQGAGWSLR

SEQ ID NO: 254919 - protein, 15 aa, Dengue virus
MYWVSCGTGNIVSAV

SEQ ID NO: 254920 - protein, 15 aa, Dengue virus
ENTTANISLTAIANQ

SEQ ID NO: 254921 - protein, 15 aa, Dengue virus
NYNMVIMDEAHFTDP

SEQ ID NO: 254922 - protein, 15 aa, Dengue virus
ATVLMGLGKGWPIHK

SEQ ID NO: 254923 - protein, 15 aa, Dengue virus
FCVKILNPYMPSVVE

SEQ ID NO: 254924 - protein, 15 aa, Dengue virus
HASHEWMTTEDMLAV

SEQ ID NO: 254925 - protein, 15 aa, Dengue virus
NEGIMAIGIVSILAS

SEQ ID NO: 254926 - protein, 15 aa, Dengue virus
GSQEGAMRTALTGAT

SEQ ID NO: 254927 - protein, 15 aa, Dengue virus
RVSTVQQLTKRFSLG

SEQ ID NO: 254928 - protein, 15 aa, Dengue virus
GSQEGAMHSALAGAT

SEQ ID NO: 254929 - protein, 15 aa, Dengue virus
ARKTFVELMRRGDLP

SEQ ID NO: 254930 - protein, 15 aa, Dengue virus
EFFLMVLLIPEPEKQ

SEQ ID NO: 254931 - protein, 15 aa, Dengue virus
FTNMEAQLIRQMESE

SEQ ID NO: 254932 - protein, 15 aa, Dengue virus
RDLRLASNAICSAVP

SEQ ID NO: 254933 - protein, 15 aa, Dengue virus
EGVYRIKQQGILGKT

SEQ ID NO: 254934 - protein, 15 aa, Dengue virus
AKMLLDNIYTPEGII

SEQ ID NO: 254935 - protein, 15 aa, Dengue virus
VATTIITPMLRHTIE

SEQ ID NO: 254936 - protein, 15 aa, Dengue virus
LVLCVTQVLLMRTTW

SEQ ID NO: 254937 - protein, 15 aa, Dengue virus
YKTWAYHGSYEVKAT

SEQ ID NO: 254938 - protein, 15 aa, Dengue virus
VMAFIAFLRFLAIPP

SEQ ID NO: 254939 - protein, 15 aa, Dengue virus
SWPLNEGIMAIGIVS

SEQ ID NO: 254940 - protein, 15 aa, Dengue virus
FHTMWHVTRGAVLTY

SEQ ID NO: 254941 - protein, 15 aa, Dengue virus
TIGKMFETTMRGAKR

SEQ ID NO: 254942 - protein, 15 aa, Dengue virus
GKVIGLYGNGVVTTS

SEQ ID NO: 254943 - protein, 15 aa, Dengue virus
GIFVVDNVHTRTEQY

SEQ ID NO: 254944 - protein, 15 aa, Dengue virus
RTEQYQFQPESPARV

SEQ ID NO: 254945 - protein, 15 aa, Dengue virus
VSGATGNIVSSVNMV

SEQ ID NO: 254946 - protein, 15 aa, Dengue virus
AQTWMSAEGAWRQVE

SEQ ID NO: 254947 - protein, 15 aa, Dengue virus
LSTLWEGSPGKFWNT

SEQ ID NO: 254948 - protein, 15 aa, Dengue virus
PIRVPNYNLVVMDEA

SEQ ID NO: 254949 - protein, 15 aa, Dengue virus
TANVSLAAIANQAVV

SEQ ID NO: 254950 - protein, 15 aa, Dengue virus
AFLRFLAIPPTAGIL

SEQ ID NO: 254951 - protein, 15 aa, Dengue virus
GLPIRYQTTATKTEH

SEQ ID NO: 254952 - protein, 15 aa, Dengue virus
IVLLIPEPDRQRTPQ

SEQ ID NO: 254953 - protein, 15 aa, Dengue virus
YRIMQRGLFGYSQIG

SEQ ID NO: 254954 - protein, 15 aa, Dengue virus
EGKVVGLYGNGVVTK

SEQ ID NO: 254955 - protein, 15 aa, Dengue virus
KCGSGIFITNNVHTW

SEQ ID NO: 254956 - protein, 15 aa, Dengue virus
MVTQLAMTDTTPFGQ

SEQ ID NO: 254957 - protein, 15 aa, Dengue virus
AWTLYAVATTFITPM

SEQ ID NO: 254958 - protein, 15 aa, Dengue virus
RGWPLHRVDLGVPLL

SEQ ID NO: 254959 - protein, 15 aa, Dengue virus
LGAIFQEEQGWTSAS

SEQ ID NO: 254960 - protein, 15 aa, Dengue virus
AGRTLRVLSLVENWL

SEQ ID NO: 254961 - protein, 15 aa, Dengue virus
RKKLRPRWLDARVYS

SEQ ID NO: 254962 - protein, 15 aa, Dengue virus
GSGIFVIDNVHTWTE

SEQ ID NO: 254963 - protein, 15 aa, Dengue virus
TYGWNIVKLHSGKDV

SEQ ID NO: 254964 - protein, 15 aa, Dengue virus
AVSRGSAKLRWIVER

SEQ ID NO: 254965 - protein, 15 aa, Dengue virus
ILTILLKATLLAISG

SEQ ID NO: 254966 - protein, 15 aa, Dengue virus
RKNGKKVIQLSRKTF

SEQ ID NO: 254967 - protein, 15 aa, Dengue virus
YAVATTVLTPMLRHS

SEQ ID NO: 254968 - protein, 15 aa, Dengue virus
PERVILAGPIPVTPS

SEQ ID NO: 254969 - protein, 15 aa, Dengue virus
GCVTTMAQGKPTLDI

SEQ ID NO: 254970 - protein, 15 aa, Dengue virus
IKRKLRTLILAPTRV

SEQ ID NO: 254971 - protein, 15 aa, Dengue virus
CASQILLMRTTWAFC

SEQ ID NO: 254972 - protein, 15 aa, Dengue virus
DHRLMSAAVKDERAV

SEQ ID NO: 254973 - protein, 15 aa, Dengue virus
GNDIANCLRKSGKKV

SEQ ID NO: 254974 - protein, 15 aa, Dengue virus
VCGVRSTTRMENLLW

SEQ ID NO: 254975 - protein, 15 aa, Dengue virus
CSHHFHQLIMKDGRV

SEQ ID NO: 254976 - protein, 15 aa, Dengue virus
AYAQMWSLMYFHRRD

SEQ ID NO: 254977 - protein, 15 aa, Dengue virus
GIRSTTRLENVMWKQ

SEQ ID NO: 254978 - protein, 15 aa, Dengue virus
LGQIMLLILCTGQLL

SEQ ID NO: 254979 - protein, 15 aa, Dengue virus
SRDFVEGVSGGTWVD

SEQ ID NO: 254980 - protein, 15 aa, Dengue virus
EGEGLHRLGYILRDV

SEQ ID NO: 254981 - protein, 15 aa, Dengue virus
VQVLAIEPGKNPKHV

SEQ ID NO: 254982 - protein, 15 aa, Dengue virus
VDCWCNATSAWVTYG

SEQ ID NO: 254983 - protein, 15 aa, Dengue virus
DGVFHTMWHVTRGAV

SEQ ID NO: 254984 - protein, 15 aa, Dengue virus
YGLNTFTNMEVQLIR

SEQ ID NO: 254985 - protein, 15 aa, Dengue virus
GEKKKLRPKWLDART

SEQ ID NO: 254986 - protein, 15 aa, Dengue virus
MTGPLVAGGLLTVCY

SEQ ID NO: 254987 - protein, 15 aa, Dengue virus
SYEVKATGSASSMIN

SEQ ID NO: 254988 - protein, 15 aa, Dengue virus
WCGSLIGLSSRATWA

SEQ ID NO: 254989 - protein, 15 aa, Dengue virus
LCAVQLLLMRTSWAL

SEQ ID NO: 254990 - protein, 15 aa, Dengue virus
GYISTRVEMGEAAAI

SEQ ID NO: 254991 - protein, 15 aa, Dengue virus
LRNDVPMAGPLVAGG

SEQ ID NO: 254992 - protein, 15 aa, Dengue virus
WPISKVDIGVPLLAM

SEQ ID NO: 254993 - protein, 15 aa, Dengue virus
ERELHKLGKCGSCVY

SEQ ID NO: 254994 - protein, 15 aa, Dengue virus
MYWVSGVSGNIVSSV

SEQ ID NO: 254995 - protein, 15 aa, Dengue virus
HTIENTTANISLAAI

SEQ ID NO: 254996 - protein, 15 aa, Dengue virus
MWLGARYLEFEALGF

SEQ ID NO: 254997 - protein, 15 aa, Dengue virus
WTEQYKFQADSPSKL

SEQ ID NO: 254998 - protein, 15 aa, Dengue virus
TYSLNTFTNMEVQLI

SEQ ID NO: 254999 - protein, 15 aa, Dengue virus
GVPLLAMGCYSQVNP

SEQ ID NO: 255000 - protein, 15 aa, Dengue virus
TIENTTANISLAAIA

SEQ ID NO: 255001 - protein, 15 aa, Dengue virus
PLNEAVMAVGVVSIL

SEQ ID NO: 255002 - protein, 15 aa, Dengue virus
GWSYYCAGLKKVTEV

SEQ ID NO: 255003 - protein, 15 aa, Dengue virus
KGPLRMVLAFITFLR

SEQ ID NO: 255004 - protein, 15 aa, Dengue virus
YQTTAIKAEHTGREI

SEQ ID NO: 255005 - protein, 15 aa, Dengue virus
FCEVLTLATGPILTL

SEQ ID NO: 255006 - protein, 15 aa, Dengue virus
KRMAILGETAWDFGS

SEQ ID NO: 255007 - protein, 15 aa, Dengue virus
CLRKNGKKVIQLSRK

SEQ ID NO: 255008 - protein, 15 aa, Dengue virus
SGQVVTYSLNTFTNM

SEQ ID NO: 255009 - protein, 15 aa, Dengue virus
AILMGLDKGWPLHRM

SEQ ID NO: 255010 - protein, 15 aa, Dengue virus
QWMTTEDMLSVWNRV

SEQ ID NO: 255011 - protein, 15 aa, Dengue virus
SSIAARGYISTRVEM

SEQ ID NO: 255012 - protein, 15 aa, Dengue virus
SLTLATGPVLTLWEG

SEQ ID NO: 255013 - protein, 15 aa, Dengue virus
TYGWNLVRLQSGVDV

SEQ ID NO: 255014 - protein, 15 aa, Dengue virus
IKRGLRTLILAPTRV

SEQ ID NO: 255015 - protein, 15 aa, Dengue virus
WQQVPFCSHHFHQLI

SEQ ID NO: 255016 - protein, 15 aa, Dengue virus
VASEMAEALKGMPIR

SEQ ID NO: 255017 - protein, 15 aa, Dengue virus
IVLGSQEGAMRTALT

SEQ ID NO: 255018 - protein, 15 aa, Dengue virus
NGVVTKSGTYVSAIT

SEQ ID NO: 255019 - protein, 15 aa, Dengue virus
MPVTVASAAQRRGRI

SEQ ID NO: 255020 - protein, 15 aa, Dengue virus
RGLFGYSQIGAGVYK

SEQ ID NO: 255021 - protein, 15 aa, Dengue virus
LMGLDKGWPISKMDI

SEQ ID NO: 255022 - protein, 15 aa, Dengue virus
NWQQVPFCSHHFHQL

SEQ ID NO: 255023 - protein, 15 aa, Dengue virus
ESRKTFVELMKRGDL

SEQ ID NO: 255024 - protein, 15 aa, Dengue virus
QVVTYSLNTFTNMEV

SEQ ID NO: 255025 - protein, 15 aa, Dengue virus
KMLLDNIYTPEGIIP

SEQ ID NO: 255026 - protein, 15 aa, Dengue virus
RIKQRGILGRSQVGV

SEQ ID NO: 255027 - protein, 15 aa, Dengue virus
NENDQYIYMGQPLNN

SEQ ID NO: 255028 - protein, 15 aa, Dengue virus
VRTNAAIGAVFVDEN

SEQ ID NO: 255029 - protein, 15 aa, Dengue virus
MLKRVRNRVSTVQQL

SEQ ID NO: 255030 - protein, 15 aa, Dengue virus
RSVALVPHVGMGLET

SEQ ID NO: 255031 - protein, 15 aa, Dengue virus
MMRHTIENTTANISL

SEQ ID NO: 255032 - protein, 15 aa, Dengue virus
TLWSNGVLESQMLIP

SEQ ID NO: 255033 - protein, 15 aa, Dengue virus
VVPMVTQLAMTDTTP

SEQ ID NO: 255034 - protein, 15 aa, Dengue virus
GERKKLRPRWLDART

SEQ ID NO: 255035 - protein, 15 aa, Dengue virus
EIVDLMCHATFTMRL

SEQ ID NO: 255036 - protein, 15 aa, Dengue virus
KLVMAFIAFLRFLAI

SEQ ID NO: 255037 - protein, 15 aa, Dengue virus
SGIFVIDNVHTWTEQ

SEQ ID NO: 255038 - protein, 15 aa, Dengue virus
NTTIAVSMANIFRGS

SEQ ID NO: 255039 - protein, 15 aa, Dengue virus
GSRAIWYMWLGARFL

SEQ ID NO: 255040 - protein, 15 aa, Dengue virus
GQVVTYGLNTFTNME

SEQ ID NO: 255041 - protein, 15 aa, Dengue virus
ERRREKRSVALAPHV

SEQ ID NO: 255042 - protein, 15 aa, Dengue virus
LRTTTASGKLIHEWC

SEQ ID NO: 255043 - protein, 15 aa, Dengue virus
VGIHMENVFHTMWHV

SEQ ID NO: 255044 - protein, 15 aa, Dengue virus
LTLWEGNPGRFWNTT

SEQ ID NO: 255045 - protein, 15 aa, Dengue virus
REKVQAIDGEFRLRG

SEQ ID NO: 255046 - protein, 15 aa, Dengue virus
AVQLLLMRTSWALCE

SEQ ID NO: 255047 - protein, 15 aa, Dengue virus
NMCTLMAMDLGEFCE

SEQ ID NO: 255048 - protein, 15 aa, Dengue virus
KRGDLPVWLAHKVAS

SEQ ID NO: 255049 - protein, 15 aa, Dengue virus
DIANCLRKSGKKVIQ

SEQ ID NO: 255050 - protein, 15 aa, Dengue virus
MRCVGIGSRDFVEGV

SEQ ID NO: 255051 - protein, 15 aa, Dengue virus
VEAGRTLRVLNLVEN

SEQ ID NO: 255052 - protein, 15 aa, Dengue virus
VALAPHVGMGLETRT

SEQ ID NO: 255053 - protein, 15 aa, Dengue virus
PLALREFKEFAAGRR

SEQ ID NO: 255054 - protein, 15 aa, Dengue virus
SGIFITNEVHTWTEQ

SEQ ID NO: 255055 - protein, 15 aa, Dengue virus
SFNMLKRARNRVSTP

SEQ ID NO: 255056 - protein, 15 aa, Dengue virus
VVKLLTKPWDVLPMV

SEQ ID NO: 255057 - protein, 15 aa, Dengue virus
TDWDYVVTTDISEMG

SEQ ID NO: 255058 - protein, 15 aa, Dengue virus
GIVAIDLDPISYDAK

SEQ ID NO: 255059 - protein, 15 aa, Dengue virus
HPYKTWAYHGSYEVK

SEQ ID NO: 255060 - protein, 15 aa, Dengue virus
EDIDCWCNLTSTWVT

SEQ ID NO: 255061 - protein, 15 aa, Dengue virus
GCGLFGKGGVVTCAK

SEQ ID NO: 255062 - protein, 15 aa, Dengue virus
QPESPARVASAILNA

SEQ ID NO: 255063 - protein, 15 aa, Dengue virus
GEFGRAKGSRAIWYM

SEQ ID NO: 255064 - protein, 15 aa, Dengue virus
VLGSQEGAMHSALAG

SEQ ID NO: 255065 - protein, 15 aa, Dengue virus
TDGIYRILQRGLLGK

SEQ ID NO: 255066 - protein, 15 aa, Dengue virus
GYISTRVGMGEAAAI

SEQ ID NO: 255067 - protein, 15 aa, Dengue virus
DARVYSDPLALKEFK

SEQ ID NO: 255068 - protein, 15 aa, Dengue virus
IENTTANISLTAIAN

SEQ ID NO: 255069 - protein, 15 aa, Dengue virus
KLRPRWLDARVYSDP

SEQ ID NO: 255070 - protein, 15 aa, Dengue virus
GILGRSQVGVGIHME

SEQ ID NO: 255071 - protein, 15 aa, Dengue virus
DLMYADDTAGWDTRI

SEQ ID NO: 255072 - protein, 15 aa, Dengue virus
EALKGMPIRYQTPAI

SEQ ID NO: 255073 - protein, 15 aa, Dengue virus
SELLSGRGPLKLFMA

SEQ ID NO: 255074 - protein, 15 aa, Dengue virus
FQADSPKRLATAIAG

SEQ ID NO: 255075 - protein, 15 aa, Dengue virus
IANCLRKNGKKVIQL

SEQ ID NO: 255076 - protein, 15 aa, Dengue virus
QGPMKLVMAFIAFLR

SEQ ID NO: 255077 - protein, 15 aa, Dengue virus
SIFKLTYQNKVVRVQ

SEQ ID NO: 255078 - protein, 15 aa, Dengue virus
ILLSSLLKNDVPLAG

SEQ ID NO: 255079 - protein, 15 aa, Dengue virus
AMHSALAGATEIQMS

SEQ ID NO: 255080 - protein, 15 aa, Dengue virus
RVVASEMAEALKGMP

SEQ ID NO: 255081 - protein, 15 aa, Dengue virus
TYGWNLVKLMSGKDV

SEQ ID NO: 255082 - protein, 15 aa, Dengue virus
CGLFGKGGIVTCAMF

SEQ ID NO: 255083 - protein, 15 aa, Dengue virus
HRRDLRLASNAICSA

SEQ ID NO: 255084 - protein, 15 aa, Dengue virus
QEGAMHTALTGATEI

SEQ ID NO: 255085 - protein, 15 aa, Dengue virus
LLAMGCYSQVNPTTL

SEQ ID NO: 255086 - protein, 15 aa, Dengue virus
EALTLATGPVSTLWE

SEQ ID NO: 255087 - protein, 15 aa, Dengue virus
VSRGTAKLRWIVERG

SEQ ID NO: 255088 - protein, 15 aa, Dengue virus
GKELKCGSGIFVTDN

SEQ ID NO: 255089 - protein, 15 aa, Dengue virus
GVCGIRSTTRLENVM

SEQ ID NO: 255090 - protein, 15 aa, Dengue virus
SASSMVNGVVRLLTK

SEQ ID NO: 255091 - protein, 15 aa, Dengue virus
PSLRTTTASGKLIHE

SEQ ID NO: 255092 - protein, 15 aa, Dengue virus
DLPVWLAHKVASEGF

SEQ ID NO: 255093 - protein, 15 aa, Dengue virus
LVHKQWFLDLPLPWT

SEQ ID NO: 255094 - protein, 15 aa, Dengue virus
WQQVPFCSHHFHELV

SEQ ID NO: 255095 - protein, 15 aa, Dengue virus
HPGSGKTRKYLPAIV

SEQ ID NO: 255096 - protein, 15 aa, Dengue virus
LMYFHRRDLRLASNA

SEQ ID NO: 255097 - protein, 15 aa, Dengue virus
HAVSRGTAKLRWIVE

SEQ ID NO: 255098 - protein, 15 aa, Dengue virus
TFKVPHAKKQDVVVL

SEQ ID NO: 255099 - protein, 15 aa, Dengue virus
YGWNLVKLHSGVDVF

SEQ ID NO: 255100 - protein, 15 aa, Dengue virus
WQEVPFCSHHFHQLI

SEQ ID NO: 255101 - protein, 15 aa, Dengue virus
TFVELMKRGDLPVWL

SEQ ID NO: 255102 - protein, 15 aa, Dengue virus
HAVSRGTAKLQWFVE

SEQ ID NO: 255103 - protein, 15 aa, Dengue virus
QMWQLMYFHRRDLRL

SEQ ID NO: 255104 - protein, 15 aa, Dengue virus
NIYTPEGIIPTLFEP

SEQ ID NO: 255105 - protein, 15 aa, Dengue virus
LAGPMVAGGLLLAAY

SEQ ID NO: 255106 - protein, 15 aa, Dengue virus
GLVSLLGSSLLKNDV

SEQ ID NO: 255107 - protein, 15 aa, Dengue virus
RKKLRPRWLDARIYS

SEQ ID NO: 255108 - protein, 15 aa, Dengue virus
PNPTIEAGRTLRVLS

SEQ ID NO: 255109 - protein, 15 aa, Dengue virus
ATTFITPMLRHSIEN

SEQ ID NO: 255110 - protein, 15 aa, Dengue virus
AIGCYSQVNPITLTA

SEQ ID NO: 255111 - protein, 15 aa, Dengue virus
GLLIACYVITGRSAD

SEQ ID NO: 255112 - protein, 15 aa, Dengue virus
ILLSSLLRNDVPLAG

SEQ ID NO: 255113 - protein, 15 aa, Dengue virus
WIPTSRTTWSIHATH

SEQ ID NO: 255114 - protein, 15 aa, Dengue virus
SVNMVSRLLLNRFTM

SEQ ID NO: 255115 - protein, 15 aa, Dengue virus
LVTFKTAHAKKQEVV

SEQ ID NO: 255116 - protein, 15 aa, Dengue virus
GTGNIVSAVNMTSKM

SEQ ID NO: 255117 - protein, 15 aa, Dengue virus
VEDYGFGIFTTNIWM

SEQ ID NO: 255118 - protein, 15 aa, Dengue virus
YFHRRDLRLAANAIC

SEQ ID NO: 255119 - protein, 15 aa, Dengue virus
MVLAFITFLRVLSIP

SEQ ID NO: 255120 - protein, 15 aa, Dengue virus
TRGPSLRTTTASGKL

SEQ ID NO: 255121 - protein, 15 aa, Dengue virus
NDWDFVVTTDISEMG

SEQ ID NO: 255122 - protein, 15 aa, Dengue virus
PMSTYGWNLVKLMSG

SEQ ID NO: 255123 - protein, 15 aa, Dengue virus
KVRSNAALGAVFTDE

SEQ ID NO: 255124 - protein, 15 aa, Dengue virus
LLLAAYVMTGRSADL

SEQ ID NO: 255125 - protein, 15 aa, Dengue virus
GLNTFTNMEAQLIRQ

SEQ ID NO: 255126 - protein, 15 aa, Dengue virus
SKELKCGNGIFVADN

SEQ ID NO: 255127 - protein, 15 aa, Dengue virus
LGEDGCWYGMEIRPV

SEQ ID NO: 255128 - protein, 15 aa, Dengue virus
AQKRAAAGIMKNPTV

SEQ ID NO: 255129 - protein, 15 aa, Dengue virus
EQYKFQADSPKRLAT

SEQ ID NO: 255130 - protein, 15 aa, Dengue virus
HATFTMRLLSPVRVP

SEQ ID NO: 255131 - protein, 15 aa, Dengue virus
LTDGIYRILQRGLLG

SEQ ID NO: 255132 - protein, 15 aa, Dengue virus
CLRKNGKRVIQLSRK

SEQ ID NO: 255133 - protein, 15 aa, Dengue virus
VNGVVKLLTKPWDVV

SEQ ID NO: 255134 - protein, 15 aa, Dengue virus
SRTTWSIHATHEWMT

SEQ ID NO: 255135 - protein, 15 aa, Dengue virus
LPDTIETLMLLTLIA

SEQ ID NO: 255136 - protein, 15 aa, Dengue virus
RETACLGKAYAQMWS

SEQ ID NO: 255137 - protein, 15 aa, Dengue virus
RELKCGSGIFVTNEV

SEQ ID NO: 255138 - protein, 15 aa, Dengue virus
AVATTFITPMMRHTI

SEQ ID NO: 255139 - protein, 15 aa, Dengue virus
VIPMVTQMAMTDTTP

SEQ ID NO: 255140 - protein, 15 aa, Dengue virus
SAWTLYAVATTIITP

SEQ ID NO: 255141 - protein, 15 aa, Dengue virus
PMLRHSIENSSVNVS

SEQ ID NO: 255142 - protein, 15 aa, Dengue virus
GIMAVGMVSILASAL

SEQ ID NO: 255143 - protein, 15 aa, Dengue virus
NRGPSLRTTTASGKL

SEQ ID NO: 255144 - protein, 15 aa, Dengue virus
DTIETLMLLTLLATV

SEQ ID NO: 255145 - protein, 15 aa, Dengue virus
LVHRQWFLDLPLPWL

SEQ ID NO: 255146 - protein, 15 aa, Dengue virus
AGPLVAGGLLIACYV

SEQ ID NO: 255147 - protein, 15 aa, Dengue virus
YKFQPESPARLATAI

SEQ ID NO: 255148 - protein, 15 aa, Dengue virus
QQVPFCSHHFHELVM

SEQ ID NO: 255149 - protein, 15 aa, Dengue virus
TANISLTAIANQATV

SEQ ID NO: 255150 - protein, 15 aa, Dengue virus
SLNTFTNMEAQLIRQ

SEQ ID NO: 255151 - protein, 15 aa, Dengue virus
LRPRWLDARVYSDPL

SEQ ID NO: 255152 - protein, 15 aa, Dengue virus
TTEDMLSVWNRVWIR

SEQ ID NO: 255153 - protein, 15 aa, Dengue virus
DMGYWIESRLNDTWK

SEQ ID NO: 255154 - protein, 15 aa, Dengue virus
MINGVVRLLTKPWDV

SEQ ID NO: 255155 - protein, 15 aa, Dengue virus
KRSVALTPHSGMGLD

SEQ ID NO: 255156 - protein, 15 aa, Dengue virus
KFQADSPKRLATAIA

SEQ ID NO: 255157 - protein, 15 aa, Dengue virus
ANISLAAIANQATVL

SEQ ID NO: 255158 - protein, 15 aa, Dengue virus
AIDGEYRLKGEARKT

SEQ ID NO: 255159 - protein, 15 aa, Dengue virus
MFKKKNLTIMDLHPG

SEQ ID NO: 255160 - protein, 15 aa, Dengue virus
VNMTSKMLLNRFTMA

SEQ ID NO: 255161 - protein, 15 aa, Dengue virus
VTTMAQGKPTLDIEL

SEQ ID NO: 255162 - protein, 15 aa, Dengue virus
LMRTSWAFCEALTLA

SEQ ID NO: 255163 - protein, 15 aa, Dengue virus
MGYWIESALNDTWKM

SEQ ID NO: 255164 - protein, 15 aa, Dengue virus
VLCVTQVLLMRTTWA

SEQ ID NO: 255165 - protein, 15 aa, Dengue virus
VAAEMEEALRGLPIR

SEQ ID NO: 255166 - protein, 15 aa, Dengue virus
RHAVSRGSAKLQWIV

SEQ ID NO: 255167 - protein, 15 aa, Dengue virus
DVDLRPASAWTLYAV

SEQ ID NO: 255168 - protein, 15 aa, Dengue virus
HEMYWVSCGTGNIVS

SEQ ID NO: 255169 - protein, 15 aa, Dengue virus
GWPIHRVDLGVPLLA

SEQ ID NO: 255170 - protein, 15 aa, Dengue virus
FTRKVRSNAAIGAVF

SEQ ID NO: 255171 - protein, 15 aa, Dengue virus
EAHFTDPSSIAARGY

SEQ ID NO: 255172 - protein, 15 aa, Dengue virus
VCGVRSTTRLENLLW

SEQ ID NO: 255173 - protein, 15 aa, Dengue virus
NGSWKLARASFIEVK

SEQ ID NO: 255174 - protein, 15 aa, Dengue virus
VLMGLGRGWPLHRVD

SEQ ID NO: 255175 - protein, 15 aa, Dengue virus
HYAIIGPGLQAKATR

SEQ ID NO: 255176 - protein, 15 aa, Dengue virus
NYNLIIMDEAHFTDP

SEQ ID NO: 255177 - protein, 15 aa, Dengue virus
WVPTSRTTWSIHAHH

SEQ ID NO: 255178 - protein, 15 aa, Dengue virus
RTEQYQFQADSPKRL

SEQ ID NO: 255179 - protein, 15 aa, Dengue virus
LVSILLSSLLRNDVP

SEQ ID NO: 255180 - protein, 15 aa, Dengue virus
WTEVPFCSHHFHKIF

SEQ ID NO: 255181 - protein, 15 aa, Dengue virus
RHSIENSSVNVSLTA

SEQ ID NO: 255182 - protein, 15 aa, Dengue virus
CGSGIFVVDNVHTRT

SEQ ID NO: 255183 - protein, 15 aa, Dengue virus
LALGCYSQVNPLTLT

SEQ ID NO: 255184 - protein, 15 aa, Dengue virus
RGEARKTFVELMKRG

SEQ ID NO: 255185 - protein, 15 aa, Dengue virus
WSIHATHQWMTTEDM

SEQ ID NO: 255186 - protein, 15 aa, Dengue virus
EPSWASVKKDLISYG

SEQ ID NO: 255187 - protein, 15 aa, Dengue virus
SRGSAKLRWFVERNL

SEQ ID NO: 255188 - protein, 15 aa, Dengue virus
KKVIQLSRKTFDTEY

SEQ ID NO: 255189 - protein, 15 aa, Dengue virus
IVASVNTTSRLLINR

SEQ ID NO: 255190 - protein, 15 aa, Dengue virus
FHKIFMKDGREIVVP

SEQ ID NO: 255191 - protein, 15 aa, Dengue virus
TTMAQGKPTLDIELL

SEQ ID NO: 255192 - protein, 15 aa, Dengue virus
MLIACYVITGTSADL

SEQ ID NO: 255193 - protein, 15 aa, Dengue virus
SGIFVTDNVHTWTEQ

SEQ ID NO: 255194 - protein, 15 aa, Dengue virus
VGLYGNGVVTKSGTY

SEQ ID NO: 255195 - protein, 15 aa, Dengue virus
LVKRFSTGLLNGKGP

SEQ ID NO: 255196 - protein, 15 aa, Dengue virus
HEMYWISNGTGNIVA

SEQ ID NO: 255197 - protein, 15 aa, Dengue virus
VVASEMAEALKGLPI

SEQ ID NO: 255198 - protein, 15 aa, Dengue virus
LTKPWDVIPMVTQMA

SEQ ID NO: 255199 - protein, 15 aa, Dengue virus
MEEALRGLPIRYQTP

SEQ ID NO: 255200 - protein, 15 aa, Dengue virus
DGIYRILQRGLLGKT

SEQ ID NO: 255201 - protein, 15 aa, Dengue virus
KKLRPRWLDARIYSD

SEQ ID NO: 255202 - protein, 15 aa, Dengue virus
RIKQKGIFGKTQVGV

SEQ ID NO: 255203 - protein, 15 aa, Dengue virus
RGTAKLRWIVERGMV

SEQ ID NO: 255204 - protein, 15 aa, Dengue virus
ILLMRTSWAFCEVLT

SEQ ID NO: 255205 - protein, 15 aa, Dengue virus
SGNDIANCLRKSGKK

SEQ ID NO: 255206 - protein, 15 aa, Dengue virus
ELPDTIETLMLLTLL

SEQ ID NO: 255207 - protein, 15 aa, Dengue virus
EARKTFVELMKRGDL

SEQ ID NO: 255208 - protein, 15 aa, Dengue virus
GVPLLAIGCYSQVNP

SEQ ID NO: 255209 - protein, 15 aa, Dengue virus
QVGVGIHMENVFHTM

SEQ ID NO: 255210 - protein, 15 aa, Dengue virus
TEQYQFQPESPARVA

SEQ ID NO: 255211 - protein, 15 aa, Dengue virus
LMYFHRRDLRLASMA

SEQ ID NO: 255212 - protein, 15 aa, Dengue virus
YYMATLKNVREVKGL

SEQ ID NO: 255213 - protein, 15 aa, Dengue virus
YCAGLKKVTEVKGYT

SEQ ID NO: 255214 - protein, 15 aa, Dengue virus
MVAGGLLLAAYVMTG

SEQ ID NO: 255215 - protein, 15 aa, Dengue virus
EMAEALKGMPIRYQT

SEQ ID NO: 255216 - protein, 15 aa, Dengue virus
KQDVVVLGSQEGAMH

SEQ ID NO: 255217 - protein, 15 aa, Dengue virus
SIFKLTYQNKVVKVL

SEQ ID NO: 255218 - protein, 15 aa, Dengue virus
TVWFVPSIKTGNDIA

SEQ ID NO: 255219 - protein, 15 aa, Dengue virus
KFQPESPSRLSAAIG

SEQ ID NO: 255220 - protein, 15 aa, Dengue virus
KSYAQMWTLMYFHRR

SEQ ID NO: 255221 - protein, 15 aa, Dengue virus
SHHFHELIMKDGRSL

SEQ ID NO: 255222 - protein, 15 aa, Dengue virus
SWVDLVLEHGGCVTT

SEQ ID NO: 255223 - protein, 15 aa, Dengue virus
DWQQVPFCSHHFHEL

SEQ ID NO: 255224 - protein, 15 aa, Dengue virus
HADMGYWIESALNDT

SEQ ID NO: 255225 - protein, 15 aa, Dengue virus
GANFKAERVIDPRRC

SEQ ID NO: 255226 - protein, 15 aa, Dengue virus
FGAAYTALFGGVSWM

SEQ ID NO: 255227 - protein, 15 aa, Dengue virus
ANQAVVLMGLGRGWP

SEQ ID NO: 255228 - protein, 15 aa, Dengue virus
VPNYNMVIMDEAHFT

SEQ ID NO: 255229 - protein, 15 aa, Dengue virus
TLTILLKATLLAVSG

SEQ ID NO: 255230 - protein, 15 aa, Dengue virus
SSMVNGVVRLLTKPW

SEQ ID NO: 255231 - protein, 15 aa, Dengue virus
ARFLEFEALGFLNED

SEQ ID NO: 255232 - protein, 15 aa, Dengue virus
RRLTIMDLHPGSGKT

SEQ ID NO: 255233 - protein, 15 aa, Dengue virus
TTEDMLKVWNRVWIQ

SEQ ID NO: 255234 - protein, 15 aa, Dengue virus
CGSLIGLTSRATWAQ

SEQ ID NO: 255235 - protein, 15 aa, Dengue virus
DGEYRLKGESRKTFV

SEQ ID NO: 255236 - protein, 15 aa, Dengue virus
HTIENSTANVSLAAI

SEQ ID NO: 255237 - protein, 15 aa, Dengue virus
VIGLYGNGVVTTSGT

SEQ ID NO: 255238 - protein, 15 aa, Dengue virus
SSVNMISRMLINRFT

SEQ ID NO: 255239 - protein, 15 aa, Dengue virus
REKRSVALTPHSGTG

SEQ ID NO: 255240 - protein, 15 aa, Dengue virus
LRFLAIPPTAGILAR

SEQ ID NO: 255241 - protein, 15 aa, Dengue virus
LPVWLAHKVAAEGIN

SEQ ID NO: 255242 - protein, 15 aa, Dengue virus
RREKRSVALAPHVGM

SEQ ID NO: 255243 - protein, 15 aa, Dengue virus
NIVSAVNMTSKMLLN

SEQ ID NO: 255244 - protein, 15 aa, Dengue virus
RYQTTAVKSEHTGKE

SEQ ID NO: 255245 - protein, 15 aa, Dengue virus
PKTHTLWSNGVLESD

SEQ ID NO: 255246 - protein, 15 aa, Dengue virus
NTDWDYVVTTDISEM

SEQ ID NO: 255247 - protein, 15 aa, Dengue virus
EEPIPMSTYGWNLVR

SEQ ID NO: 255248 - protein, 15 aa, Dengue virus
GRELKCGSGIFITDN

SEQ ID NO: 255249 - protein, 15 aa, Dengue virus
PLLAMGCYSQVNPTT

SEQ ID NO: 255250 - protein, 15 aa, Dengue virus
IHRMDLGVPLLALGC

SEQ ID NO: 255251 - protein, 15 aa, Dengue virus
RYLPAIVREALKRRL

SEQ ID NO: 255252 - protein, 15 aa, Dengue virus
CTLIAMDLGELCEDT

SEQ ID NO: 255253 - protein, 15 aa, Dengue virus
TEDMLKVWNRVWIQD

SEQ ID NO: 255254 - protein, 15 aa, Dengue virus
MRTSWAFCEVLTLAT

SEQ ID NO: 255255 - protein, 15 aa, Dengue virus
VALVPHVGMGLETRT

SEQ ID NO: 255256 - protein, 15 aa, Dengue virus
VVTTSGTYVSAIAQA

SEQ ID NO: 255257 - protein, 15 aa, Dengue virus
GEARKTFVELMRRGD

SEQ ID NO: 255258 - protein, 15 aa, Dengue virus
YNLVVMDEAHFTDPC

SEQ ID NO: 255259 - protein, 15 aa, Dengue virus
NVFHTMWHVTRGAVL

SEQ ID NO: 255260 - protein, 15 aa, Dengue virus
SNPTIEEGRTLRVLK

SEQ ID NO: 255261 - protein, 15 aa, Dengue virus
YRGAKRMAILGDTAW

SEQ ID NO: 255262 - protein, 15 aa, Dengue virus
TKRFSLGLLSGRGPL

SEQ ID NO: 255263 - protein, 15 aa, Dengue virus
VKRFSTGLLNGKGPL

SEQ ID NO: 255264 - protein, 15 aa, Dengue virus
GNGIFVADNVHTRTE

SEQ ID NO: 255265 - protein, 15 aa, Dengue virus
LRHSIENSSVNVSLT

SEQ ID NO: 255266 - protein, 15 aa, Dengue virus
VVGLYGNGVVTKSGD

SEQ ID NO: 255267 - protein, 15 aa, Dengue virus
REALKRRLRTLILAP

SEQ ID NO: 255268 - protein, 15 aa, Dengue virus
PSWASVKKDLISYGG

SEQ ID NO: 255269 - protein, 15 aa, Dengue virus
AGNDIAACLRKNGKR

SEQ ID NO: 255270 - protein, 15 aa, Dengue virus
TRKYLPAIIREAIKR

SEQ ID NO: 255271 - protein, 15 aa, Dengue virus
ACYVITGTSADLELE

SEQ ID NO: 255272 - protein, 15 aa, Dengue virus
DCWCNATSAWVMYGT

SEQ ID NO: 255273 - protein, 15 aa, Dengue virus
RVPNYNLIVMDEAHF

SEQ ID NO: 255274 - protein, 15 aa, Dengue virus
QVPFCSHHFHELIMK

SEQ ID NO: 255275 - protein, 15 aa, Dengue virus
LMSAAIKDQRAVHAD

SEQ ID NO: 255276 - protein, 15 aa, Dengue virus
LHPASAWTLYAVATT

SEQ ID NO: 255277 - protein, 15 aa, Dengue virus
LDARVYADPMALKDF

SEQ ID NO: 255278 - protein, 15 aa, Dengue virus
NCLRKSGKKVIQLSR

SEQ ID NO: 255279 - protein, 15 aa, Dengue virus
WMTTEDMLAVWNRVW

SEQ ID NO: 255280 - protein, 15 aa, Dengue virus
KRMAILGDTAWDFGS

SEQ ID NO: 255281 - protein, 15 aa, Dengue virus
GEQRKTFVDLMKRGD

SEQ ID NO: 255282 - protein, 15 aa, Dengue virus
NQAAILMGLGKGWPL

SEQ ID NO: 255283 - protein, 15 aa, Dengue virus
KCTLMAMDLGEMCDD

SEQ ID NO: 255284 - protein, 15 aa, Dengue virus
SYYCAGLKKVTEVKG

SEQ ID NO: 255285 - protein, 15 aa, Dengue virus
TAAGIMKNPTVDGIT

SEQ ID NO: 255286 - protein, 15 aa, Dengue virus
DFVEGVSGGAWVDVV

SEQ ID NO: 255287 - protein, 15 aa, Dengue virus
RHAVSRGSAKLRWIV

SEQ ID NO: 255288 - protein, 15 aa, Dengue virus
DPSSVAARGYISTRV

SEQ ID NO: 255289 - protein, 15 aa, Dengue virus
WPLHRMDIGVPLLAI

SEQ ID NO: 255290 - protein, 15 aa, Dengue virus
GGMLVRNPLSRNSTH

SEQ ID NO: 255291 - protein, 15 aa, Dengue virus
STANIFRGSYLAGAG

SEQ ID NO: 255292 - protein, 15 aa, Dengue virus
VSAVNMTSKMLLNRF

SEQ ID NO: 255293 - protein, 15 aa, Dengue virus
PSIKAGNDIAACLRK

SEQ ID NO: 255294 - protein, 15 aa, Dengue virus
GKCESCVYNMMGKRE

SEQ ID NO: 255295 - protein, 15 aa, Dengue virus
TVLMGLGKGWPISKV

SEQ ID NO: 255296 - protein, 15 aa, Dengue virus
DPSSIAARGYISTRV

SEQ ID NO: 255297 - protein, 15 aa, Dengue virus
GVVTRSGTYVSSIAQ

SEQ ID NO: 255298 - protein, 15 aa, Dengue virus
EKKKLRPKWLDARVY

SEQ ID NO: 255299 - protein, 15 aa, Dengue virus
GRELKCGSGIFVTNE

SEQ ID NO: 255300 - protein, 15 aa, Dengue virus
GVGNRDFVEGLSGAT

SEQ ID NO: 255301 - protein, 15 aa, Dengue virus
VLGSQEGAMRTALTG

SEQ ID NO: 255302 - protein, 15 aa, Dengue virus
REAIKRKLRTLVLAP

SEQ ID NO: 255303 - protein, 15 aa, Dengue virus
ERVILAGPMPVTVAS

SEQ ID NO: 255304 - protein, 15 aa, Dengue virus
CWCNATSAWVTYGTC

SEQ ID NO: 255305 - protein, 15 aa, Dengue virus
TDISEMGANFRADRV

SEQ ID NO: 255306 - protein, 15 aa, Dengue virus
TEVPFCSHHFHKIFM

SEQ ID NO: 255307 - protein, 15 aa, Dengue virus
NLIVMDEAHFTDPSS

SEQ ID NO: 255308 - protein, 15 aa, Dengue virus
RGMLQGQGPMKMVMA

SEQ ID NO: 255309 - protein, 15 aa, Dengue virus
IVSAVNMTSKMLLNR

SEQ ID NO: 255310 - protein, 15 aa, Dengue virus
VTTSGDYVSAIAQTE

SEQ ID NO: 255311 - protein, 15 aa, Dengue virus
MRTTWALCESITLAT

SEQ ID NO: 255312 - protein, 15 aa, Dengue virus
RWLDARVYSDPLALK

SEQ ID NO: 255313 - protein, 15 aa, Dengue virus
KTFVDLMRRGDLPVW

SEQ ID NO: 255314 - protein, 15 aa, Dengue virus
TEQYKFQPESPSRLS

SEQ ID NO: 255315 - protein, 15 aa, Dengue virus
EGVYRIKQRGILGRS

SEQ ID NO: 255316 - protein, 15 aa, Dengue virus
NMLKRVRNRVSTVQQ

SEQ ID NO: 255317 - protein, 15 aa, Dengue virus
TANISLTAIANQAVV

SEQ ID NO: 255318 - protein, 15 aa, Dengue virus
INGVVKLLTKPWDVL

SEQ ID NO: 255319 - protein, 15 aa, Dengue virus
IPPTAGILKRWGQLK

SEQ ID NO: 255320 - protein, 15 aa, Dengue virus
MALVAFLRFLAIPPT

SEQ ID NO: 255321 - protein, 15 aa, Dengue virus
GAYRIMQRGLFGYSQ

SEQ ID NO: 255322 - protein, 15 aa, Dengue virus
HHFHKIFMKDGREIV

SEQ ID NO: 255323 - protein, 15 aa, Dengue virus
RTTWSIHAKHQWMTT

SEQ ID NO: 255324 - protein, 15 aa, Dengue virus
SGIFITNNVHTWTEQ

SEQ ID NO: 255325 - protein, 15 aa, Dengue virus
TLILAPTRVVAAEME

SEQ ID NO: 255326 - protein, 15 aa, Dengue virus
YKTWAYHGSYETKQT

SEQ ID NO: 255327 - protein, 15 aa, Dengue virus
VPNYNLVVMDEAHFT

SEQ ID NO: 255328 - protein, 15 aa, Dengue virus
EYRLKGESRKTFVEL

SEQ ID NO: 255329 - protein, 15 aa, Dengue virus
IAVSTANIFRGSYLA

SEQ ID NO: 255330 - protein, 15 aa, Dengue virus
WLVHKQWFLDLPLPW

SEQ ID NO: 255331 - protein, 15 aa, Dengue virus
KVIQLSRKTFDSEYV

SEQ ID NO: 255332 - protein, 15 aa, Dengue virus
GWPIHRMDLGVPLLA

SEQ ID NO: 255333 - protein, 15 aa, Dengue virus
HEMYWVSGATGNIVS

SEQ ID NO: 255334 - protein, 15 aa, Dengue virus
EFGKAKGSRAIWYMW

SEQ ID NO: 255335 - protein, 15 aa, Dengue virus
DIAACLRKSGKRVIQ

SEQ ID NO: 255336 - protein, 15 aa, Dengue virus
RERNRVSTGSQLAKR

SEQ ID NO: 255337 - protein, 15 aa, Dengue virus
PMPVTHSSAAQRRGR

SEQ ID NO: 255338 - protein, 15 aa, Dengue virus
RGSAKLQWIVERGMI

SEQ ID NO: 255339 - protein, 15 aa, Dengue virus
ATLKNVREVKGLTKG

SEQ ID NO: 255340 - protein, 15 aa, Dengue virus
LDARVYSDPLALKEF

SEQ ID NO: 255341 - protein, 15 aa, Dengue virus
PMSTYGWNIVKLHSG

SEQ ID NO: 255342 - protein, 15 aa, Dengue virus
FCSHHFHELIMKDGR

SEQ ID NO: 255343 - protein, 15 aa, Dengue virus
PNPTIEESRTIRVLS

SEQ ID NO: 255344 - protein, 15 aa, Dengue virus
EEFTSKVRSNAALGA

SEQ ID NO: 255345 - protein, 15 aa, Dengue virus
NSTHEMYWISNGTGN

SEQ ID NO: 255346 - protein, 15 aa, Dengue virus
FPTSRTTWSIHAKHQ

SEQ ID NO: 255347 - protein, 15 aa, Dengue virus
STGLLNGKGPLRMVL

SEQ ID NO: 255348 - protein, 15 aa, Dengue virus
WTEQYKFQPESPSRL

SEQ ID NO: 255349 - protein, 15 aa, Dengue virus
EDYGFGIFTTNIWMK

SEQ ID NO: 255350 - protein, 15 aa, Dengue virus
AFCEVLTLATGPILT

SEQ ID NO: 255351 - protein, 15 aa, Dengue virus
MAEALKGMPIRYQTT

SEQ ID NO: 255352 - protein, 15 aa, Dengue virus
TRTEQYQFQPESPAR

SEQ ID NO: 255353 - protein, 15 aa, Dengue virus
KGKTVWFVPSIKAGN

SEQ ID NO: 255354 - protein, 15 aa, Dengue virus
IANQAVVLMGLGRGW

SEQ ID NO: 255355 - protein, 15 aa, Dengue virus
SLNTFTNMEVQLIRQ

SEQ ID NO: 255356 - protein, 15 aa, Dengue virus
VWFVPSIKSGNDIAN

SEQ ID NO: 255357 - protein, 15 aa, Dengue virus
SAYTALFSGVSWMIR

SEQ ID NO: 255358 - protein, 15 aa, Dengue virus
AQMWALMYFHRRDLR

SEQ ID NO: 255359 - protein, 15 aa, Dengue virus
SLLRNDVPLAGPLIA

SEQ ID NO: 255360 - protein, 15 aa, Dengue virus
LSLTAIANQAAILMG

SEQ ID NO: 255361 - protein, 15 aa, Dengue virus
PIPMATYGWNLVKLH

SEQ ID NO: 255362 - protein, 15 aa, Dengue virus
TGEIGAIALDFSPGT

SEQ ID NO: 255363 - protein, 15 aa, Dengue virus
LNDTWKIEKASFIEI

SEQ ID NO: 255364 - protein, 15 aa, Dengue virus
KRYLPAIVREALKRR

SEQ ID NO: 255365 - protein, 15 aa, Dengue virus
VILAGPMPVTASSAA

SEQ ID NO: 255366 - protein, 15 aa, Dengue virus
KFQPESPKRLSAAIG

SEQ ID NO: 255367 - protein, 15 aa, Dengue virus
CDSKLMSAAIKDQRA

SEQ ID NO: 255368 - protein, 15 aa, Dengue virus
SHHFHELVMKDGRKL

SEQ ID NO: 255369 - protein, 15 aa, Dengue virus
RVEMGEAAAIFMTAT

SEQ ID NO: 255370 - protein, 15 aa, Dengue virus
ANIFRGSYLAGAGLA

SEQ ID NO: 255371 - protein, 15 aa, Dengue virus
QEGAMRTALTGATEI

SEQ ID NO: 255372 - protein, 15 aa, Dengue virus
CGLFGKGGVVTCAKF

SEQ ID NO: 255373 - protein, 15 aa, Dengue virus
ARVYSDPLALKEFKE

SEQ ID NO: 255374 - protein, 15 aa, Dengue virus
WNRVWIRDNPNMTDK

SEQ ID NO: 255375 - protein, 15 aa, Dengue virus
RVGMGEAAAIFMTAT

SEQ ID NO: 255376 - protein, 15 aa, Dengue virus
WVDIVLEHGGCVTTM

SEQ ID NO: 255377 - protein, 15 aa, Dengue virus
VPMVTQLAMTDTTPF

SEQ ID NO: 255378 - protein, 15 aa, Dengue virus
ACLGKAYAQMWSLMY

SEQ ID NO: 255379 - protein, 15 aa, Dengue virus
GSSIGKMFEATARGA

SEQ ID NO: 255380 - protein, 15 aa, Dengue virus
KETACLGKSYAQMWT

SEQ ID NO: 255381 - protein, 15 aa, Dengue virus
GGNIYADDTAGWDTR

SEQ ID NO: 255382 - protein, 15 aa, Dengue virus
GMPIRYQTPAIRAEH

SEQ ID NO: 255383 - protein, 15 aa, Dengue virus
DARIYSDPLALREFK

SEQ ID NO: 255384 - protein, 15 aa, Dengue virus
RGEDGCWYGMEIRPL

SEQ ID NO: 255385 - protein, 15 aa, Dengue virus
TWKLEKASFIEVKTC

SEQ ID NO: 255386 - protein, 15 aa, Dengue virus
KFEKQLGQIMLLILC

SEQ ID NO: 255387 - protein, 15 aa, Dengue virus
EDYGFGMFTTNIWMK

SEQ ID NO: 255388 - protein, 15 aa, Dengue virus
GSRDFVEGVSGGSWV

SEQ ID NO: 255389 - protein, 15 aa, Dengue virus
KTHTLWSNGVLESDM

SEQ ID NO: 255390 - protein, 15 aa, Dengue virus
GWPLHRMDIGVPLLA

SEQ ID NO: 255391 - protein, 15 aa, Dengue virus
STRVGMGEAAAIFMT

SEQ ID NO: 255392 - protein, 15 aa, Dengue virus
EDHWFSRGNSLSGVE

SEQ ID NO: 255393 - protein, 15 aa, Dengue virus
DGICGIRSTTRLENL

SEQ ID NO: 255394 - protein, 15 aa, Dengue virus
KNDVPLAGPLIAGGM

SEQ ID NO: 255395 - protein, 15 aa, Dengue virus
PQDELIGRARISQGA

SEQ ID NO: 255396 - protein, 15 aa, Dengue virus
EALRGLPIRYQTPAV

SEQ ID NO: 255397 - protein, 15 aa, Dengue virus
GANFRAERVIDPRRC

SEQ ID NO: 255398 - protein, 15 aa, Dengue virus
RREKRSVALTPHSGT

SEQ ID NO: 255399 - protein, 15 aa, Dengue virus
GYWIESSKNQTWQIE

SEQ ID NO: 255400 - protein, 15 aa, Dengue virus
EEVQVLALEPGKNPK

SEQ ID NO: 255401 - protein, 15 aa, Dengue virus
KPRWLDARVYADPMA

SEQ ID NO: 255402 - protein, 15 aa, Dengue virus
GGWSYYCGGLKNVTE

SEQ ID NO: 255403 - protein, 15 aa, Dengue virus
KTKRYLPAIVREALK

SEQ ID NO: 255404 - protein, 15 aa, Dengue virus
YRLRGEARKTFVELM

SEQ ID NO: 255405 - protein, 15 aa, Dengue virus
MWQLMYFHRRDLRLA

SEQ ID NO: 255406 - protein, 15 aa, Dengue virus
TLYAVATTIVTPMLR

SEQ ID NO: 255407 - protein, 15 aa, Dengue virus
REAIKRGLRTLILAP

SEQ ID NO: 255408 - protein, 15 aa, Dengue virus
GAIALDFSPGTSGSP

SEQ ID NO: 255409 - protein, 15 aa, Dengue virus
QFQADSPKRLASAIQ

SEQ ID NO: 255410 - protein, 15 aa, Dengue virus
LKCGSGIFITNNVHT

SEQ ID NO: 255411 - protein, 15 aa, Dengue virus
AIANQAVVLMGLGKG

SEQ ID NO: 255412 - protein, 15 aa, Dengue virus
KAGNDIAACLRKNGK

SEQ ID NO: 255413 - protein, 15 aa, Dengue virus
NYNLIVMDEAHFTDP

SEQ ID NO: 255414 - protein, 15 aa, Dengue virus
VPLLAIGCYSQVNPI

SEQ ID NO: 255415 - protein, 15 aa, Dengue virus
PAIIREAIKRKLRTL

SEQ ID NO: 255416 - protein, 15 aa, Dengue virus
NGVVTTSGTYVSAIA

SEQ ID NO: 255417 - protein, 15 aa, Dengue virus
SPNPTIEAGRTLRVL

SEQ ID NO: 255418 - protein, 15 aa, Dengue virus
NTTANISLTAIANQA

SEQ ID NO: 255419 - protein, 15 aa, Dengue virus
SASSMVNGVVKLLTK

SEQ ID NO: 255420 - protein, 15 aa, Dengue virus
KHAVSRGSSKLRWFV

SEQ ID NO: 255421 - protein, 15 aa, Dengue virus
CGSLIGLSSRATWAQ

SEQ ID NO: 255422 - protein, 15 aa, Dengue virus
IAACLRKNGKRVIQL

SEQ ID NO: 255423 - protein, 15 aa, Dengue virus
LAIGCYSQVNPITLT

SEQ ID NO: 255424 - protein, 15 aa, Dengue virus
LQWIASAIVLEFFMM

SEQ ID NO: 255425 - protein, 15 aa, Dengue virus
WTLMYFHRRDLRLAS

SEQ ID NO: 255426 - protein, 15 aa, Dengue virus
NPGRFWNTTIAVSMA

SEQ ID NO: 255427 - protein, 15 aa, Dengue virus
QWIASAIVLEFFLMV

SEQ ID NO: 255428 - protein, 15 aa, Dengue virus
LRHTIENSTANVSLA

SEQ ID NO: 255429 - protein, 15 aa, Dengue virus
YVMTGRSADLELERA

SEQ ID NO: 255430 - protein, 15 aa, Dengue virus
NGVVKLLTKPWDVLP

SEQ ID NO: 255431 - protein, 15 aa, Dengue virus
LSGRGPLKLFMAFVA

SEQ ID NO: 255432 - protein, 15 aa, Dengue virus
NSSVNVSLTAIANQA

SEQ ID NO: 255433 - protein, 15 aa, Dengue virus
GPLRMVLAFITFLRV

SEQ ID NO: 255434 - protein, 15 aa, Dengue virus
LNDWDYVVTTDISEM

SEQ ID NO: 255435 - protein, 15 aa, Dengue virus
DVVLEHGSCVTTMAQ

SEQ ID NO: 255436 - protein, 15 aa, Dengue virus
TKAEFCKKVRSNAAM

SEQ ID NO: 255437 - protein, 15 aa, Dengue virus
SSMINGVVKLLTKPW

SEQ ID NO: 255438 - protein, 15 aa, Dengue virus
CEVLTLATGPILTLW

SEQ ID NO: 255439 - protein, 15 aa, Dengue virus
PLRMVLAFITFLRVL

SEQ ID NO: 255440 - protein, 15 aa, Dengue virus
HRMDLGVPLLALGCY

SEQ ID NO: 255441 - protein, 15 aa, Dengue virus
TTANISLTAIANQAV

SEQ ID NO: 255442 - protein, 15 aa, Dengue virus
RARVSQGAGWSLKET

SEQ ID NO: 255443 - protein, 15 aa, Dengue virus
EAIKRGLRTLILAPT

SEQ ID NO: 255444 - protein, 15 aa, Dengue virus
AARGYISTRVEMGEA

SEQ ID NO: 255445 - protein, 15 aa, Dengue virus
LGLLSGRGPLKLFMA

SEQ ID NO: 255446 - protein, 15 aa, Dengue virus
TTFITPMMRHTIENT

SEQ ID NO: 255447 - protein, 15 aa, Dengue virus
LTAIANQAAILMGLG

SEQ ID NO: 255448 - protein, 15 aa, Dengue virus
IFRGSYLAGAGLLFS

SEQ ID NO: 255449 - protein, 15 aa, Dengue virus
SYYCGGLKNVKEVRG

SEQ ID NO: 255450 - protein, 15 aa, Dengue virus
VNMVSRMLLNRFTMT

SEQ ID NO: 255451 - protein, 15 aa, Dengue virus
NVSLTAIANQAAVLM

SEQ ID NO: 255452 - protein, 15 aa, Dengue virus
HGSCVTTMAKNKPTL

SEQ ID NO: 255453 - protein, 15 aa, Dengue virus
GPILTLWEGNPGRFW

SEQ ID NO: 255454 - protein, 15 aa, Dengue virus
ASHEWMTTEDMLAVW

SEQ ID NO: 255455 - protein, 15 aa, Dengue virus
RKYLPAIVREAIKRK

SEQ ID NO: 255456 - protein, 15 aa, Dengue virus
RWLDARIYSDPLALR

SEQ ID NO: 255457 - protein, 15 aa, Dengue virus
PLLALGCYSQVNPLT

SEQ ID NO: 255458 - protein, 15 aa, Dengue virus
LNTFTNMEAQLIRQM

SEQ ID NO: 255459 - protein, 15 aa, Dengue virus
ALKRRLRTLILAPTR

SEQ ID NO: 255460 - protein, 15 aa, Dengue virus
RFLEFEALGFMNEDH

SEQ ID NO: 255461 - protein, 15 aa, Dengue virus
SANLSLAAIANQAAI

SEQ ID NO: 255462 - protein, 15 aa, Dengue virus
SLAAIANQAVVLMGL

SEQ ID NO: 255463 - protein, 15 aa, Dengue virus
GYSQIGAGVYKEGVF

SEQ ID NO: 255464 - protein, 15 aa, Dengue virus
TEQYKFQPESPARLA

SEQ ID NO: 255465 - protein, 15 aa, Dengue virus
TIEEGRTLRVLKMVE

SEQ ID NO: 255466 - protein, 15 aa, Dengue virus
AYRIMQRGLFGYSQI

SEQ ID NO: 255467 - protein, 15 aa, Dengue virus
TANIFRGSYLAGAGL

SEQ ID NO: 255468 - protein, 15 aa, Dengue virus
AIKRKLRTLILAPTR

SEQ ID NO: 255469 - protein, 15 aa, Dengue virus
DWTEVPFCSHHFHKI

SEQ ID NO: 255470 - protein, 15 aa, Dengue virus
KRSVALAPHVGLGLD

SEQ ID NO: 255471 - protein, 15 aa, Dengue virus
IANQAAILMGLDKGW

SEQ ID NO: 255472 - protein, 15 aa, Dengue virus
ARISQGAGWSLKETA

SEQ ID NO: 255473 - protein, 15 aa, Dengue virus
GLPIRYQTPAVKSEH

SEQ ID NO: 255474 - protein, 15 aa, Dengue virus
MSAAVKDQRAVHADM

SEQ ID NO: 255475 - protein, 15 aa, Dengue virus
LVKRFSSELLSGRGP

SEQ ID NO: 255476 - protein, 15 aa, Dengue virus
SSPNPTIEESRTIRV

SEQ ID NO: 255477 - protein, 15 aa, Dengue virus
MAFIAFLRFLTIPPT

SEQ ID NO: 255478 - protein, 15 aa, Dengue virus
LMGLGRGWPLHRVDL

SEQ ID NO: 255479 - protein, 15 aa, Dengue virus
EAVMAVGVVSILASS

SEQ ID NO: 255480 - protein, 15 aa, Dengue virus
MPVTAASAAQRRGRI

SEQ ID NO: 255481 - protein, 15 aa, Dengue virus
GAKRMAILGETAWDF

SEQ ID NO: 255482 - protein, 15 aa, Dengue virus
KETLVTFKNPHAKRQ

SEQ ID NO: 255483 - protein, 15 aa, Dengue virus
LVAGGLLIACYVITG

SEQ ID NO: 255484 - protein, 15 aa, Dengue virus
VDLMCHATFTTRLLS

SEQ ID NO: 255485 - protein, 15 aa, Dengue virus
NDWDYVVTTDISEMG

SEQ ID NO: 255486 - protein, 15 aa, Dengue virus
CTKAEFCKKVRSNAA

SEQ ID NO: 255487 - protein, 15 aa, Dengue virus
VWFVPSIKAGNDIAN

SEQ ID NO: 255488 - protein, 15 aa, Dengue virus
LMKRGDLPVWLAYRV

SEQ ID NO: 255489 - protein, 15 aa, Dengue virus
DHHAVSRGSAKLRWF

SEQ ID NO: 255490 - protein, 15 aa, Dengue virus
NDIPMTGPLVAGGLL

SEQ ID NO: 255491 - protein, 15 aa, Dengue virus
SQLAKRFSRGMLQGQ

SEQ ID NO: 255492 - protein, 15 aa, Dengue virus
GNIVASVNTTSRLLL

SEQ ID NO: 255493 - protein, 15 aa, Dengue virus
RGYISTRVGMGEAAA

SEQ ID NO: 255494 - protein, 15 aa, Dengue virus
PIRYQTPAVKSEHTG

SEQ ID NO: 255495 - protein, 15 aa, Dengue virus
QGKCATCVYNMMGKR

SEQ ID NO: 255496 - protein, 15 aa, Dengue virus
KRGLRTLILAPTRVV

SEQ ID NO: 255497 - protein, 15 aa, Dengue virus
RLNDTWKIEKASFIE

SEQ ID NO: 255498 - protein, 15 aa, Dengue virus
NKCTLMAMDLGEMCD

SEQ ID NO: 255499 - protein, 15 aa, Dengue virus
LAPTRVVASEMAEAL

SEQ ID NO: 255500 - protein, 15 aa, Dengue virus
SNASGNIVSSVNMIS

SEQ ID NO: 255501 - protein, 15 aa, Dengue virus
TRTEQYKFQPESPAR

SEQ ID NO: 255502 - protein, 15 aa, Dengue virus
KTFVDLMKRGDLPVW

SEQ ID NO: 255503 - protein, 15 aa, Dengue virus
IAARGYISTRVGMGE

SEQ ID NO: 255504 - protein, 15 aa, Dengue virus
AYTALFSGVSWMIRI

SEQ ID NO: 255505 - protein, 15 aa, Dengue virus
GCGLFGKGSLITCAK

SEQ ID NO: 255506 - protein, 15 aa, Dengue virus
GPERVILAGPMPVTA

SEQ ID NO: 255507 - protein, 15 aa, Dengue virus
KPVILTDGPERVILA

SEQ ID NO: 255508 - protein, 15 aa, Dengue virus
VLMGLGKGWPLSKMD

SEQ ID NO: 255509 - protein, 15 aa, Dengue virus
ALCEALTLATGPITT

SEQ ID NO: 255510 - protein, 15 aa, Dengue virus
HHAVSRGSAKLRWFV

SEQ ID NO: 255511 - protein, 15 aa, Dengue virus
EFCKKVRSNAAMGAV

SEQ ID NO: 255512 - protein, 15 aa, Dengue virus
IANCLRKSGKKVIQL

SEQ ID NO: 255513 - protein, 15 aa, Dengue virus
TWAYHGSYEVKPTGS

SEQ ID NO: 255514 - protein, 15 aa, Dengue virus
YAIIGPGLQAKATRE

SEQ ID NO: 255515 - protein, 15 aa, Dengue virus
DVPLAGPMVAGGLLL

SEQ ID NO: 255516 - protein, 15 aa, Dengue virus
AGHLKCRLKMDKLTL

SEQ ID NO: 255517 - protein, 15 aa, Dengue virus
EDHWFSRENSLSGVE

SEQ ID NO: 255518 - protein, 15 aa, Dengue virus
KVVGLYGNGVVTKNG

SEQ ID NO: 255519 - protein, 15 aa, Dengue virus
LKRERNRVSTGSQLA

SEQ ID NO: 255520 - protein, 15 aa, Dengue virus
VEAGRTLRVLSLVEN

SEQ ID NO: 255521 - protein, 15 aa, Dengue virus
GWNLVKLMSGKDVFY

SEQ ID NO: 255522 - protein, 15 aa, Dengue virus
LRTLILAPTRVVASE

SEQ ID NO: 255523 - protein, 15 aa, Dengue virus
PESPSRLSAAIGKAW

SEQ ID NO: 255524 - protein, 15 aa, Dengue virus
CGSGIFVVDNVHTWT

SEQ ID NO: 255525 - protein, 15 aa, Dengue virus
EAGRTLRVLNLVENW

SEQ ID NO: 255526 - protein, 15 aa, Dengue virus
CDHRLMSAAIKDSKA

SEQ ID NO: 255527 - protein, 15 aa, Dengue virus
ATVLMGLGRGWPLHR

SEQ ID NO: 255528 - protein, 15 aa, Dengue virus
KCGSGIFVTDNVHTW

SEQ ID NO: 255529 - protein, 15 aa, Dengue virus
ETLMLLTLLATVTGG

SEQ ID NO: 255530 - protein, 15 aa, Dengue virus
SGVSGNIVSSVNTIS

SEQ ID NO: 255531 - protein, 15 aa, Dengue virus
WLVHRQWFLNLPLPW

SEQ ID NO: 255532 - protein, 15 aa, Dengue virus
FAGHLKCRLKMDKLT

SEQ ID NO: 255533 - protein, 15 aa, Dengue virus
HVGMGLETRAQTWMS

SEQ ID NO: 255534 - protein, 15 aa, Dengue virus
RSVALTPHSGMGLDT

SEQ ID NO: 255535 - protein, 15 aa, Dengue virus
CLRKSGKRVIQLSRK

SEQ ID NO: 255536 - protein, 15 aa, Dengue virus
NGVVKLLTKPWDVIP

SEQ ID NO: 255537 - protein, 15 aa, Dengue virus
GGALVRCPLSRNSTH

SEQ ID NO: 255538 - protein, 15 aa, Dengue virus
LAAIANQAVVLMGLG

SEQ ID NO: 255539 - protein, 15 aa, Dengue virus
RLTIMDLHPGAGKTK

SEQ ID NO: 255540 - protein, 15 aa, Dengue virus
NVKKDLISYGGGWRF

SEQ ID NO: 255541 - protein, 15 aa, Dengue virus
QFCIKILNPYMPSVV

SEQ ID NO: 255542 - protein, 15 aa, Dengue virus
FHTMWHVTRGAVLMH

SEQ ID NO: 255543 - protein, 15 aa, Dengue virus
LRETACLGKAYAQMW

SEQ ID NO: 255544 - protein, 15 aa, Dengue virus
RTTWSIHASHEWMTT

SEQ ID NO: 255545 - protein, 15 aa, Dengue virus
YWVSNASGNIVSSVN

SEQ ID NO: 255546 - protein, 15 aa, Dengue virus
HHQWMTTEDMLTVWN

SEQ ID NO: 255547 - protein, 15 aa, Dengue virus
NGVVRLLTKPWDVVP

SEQ ID NO: 255548 - protein, 15 aa, Dengue virus
PMAGPLVAGGLLIAC

SEQ ID NO: 255549 - protein, 15 aa, Dengue virus
VLTLATGPVMTLWEG

SEQ ID NO: 255550 - protein, 15 aa, Dengue virus
ANLSLTAIANQAAIL

SEQ ID NO: 255551 - protein, 15 aa, Dengue virus
LAMGCYSQVNPTTLT

SEQ ID NO: 255552 - protein, 15 aa, Dengue virus
AFCESLTLATGPVLT

SEQ ID NO: 255553 - protein, 15 aa, Dengue virus
LPAIVREAIKRKLRT

SEQ ID NO: 255554 - protein, 15 aa, Dengue virus
GCYSQVNPITLTAAL

SEQ ID NO: 255555 - protein, 15 aa, Dengue virus
GQMFESTYRGAKRMA

SEQ ID NO: 255556 - protein, 15 aa, Dengue virus
STRVEMGEAAAIFMT

SEQ ID NO: 255557 - protein, 15 aa, Dengue virus
PMALKDFKEFASGRK

SEQ ID NO: 255558 - protein, 15 aa, Dengue virus
SLIGLTSRATWAQNI

SEQ ID NO: 255559 - protein, 15 aa, Dengue virus
SMVNGVVKLLTKPWD

SEQ ID NO: 255560 - protein, 15 aa, Dengue virus
TSRTTWSIHATHEWM

SEQ ID NO: 255561 - protein, 15 aa, Dengue virus
SWPLNEAVMAVGVVS

SEQ ID NO: 255562 - protein, 15 aa, Dengue virus
CEALTLATGPITTLW

SEQ ID NO: 255563 - protein, 15 aa, Dengue virus
TFKTAHAKKQEVVVL

SEQ ID NO: 255564 - protein, 15 aa, Dengue virus
IHKMDLGVPLLALGC

SEQ ID NO: 255565 - protein, 15 aa, Dengue virus
TLETLLLLALLGAMT

SEQ ID NO: 255566 - protein, 15 aa, Dengue virus
LIVLLIPEPDRQRTP

SEQ ID NO: 255567 - protein, 15 aa, Dengue virus
KVDIGVPLLAMGCYS

SEQ ID NO: 255568 - protein, 15 aa, Dengue virus
SVNTISKMLINRFTM

SEQ ID NO: 255569 - protein, 15 aa, Dengue virus
GVMAVGLVSLLGSSL

SEQ ID NO: 255570 - protein, 15 aa, Dengue virus
ANQAAILMGLGKGWP

SEQ ID NO: 255571 - protein, 15 aa, Dengue virus
DVLPMVTQIAMTDTT

SEQ ID NO: 255572 - protein, 15 aa, Dengue virus
FQEGTFHTMWHVTRG

SEQ ID NO: 255573 - protein, 15 aa, Dengue virus
ANLSLAAIANQAAIL

SEQ ID NO: 255574 - protein, 15 aa, Dengue virus
SVALTPHSGTGLETR

SEQ ID NO: 255575 - protein, 15 aa, Dengue virus
RVPNYNLVVMDEAHF

SEQ ID NO: 255576 - protein, 15 aa, Dengue virus
TIAVSTANIFRGSYL

SEQ ID NO: 255577 - protein, 15 aa, Dengue virus
RKSGKRVIQLSRKTF

SEQ ID NO: 255578 - protein, 15 aa, Dengue virus
EKRSVALVPHVGMGL

SEQ ID NO: 255579 - protein, 15 aa, Dengue virus
VLCAVQLLLMRTSWA

SEQ ID NO: 255580 - protein, 15 aa, Dengue virus
SGKTRKYLPAIIREA

SEQ ID NO: 255581 - protein, 15 aa, Dengue virus
IVGLYGNGVVTRSGA

SEQ ID NO: 255582 - protein, 15 aa, Dengue virus
PQWIASAIILEFFLI

SEQ ID NO: 255583 - protein, 15 aa, Dengue virus
LGEFGKAKGSRAIWY

SEQ ID NO: 255584 - protein, 15 aa, Dengue virus
CTREEFIKKVRTNAA

SEQ ID NO: 255585 - protein, 15 aa, Dengue virus
ACYVITGRSADLELE

SEQ ID NO: 255586 - protein, 15 aa, Dengue virus
TFKNAHAKRQDVIVL

SEQ ID NO: 255587 - protein, 15 aa, Dengue virus
GWPLHRVDLGVPLLA

SEQ ID NO: 255588 - protein, 15 aa, Dengue virus
IRYQTPAIRAEHTGR

SEQ ID NO: 255589 - protein, 15 aa, Dengue virus
GLLSGRGPLKLFMAL

SEQ ID NO: 255590 - protein, 15 aa, Dengue virus
ANISLTAIANQAVVL

SEQ ID NO: 255591 - protein, 15 aa, Dengue virus
FLMVLLVPEPEKQRT

SEQ ID NO: 255592 - protein, 15 aa, Dengue virus
EMYWVSGVSGNIVSS

SEQ ID NO: 255593 - protein, 15 aa, Dengue virus
MKLVMAFIAFLRFLA

SEQ ID NO: 255594 - protein, 15 aa, Dengue virus
SLLGSSLLKNDVPLA

SEQ ID NO: 255595 - protein, 15 aa, Dengue virus
VGVGVFQEGTFHTMW

SEQ ID NO: 255596 - protein, 15 aa, Dengue virus
GARYLEFEALGFMNE

SEQ ID NO: 255597 - protein, 15 aa, Dengue virus
CGSLIGLSSRATWAK

SEQ ID NO: 255598 - protein, 15 aa, Dengue virus
RGPSLRTTTVSGKLI

SEQ ID NO: 255599 - protein, 15 aa, Dengue virus
GSGKTRKYLPAIVRE

SEQ ID NO: 255600 - protein, 15 aa, Dengue virus
YRIKQKGIFGKTQVG

SEQ ID NO: 255601 - protein, 15 aa, Dengue virus
EKKLGEFGKAKGSRA

SEQ ID NO: 255602 - protein, 15 aa, Dengue virus
TWTEQYKFQPESPSR

SEQ ID NO: 255603 - protein, 15 aa, Dengue virus
ANQAVVLMGLGKGWP

SEQ ID NO: 255604 - protein, 15 aa, Dengue virus
VLMGLGKGWPISKVD

SEQ ID NO: 255605 - protein, 15 aa, Dengue virus
SWSGVEGEGLHRLGY

SEQ ID NO: 255606 - protein, 15 aa, Dengue virus
TPQDNQLAYVVIGLL

SEQ ID NO: 255607 - protein, 15 aa, Dengue virus
SPNPTVEAGRTLRVL

SEQ ID NO: 255608 - protein, 15 aa, Dengue virus
SMANIFRGSYLAGAG

SEQ ID NO: 255609 - protein, 15 aa, Dengue virus
SGIFVIDNVHTRTEQ

SEQ ID NO: 255610 - protein, 15 aa, Dengue virus
GIMAIGIVSILASSL

SEQ ID NO: 255611 - protein, 15 aa, Dengue virus
TKHAVSRGSSKIRWF

SEQ ID NO: 255612 - protein, 15 aa, Dengue virus
EMYWISNGTGNIVAS

SEQ ID NO: 255613 - protein, 15 aa, Dengue virus
GVGVFQEGTFHTMWH

SEQ ID NO: 255614 - protein, 15 aa, Dengue virus
IFRGSYLAGAGLAFS

SEQ ID NO: 255615 - protein, 15 aa, Dengue virus
RFLAIPPTAGILKRW

SEQ ID NO: 255616 - protein, 15 aa, Dengue virus
LRTTTASGKLVTQWC

SEQ ID NO: 255617 - protein, 15 aa, Dengue virus
TNMEVQLIRQMEAEG

SEQ ID NO: 255618 - protein, 15 aa, Dengue virus
TVQQLTKRFSLGLLS

SEQ ID NO: 255619 - protein, 15 aa, Dengue virus
EMEEALKGMPIRYQT

SEQ ID NO: 255620 - protein, 15 aa, Dengue virus
WYGMEIRPINEKEEN

SEQ ID NO: 255621 - protein, 15 aa, Dengue virus
KRFSSELLSGRGPLK

SEQ ID NO: 255622 - protein, 15 aa, Dengue virus
IYDSKFEKQLGQVML

SEQ ID NO: 255623 - protein, 15 aa, Dengue virus
AVATTIVTPMLRHTI

SEQ ID NO: 255624 - protein, 15 aa, Dengue virus
VATTVLTPMLRHSIE

SEQ ID NO: 255625 - protein, 15 aa, Dengue virus
IPMVTQMAMTDTTPF

SEQ ID NO: 255626 - protein, 15 aa, Dengue virus
PWDVVPMVTQLAMTD

SEQ ID NO: 255627 - protein, 15 aa, Dengue virus
ATGNIVSSVNMVSRM

SEQ ID NO: 255628 - protein, 15 aa, Dengue virus
QVMLLVLCAVQLLLM

SEQ ID NO: 255629 - protein, 15 aa, Dengue virus
LKRRLRTLILAPTRV

SEQ ID NO: 255630 - protein, 15 aa, Dengue virus
GTFHTMWHVTRGAVL

SEQ ID NO: 255631 - protein, 15 aa, Dengue virus
QPESPSRLSAAIGKA

SEQ ID NO: 255632 - protein, 15 aa, Dengue virus
LQWIASAIVLEFFLM

SEQ ID NO: 255633 - protein, 15 aa, Dengue virus
GVVRLLTKPWDVVPM

SEQ ID NO: 255634 - protein, 15 aa, Dengue virus
TTWAFCEVLTLATGP

SEQ ID NO: 255635 - protein, 15 aa, Dengue virus
TRVGMGEAAAIFMTA

SEQ ID NO: 255636 - protein, 15 aa, Dengue virus
LRPRWLDARIYSDPL

SEQ ID NO: 255637 - protein, 15 aa, Dengue virus
GWNIVKLHSGKDVFF

SEQ ID NO: 255638 - protein, 15 aa, Dengue virus
PTSRTTWSIHAKHQW

SEQ ID NO: 255639 - protein, 15 aa, Dengue virus
GGAWVDLVLEHGGCV

SEQ ID NO: 255640 - protein, 15 aa, Dengue virus
SQEGAMHSALAGATE

SEQ ID NO: 255641 - protein, 15 aa, Dengue virus
EALKGLPIRYQTTAV

SEQ ID NO: 255642 - protein, 15 aa, Dengue virus
THEMYWISNGTGNIV

SEQ ID NO: 255643 - protein, 15 aa, Dengue virus
EKNETWKLEKASFIE

SEQ ID NO: 255644 - protein, 15 aa, Dengue virus
IHMENVFHTMWHVTR

SEQ ID NO: 255645 - protein, 15 aa, Dengue virus
DLWCGSLIGLSSRAT

SEQ ID NO: 255646 - protein, 15 aa, Dengue virus
EGAMHTALTGATEIQ

SEQ ID NO: 255647 - protein, 15 aa, Dengue virus
IACYVITGTSADLTV

SEQ ID NO: 255648 - protein, 15 aa, Dengue virus
STHEMYWISNGTGNI

SEQ ID NO: 255649 - protein, 15 aa, Dengue virus
MMRTTWALCESITLA

SEQ ID NO: 255650 - protein, 15 aa, Dengue virus
FQPESPKRLSAAIGK

SEQ ID NO: 255651 - protein, 15 aa, Dengue virus
LLMRTSWAFCEALTL

SEQ ID NO: 255652 - protein, 15 aa, Dengue virus
GKAYAQMWSLMYFHR

SEQ ID NO: 255653 - protein, 15 aa, Dengue virus
LFMGHLKCRLRMDKL

SEQ ID NO: 255654 - protein, 15 aa, Dengue virus
ARIYADPMALKDFKE

SEQ ID NO: 255655 - protein, 15 aa, Dengue virus
WQQVPFCSHHFHELI

SEQ ID NO: 255656 - protein, 15 aa, Dengue virus
ENPYKTWAYHGSYEV

SEQ ID NO: 255657 - protein, 15 aa, Dengue virus
INMLKRVRNRVSTVQ

SEQ ID NO: 255658 - protein, 15 aa, Dengue virus
AACLRKNGKRVIQLS

SEQ ID NO: 255659 - protein, 15 aa, Dengue virus
LLFLNDMGKVRKDIP

SEQ ID NO: 255660 - protein, 15 aa, Dengue virus
IFVADNVHTRTEQYQ

SEQ ID NO: 255661 - protein, 15 aa, Dengue virus
TGSASSMVNGVVKLL

SEQ ID NO: 255662 - protein, 15 aa, Dengue virus
RTTWSIHATHEWMTT

SEQ ID NO: 255663 - protein, 15 aa, Dengue virus
MSTYGWNIVKLHSGK

SEQ ID NO: 255664 - protein, 15 aa, Dengue virus
KRFSKGLFSGQGPMK

SEQ ID NO: 255665 - protein, 15 aa, Dengue virus
SLMYFHRRDLRLAAN

SEQ ID NO: 255666 - protein, 15 aa, Dengue virus
LIMKDGRSLVVPCRN

SEQ ID NO: 255667 - protein, 15 aa, Dengue virus
IFRKRRLTIMDLHPG

SEQ ID NO: 255668 - protein, 15 aa, Dengue virus
WPLSKMDLGVPLLAL

SEQ ID NO: 255669 - protein, 15 aa, Dengue virus
SQILLMRTTWAFCEV

SEQ ID NO: 255670 - protein, 15 aa, Dengue virus
LYAVATTFITPMLRH

SEQ ID NO: 255671 - protein, 15 aa, Dengue virus
KNETWKLEKASFIEV

SEQ ID NO: 255672 - protein, 15 aa, Dengue virus
HPGAGKTKRILPSIV

SEQ ID NO: 255673 - protein, 15 aa, Dengue virus
SLRTTTASGKLIHEW

SEQ ID NO: 255674 - protein, 15 aa, Dengue virus
QEGTFHTMWHVTRGA

SEQ ID NO: 255675 - protein, 15 aa, Dengue virus
VGLVSILLSSLLRND

SEQ ID NO: 255676 - protein, 15 aa, Dengue virus
ESLTLATGPVLTLWE

SEQ ID NO: 255677 - protein, 15 aa, Dengue virus
SSLLKNDVPLAGPMV

SEQ ID NO: 255678 - protein, 15 aa, Dengue virus
STHEMYWVSCGTGNI

SEQ ID NO: 255679 - protein, 15 aa, Dengue virus
TRVEMGEAAAIFMTA

SEQ ID NO: 255680 - protein, 15 aa, Dengue virus
LGRSQVGVGIHMENV

SEQ ID NO: 255681 - protein, 15 aa, Dengue virus
WNTTIAVSMANIFRG

SEQ ID NO: 255682 - protein, 15 aa, Dengue virus
FLTIPPTAGILARWS

SEQ ID NO: 255683 - protein, 15 aa, Dengue virus
HGGCVTTIAKNKPTL

SEQ ID NO: 255684 - protein, 15 aa, Dengue virus
PQGLVKRFSTGLLNG

SEQ ID NO: 255685 - protein, 15 aa, Dengue virus
KRSVALAPHVGMGLE

SEQ ID NO: 255686 - protein, 15 aa, Dengue virus
TVWFVPSIKAGNDIA

SEQ ID NO: 255687 - protein, 15 aa, Dengue virus
FCSHHFHKIFMKDGR

SEQ ID NO: 255688 - protein, 15 aa, Dengue virus
FEATARGARRMAILG

SEQ ID NO: 255689 - protein, 15 aa, Dengue virus
WTLYAVATTVLTPML

SEQ ID NO: 255690 - protein, 15 aa, Dengue virus
VDVVLEHGGCVTTMA

SEQ ID NO: 255691 - protein, 15 aa, Dengue virus
CYVITGTSADLTVEK

SEQ ID NO: 255692 - protein, 15 aa, Dengue virus
LMRTTWAFCEVLTLA

SEQ ID NO: 255693 - protein, 15 aa, Dengue virus
PMTGPLVAGGLLTVC

SEQ ID NO: 255694 - protein, 15 aa, Dengue virus
GSAYTALFSGVSWMI

SEQ ID NO: 255695 - protein, 15 aa, Dengue virus
PAMVREAIRRGLRTL

SEQ ID NO: 255696 - protein, 15 aa, Dengue virus
ISEMGANFRAERVID

SEQ ID NO: 255697 - protein, 15 aa, Dengue virus
SSLRTTTVSGKLIHE

SEQ ID NO: 255698 - protein, 15 aa, Dengue virus
KLMSAAIKDQRAVHA

SEQ ID NO: 255699 - protein, 15 aa, Dengue virus
PGSGKTRKYLPAIIR

SEQ ID NO: 255700 - protein, 15 aa, Dengue virus
RGPSLRTTTVTGKII

SEQ ID NO: 255701 - protein, 15 aa, Dengue virus
EFGRAKGSRAIWYMW

SEQ ID NO: 255702 - protein, 15 aa, Dengue virus
RILPSIVREAIKRGL

SEQ ID NO: 255703 - protein, 15 aa, Dengue virus
PIRVPNYNLVIMDEA

SEQ ID NO: 255704 - protein, 15 aa, Dengue virus
HAVSRGSAKLRWIVE

SEQ ID NO: 255705 - protein, 15 aa, Dengue virus
ETTMRGAKRMAILGD

SEQ ID NO: 255706 - protein, 15 aa, Dengue virus
RPASAWTLYAVATTV

SEQ ID NO: 255707 - protein, 15 aa, Dengue virus
LYGNGVVTTSGTYVS

SEQ ID NO: 255708 - protein, 15 aa, Dengue virus
VTQVLLMRTTWALCE

SEQ ID NO: 255709 - protein, 15 aa, Dengue virus
RMVTFKVPHAKKQDV

SEQ ID NO: 255710 - protein, 15 aa, Dengue virus
PVWLAHKVAAEGINY

SEQ ID NO: 255711 - protein, 15 aa, Dengue virus
EGSPGRFWNTTIAVS

SEQ ID NO: 255712 - protein, 15 aa, Dengue virus
HWFSRGNSLSGVEGE

SEQ ID NO: 255713 - protein, 15 aa, Dengue virus
ICGIRSTTRLENLMW

SEQ ID NO: 255714 - protein, 15 aa, Dengue virus
GIFVIDNVHTRTEQY

SEQ ID NO: 255715 - protein, 15 aa, Dengue virus
GKELKCGSGIFITDN

SEQ ID NO: 255716 - protein, 15 aa, Dengue virus
TTIVTPMLRHTIENS

SEQ ID NO: 255717 - protein, 15 aa, Dengue virus
EALTLATGPITTLWE

SEQ ID NO: 255718 - protein, 15 aa, Dengue virus
FHELIMKDGRSLVVP

SEQ ID NO: 255719 - protein, 15 aa, Dengue virus
TWLVHRQWFLDLPLP

SEQ ID NO: 255720 - protein, 15 aa, Dengue virus
QATVLMGLGKGWPIS

SEQ ID NO: 255721 - protein, 15 aa, Dengue virus
GNIYADDTAGWDTRI

SEQ ID NO: 255722 - protein, 15 aa, Dengue virus
LKRVRNRVSTVQQLT

SEQ ID NO: 255723 - protein, 15 aa, Dengue virus
WPIHRMDLGVPLLAL

SEQ ID NO: 255724 - protein, 15 aa, Dengue virus
RTLILAPTRVVAAEM

SEQ ID NO: 255725 - protein, 15 aa, Dengue virus
RARISQGAGWSLKET

SEQ ID NO: 255726 - protein, 15 aa, Dengue virus
IAARGYISTRVEMGE

SEQ ID NO: 255727 - protein, 15 aa, Dengue virus
RYLEFEALGFMNEDH

SEQ ID NO: 255728 - protein, 15 aa, Dengue virus
PDGPERVILAGPMPV

SEQ ID NO: 255729 - protein, 15 aa, Dengue virus
GSGIFITNNVHTWTE

SEQ ID NO: 255730 - protein, 15 aa, Dengue virus
DKRSVALVPHVGMGL

SEQ ID NO: 255731 - protein, 15 aa, Dengue virus
EKQLGQVMLLVLCAV

SEQ ID NO: 255732 - protein, 15 aa, Dengue virus
YKFQPESPSRLSAAI

SEQ ID NO: 255733 - protein, 15 aa, Dengue virus
KGWPLSKMDLGVPLL

SEQ ID NO: 255734 - protein, 15 aa, Dengue virus
FRGSYLAGAGLAFSL

SEQ ID NO: 255735 - protein, 15 aa, Dengue virus
GPMKMVMAFIAFLRF

SEQ ID NO: 255736 - protein, 15 aa, Dengue virus
TYGLNTFTNMEVQLI

SEQ ID NO: 255737 - protein, 15 aa, Dengue virus
LLMRTSWAFCEVLTL

SEQ ID NO: 255738 - protein, 15 aa, Dengue virus
LMGLGRGWPIHRVDL

SEQ ID NO: 255739 - protein, 15 aa, Dengue virus
KLRTLILAPTRVVAA

SEQ ID NO: 255740 - protein, 15 aa, Dengue virus
TEQYQFQADSPKRLA

SEQ ID NO: 255741 - protein, 15 aa, Dengue virus
TTDISEMGANFRADR

SEQ ID NO: 255742 - protein, 15 aa, Dengue virus
NTTANISLAAIANQA

SEQ ID NO: 255743 - protein, 15 aa, Dengue virus
ILMGLDKGWPLHRMD

SEQ ID NO: 255744 - protein, 15 aa, Dengue virus
VTRSGAYVSAIAQAK

SEQ ID NO: 255745 - protein, 15 aa, Dengue virus
DVRNDMISYGGGWKL

SEQ ID NO: 255746 - protein, 15 aa, Dengue virus
YSLNTFTNMEVQLIR

SEQ ID NO: 255747 - protein, 15 aa, Dengue virus
GKVVGLYGNGVVTKS

SEQ ID NO: 255748 - protein, 15 aa, Dengue virus
IGVPLLAMGCYSQVN

SEQ ID NO: 255749 - protein, 15 aa, Dengue virus
ETLVTFKNPHAKRQD

SEQ ID NO: 255750 - protein, 15 aa, Dengue virus
VLPMVTQIAMTDTTP

SEQ ID NO: 255751 - protein, 15 aa, Dengue virus
AAIANQAVVLMGLGR

SEQ ID NO: 255752 - protein, 15 aa, Dengue virus
SKVRSNAALGAIFQE

SEQ ID NO: 255753 - protein, 15 aa, Dengue virus
VAGGLLIACYVITGT

SEQ ID NO: 255754 - protein, 15 aa, Dengue virus
QVGTYGLNTFTNMEA

SEQ ID NO: 255755 - protein, 15 aa, Dengue virus
TMRGAKRMAILGDTA

SEQ ID NO: 255756 - protein, 15 aa, Dengue virus
FHQLIMKDGRVLVVP

SEQ ID NO: 255757 - protein, 15 aa, Dengue virus
RVILAGPMPVTHASA

SEQ ID NO: 255758 - protein, 15 aa, Dengue virus
WYGMEIRPLKEKEEN

SEQ ID NO: 255759 - protein, 15 aa, Dengue virus
MPVTHSSAAQRRGRI

SEQ ID NO: 255760 - protein, 15 aa, Dengue virus
ETACLGKSYAQMWQL

SEQ ID NO: 255761 - protein, 15 aa, Dengue virus
LCEVLTLATGPVMTL

SEQ ID NO: 255762 - protein, 15 aa, Dengue virus
FSRGMLQGQGPMKMV

SEQ ID NO: 255763 - protein, 15 aa, Dengue virus
AYNHALNELPESLET

SEQ ID NO: 255764 - protein, 15 aa, Dengue virus
SVYTTMFGGVSWVMK

SEQ ID NO: 255765 - protein, 15 aa, Dengue virus
TWSIHAKHQWMTTED

SEQ ID NO: 255766 - protein, 15 aa, Dengue virus
AHYAIIGPGLQAKAT

SEQ ID NO: 255767 - protein, 15 aa, Dengue virus
QVVTYSLNTFTNMEA

SEQ ID NO: 255768 - protein, 15 aa, Dengue virus
ERKKLRPRWLDARTY

SEQ ID NO: 255769 - protein, 15 aa, Dengue virus
MGANFRAERVIDPRR

SEQ ID NO: 255770 - protein, 15 aa, Dengue virus
SKLMSAAVKDQRAVH

SEQ ID NO: 255771 - protein, 15 aa, Dengue virus
IVSSVNMISRMLINR

SEQ ID NO: 255772 - protein, 15 aa, Dengue virus
FSKGLFSGQGPMKLV

SEQ ID NO: 255773 - protein, 15 aa, Dengue virus
NDVPLAGPLIAGGML

SEQ ID NO: 255774 - protein, 15 aa, Dengue virus
VVLGSQEGAMHSALT

SEQ ID NO: 255775 - protein, 15 aa, Dengue virus
KYAVSRGTSKIRWIV

SEQ ID NO: 255776 - protein, 15 aa, Dengue virus
ASSMVNGVVRLLTKP

SEQ ID NO: 255777 - protein, 15 aa, Dengue virus
AIIGPGLQAKATREA

SEQ ID NO: 255778 - protein, 15 aa, Dengue virus
QYVFMGEPLENDEDC

SEQ ID NO: 255779 - protein, 15 aa, Dengue virus
EVEDYGFGMFTTNIW

SEQ ID NO: 255780 - protein, 15 aa, Dengue virus
TSRTTWSIHAKHQWM

SEQ ID NO: 255781 - protein, 15 aa, Dengue virus
SPGKFWNTTIAVSTA

SEQ ID NO: 255782 - protein, 15 aa, Dengue virus
STYGWNLVKLMSGKD

SEQ ID NO: 255783 - protein, 15 aa, Dengue virus
IACYVITGTSADLEL

SEQ ID NO: 255784 - protein, 15 aa, Dengue virus
VGLYGNGVVTKSGDY

SEQ ID NO: 255785 - protein, 15 aa, Dengue virus
TEQYKFQADSPSKLA

SEQ ID NO: 255786 - protein, 15 aa, Dengue virus
SVNTTSKMLLNRFTT

SEQ ID NO: 255787 - protein, 15 aa, Dengue virus
AYHGSYEVKATGSAS

SEQ ID NO: 255788 - protein, 15 aa, Dengue virus
LPETLETLLLLALLG

SEQ ID NO: 255789 - protein, 15 aa, Dengue virus
FQPESPSRLSAAIGK

SEQ ID NO: 255790 - protein, 15 aa, Dengue virus
NRVSTVQQLTKRFSL

SEQ ID NO: 255791 - protein, 15 aa, Dengue virus
PIRYQTPAIRAEHTG

SEQ ID NO: 255792 - protein, 15 aa, Dengue virus
LYAVATTFITPMMRH

SEQ ID NO: 255793 - protein, 15 aa, Dengue virus
NGIFVADNVHTRTEQ

SEQ ID NO: 255794 - protein, 15 aa, Dengue virus
ERVVLAGPMPVTHSS

SEQ ID NO: 255795 - protein, 15 aa, Dengue virus
KHAVSRGTAKLQWFV

SEQ ID NO: 255796 - protein, 15 aa, Dengue virus
GIYRILQRGLLGKTQ

SEQ ID NO: 255797 - protein, 15 aa, Dengue virus
NLSLTAIANQAAILM

SEQ ID NO: 255798 - protein, 15 aa, Dengue virus
FIAFLRFLAIPPTAG

SEQ ID NO: 255799 - protein, 15 aa, Dengue virus
YISTRVEMGEAAGIF

SEQ ID NO: 255800 - protein, 15 aa, Dengue virus
GSGIFVIDNVHTRTE

SEQ ID NO: 255801 - protein, 15 aa, Dengue virus
RARNRVSTPQGLVKR

SEQ ID NO: 255802 - protein, 15 aa, Dengue virus
NPTIEESRTIRVLSL

SEQ ID NO: 255803 - protein, 15 aa, Dengue virus
TTWSIHATHQWMTTE

SEQ ID NO: 255804 - protein, 15 aa, Dengue virus
RKTFVELMRRGDLPV

SEQ ID NO: 255805 - protein, 15 aa, Dengue virus
LRKSGKKVIQLSRKT

SEQ ID NO: 255806 - protein, 15 aa, Dengue virus
VSLTAIANQAAVLMG

SEQ ID NO: 255807 - protein, 15 aa, Dengue virus
LVLEHGGCVTTIAKN

SEQ ID NO: 255808 - protein, 15 aa, Dengue virus
FTSKVRSNAALGAIF

SEQ ID NO: 255809 - protein, 15 aa, Dengue virus
KAYAQMWSLMYFHRR

SEQ ID NO: 255810 - protein, 15 aa, Dengue virus
KGSSIGKMFEATARG

SEQ ID NO: 255811 - protein, 15 aa, Dengue virus
MCHATFTMRLLSPVR

SEQ ID NO: 255812 - protein, 15 aa, Dengue virus
SQILLMRTSWAFCES

SEQ ID NO: 255813 - protein, 15 aa, Dengue virus
HTWTEQYKFQADSPS

SEQ ID NO: 255814 - protein, 15 aa, Dengue virus
TREEFTSKVRSNAAL

SEQ ID NO: 255815 - protein, 15 aa, Dengue virus
REEFTSKVRSNAALG

SEQ ID NO: 255816 - protein, 15 aa, Dengue virus
PESPARLATAIAGAW

SEQ ID NO: 255817 - protein, 15 aa, Dengue virus
SILLSSLLRNDVPLA

SEQ ID NO: 255818 - protein, 15 aa, Dengue virus
KRGDLPVWLAHKVAA

SEQ ID NO: 255819 - protein, 15 aa, Dengue virus
PASAWTLYAVATTII

SEQ ID NO: 255820 - protein, 15 aa, Dengue virus
GYISTRVEMGEAAGI

SEQ ID NO: 255821 - protein, 15 aa, Dengue virus
MPIRYQTTAVKSEHT

SEQ ID NO: 255822 - protein, 15 aa, Dengue virus
PGKFWNTTIAVSTAN

SEQ ID NO: 255823 - protein, 15 aa, Dengue virus
GEAAAIFMTATPPGS

SEQ ID NO: 255824 - protein, 15 aa, Dengue virus
GVYRIKQRGILGRSQ

SEQ ID NO: 255825 - protein, 15 aa, Dengue virus
EYRLRGEQRKTFVEL

SEQ ID NO: 255826 - protein, 15 aa, Dengue virus
FMALVAFLRFLAIPP

SEQ ID NO: 255827 - protein, 15 aa, Dengue virus
PMPVTVASAAQRRGR

SEQ ID NO: 255828 - protein, 15 aa, Dengue virus
AWMVHRQWFFDLPLP

SEQ ID NO: 255829 - protein, 15 aa, Dengue virus
QYQFQADSPKRLATA

SEQ ID NO: 255830 - protein, 15 aa, Dengue virus
KVRSNAALGAIFQEE

SEQ ID NO: 255831 - protein, 15 aa, Dengue virus
IFVIDNVHTRTEQYQ

SEQ ID NO: 255832 - protein, 15 aa, Dengue virus
QGAGWSLKETACLGK

SEQ ID NO: 255833 - protein, 15 aa, Dengue virus
DVPLAGPLIAGGMLI

SEQ ID NO: 255834 - protein, 15 aa, Dengue virus
AVNMTSKMLLNRFTM

SEQ ID NO: 255835 - protein, 15 aa, Dengue virus
TACLGKSYAQMWALM

SEQ ID NO: 255836 - protein, 15 aa, Dengue virus
KQEVVVLGSQEGAMH

SEQ ID NO: 255837 - protein, 15 aa, Dengue virus
VEDYGFGMFSTNIWL

SEQ ID NO: 255838 - protein, 15 aa, Dengue virus
VDIVLEHGGCVTTMA

SEQ ID NO: 255839 - protein, 15 aa, Dengue virus
RTQTWMSSEGAWKQI

SEQ ID NO: 255840 - protein, 15 aa, Dengue virus
EDYGFGIFTTNIWLK

SEQ ID NO: 255841 - protein, 15 aa, Dengue virus
GVVRLLTKPWDVLPM

SEQ ID NO: 255842 - protein, 15 aa, Dengue virus
RENSYSGVEGEGLHR

SEQ ID NO: 255843 - protein, 15 aa, Dengue virus
ALCESITLATGPLST

SEQ ID NO: 255844 - protein, 15 aa, Dengue virus
ISYDAKFEKQLGQIM

SEQ ID NO: 255845 - protein, 15 aa, Dengue virus
LGVPLLALGCYSQVN

SEQ ID NO: 255846 - protein, 15 aa, Dengue virus
SMINGVVKLLTKPWD

SEQ ID NO: 255847 - protein, 15 aa, Dengue virus
SCVYNMMGKREKKLG

SEQ ID NO: 255848 - protein, 15 aa, Dengue virus
KCETCVYNMMGKREK

SEQ ID NO: 255849 - protein, 15 aa, Dengue virus
GDLPVWLAYKVASEG

SEQ ID NO: 255850 - protein, 15 aa, Dengue virus
GLVSILLSSLLKNDV

SEQ ID NO: 255851 - protein, 15 aa, Dengue virus
DIGVPLLAMGCYSQV

SEQ ID NO: 255852 - protein, 15 aa, Dengue virus
LIALNDMGKIRKDIQ

SEQ ID NO: 255853 - protein, 15 aa, Dengue virus
LRMVLAFITFLRVLS

SEQ ID NO: 255854 - protein, 15 aa, Dengue virus
IDLRPASAWTLYAVA

SEQ ID NO: 255855 - protein, 15 aa, Dengue virus
EMGANFRAERVIDPR

SEQ ID NO: 255856 - protein, 15 aa, Dengue virus
LIMKDGRVLVVPCRP

SEQ ID NO: 255857 - protein, 15 aa, Dengue virus
SSIGKMLEATAKGAR

SEQ ID NO: 255858 - protein, 15 aa, Dengue virus
EVEDYGFGIFTTNIW

SEQ ID NO: 255859 - protein, 15 aa, Dengue virus
ATAKGARRMAILGDT

SEQ ID NO: 255860 - protein, 15 aa, Dengue virus
ASAWTLYAVATTFIT

SEQ ID NO: 255861 - protein, 15 aa, Dengue virus
LMRTSWAFCEVLTLA

SEQ ID NO: 255862 - protein, 15 aa, Dengue virus
SEKNETWKLEKASFI

SEQ ID NO: 255863 - protein, 15 aa, Dengue virus
RYLEFEALGFLNEDH

SEQ ID NO: 255864 - protein, 15 aa, Dengue virus
WPLNEAIMAVGLVSI

SEQ ID NO: 255865 - protein, 15 aa, Dengue virus
ETLMLVALIAVLTGG

SEQ ID NO: 255866 - protein, 15 aa, Dengue virus
TDGPERVILAGPIPV

SEQ ID NO: 255867 - protein, 15 aa, Dengue virus
AAVLMGLGKGWPLSK

SEQ ID NO: 255868 - protein, 15 aa, Dengue virus
VDGEYRLRGESRKTF

SEQ ID NO: 255869 - protein, 15 aa, Dengue virus
FLIVLLIPEPDRQRT

SEQ ID NO: 255870 - protein, 15 aa, Dengue virus
VSILLSSLLRNDVPL

SEQ ID NO: 255871 - protein, 15 aa, Dengue virus
LEPSWADVKNDMISY

SEQ ID NO: 255872 - protein, 15 aa, Dengue virus
PYDPKFEKQLGQVML

SEQ ID NO: 255873 - protein, 15 aa, Dengue virus
ARIYSDPLALREFKE

SEQ ID NO: 255874 - protein, 15 aa, Dengue virus
AIKDQRAVHADMGYW

SEQ ID NO: 255875 - protein, 15 aa, Dengue virus
FTGHLKCKVRMEKLR

SEQ ID NO: 255876 - protein, 15 aa, Dengue virus
WPISKMDIGVPLLAM

SEQ ID NO: 255877 - protein, 15 aa, Dengue virus
DLPVWLAYKVASEGI

SEQ ID NO: 255878 - protein, 15 aa, Dengue virus
YAVATTFITPMLRHS

SEQ ID NO: 255879 - protein, 15 aa, Dengue virus
TKPWDVVPMVTQLAM

SEQ ID NO: 255880 - protein, 15 aa, Dengue virus
TAIANQATVLMGLGK

SEQ ID NO: 255881 - protein, 15 aa, Dengue virus
DDQYVFMGEPLENDE

SEQ ID NO: 255882 - protein, 15 aa, Dengue virus
LVSILLSSLLKNDVP

SEQ ID NO: 255883 - protein, 15 aa, Dengue virus
TIENSTANVSLAAIA

SEQ ID NO: 255884 - protein, 15 aa, Dengue virus
IVDLMCHATFTTRLL

SEQ ID NO: 255885 - protein, 15 aa, Dengue virus
NEDHWFSRENSLSGV

SEQ ID NO: 255886 - protein, 15 aa, Dengue virus
QLLLMRTSWALCEVL

SEQ ID NO: 255887 - protein, 15 aa, Dengue virus
YNLVIMDEAHFTDPC

SEQ ID NO: 255888 - protein, 15 aa, Dengue virus
TFHTMWHVTRGAVLM

SEQ ID NO: 255889 - protein, 15 aa, Dengue virus
IENTSANLSLAAIAN

SEQ ID NO: 255890 - protein, 15 aa, Dengue virus
VGVFQEGTFHTMWHV

SEQ ID NO: 255891 - protein, 15 aa, Dengue virus
TGNIVASVNTTSRLL

SEQ ID NO: 255892 - protein, 15 aa, Dengue virus
QDELIGRARISQGAG

SEQ ID NO: 255893 - protein, 15 aa, Dengue virus
FHRRDLRLASNAICS

SEQ ID NO: 255894 - protein, 15 aa, Dengue virus
TYGWNLVKLYSGKDV

SEQ ID NO: 255895 - protein, 15 aa, Dengue virus
KRVIQLSRKTFDSEY

SEQ ID NO: 255896 - protein, 15 aa, Dengue virus
GVVTTSGTYVSAIAQ

SEQ ID NO: 255897 - protein, 15 aa, Dengue virus
WGNGCGLFGKGSLVT

SEQ ID NO: 255898 - protein, 15 aa, Dengue virus
LAAYVMTGRSADLEL

SEQ ID NO: 255899 - protein, 15 aa, Dengue virus
GAGWSLKETACLGKS

SEQ ID NO: 255900 - protein, 15 aa, Dengue virus
GSWVDLVLEHGGCVT

SEQ ID NO: 255901 - protein, 15 aa, Dengue virus
AFITFLRVLSIPPTA

SEQ ID NO: 255902 - protein, 15 aa, Dengue virus
TWKIEKASFIEIKSC

SEQ ID NO: 255903 - protein, 15 aa, Dengue virus
GRGPLKLFMALVAFL

SEQ ID NO: 255904 - protein, 15 aa, Dengue virus
MVTQIAMTDTTPFGQ

SEQ ID NO: 255905 - protein, 15 aa, Dengue virus
GSYLAGAGLLFSIMK

SEQ ID NO: 255906 - protein, 15 aa, Dengue virus
EHRREKRSVALAPHV

SEQ ID NO: 255907 - protein, 15 aa, Dengue virus
GLFGYSQIGAGVYKE

SEQ ID NO: 255908 - protein, 15 aa, Dengue virus
TSWAFCEALTLATGP

SEQ ID NO: 255909 - protein, 15 aa, Dengue virus
TRKVRSNAAIGAVFT

SEQ ID NO: 255910 - protein, 15 aa, Dengue virus
EVGAVTLDFSPGTSG

SEQ ID NO: 255911 - protein, 15 aa, Dengue virus
VLMGLGKGWPIHRMD

SEQ ID NO: 255912 - protein, 15 aa, Dengue virus
PLALKEFKEFAAGRK

SEQ ID NO: 255913 - protein, 15 aa, Dengue virus
AQMWSLMYFHRRDLR

SEQ ID NO: 255914 - protein, 15 aa, Dengue virus
TWSIHAHHQWMTTED

SEQ ID NO: 255915 - protein, 15 aa, Dengue virus
PFCSHHFHELIMKDG

SEQ ID NO: 255916 - protein, 15 aa, Dengue virus
GKRVIQLSRKTFDTE

SEQ ID NO: 255917 - protein, 15 aa, Dengue virus
IANQAVVLMGLGKGW

SEQ ID NO: 255918 - protein, 15 aa, Dengue virus
HAVSRGSAKLRWFVE

SEQ ID NO: 255919 - protein, 15 aa, Dengue virus
FFLMVLLVPEPEKQR

SEQ ID NO: 255920 - protein, 15 aa, Dengue virus
DSKFEKQLGQVMLLV

SEQ ID NO: 255921 - protein, 15 aa, Dengue virus
VGRARVSQGAGWSLR

SEQ ID NO: 255922 - protein, 15 aa, Dengue virus
NPYKTWAYHGSYEVK

SEQ ID NO: 255923 - protein, 15 aa, Dengue virus
LLILCTGQLLMMRTT

SEQ ID NO: 255924 - protein, 15 aa, Dengue virus
RGSYLAGAGLLFSIM

SEQ ID NO: 255925 - protein, 15 aa, Dengue virus
LTKPWDVVPTVTQMA

SEQ ID NO: 255926 - protein, 15 aa, Dengue virus
TVWFVPSIKSGNDIA

SEQ ID NO: 255927 - protein, 15 aa, Dengue virus
DHWFSRGNSLSGVEG

SEQ ID NO: 255928 - protein, 15 aa, Dengue virus
IVDLMCHATFTMRLL

SEQ ID NO: 255929 - protein, 15 aa, Dengue virus
PVWLAYKVASEGIKY

SEQ ID NO: 255930 - protein, 15 aa, Dengue virus
DLRLASNAICSAVPS

SEQ ID NO: 255931 - protein, 15 aa, Dengue virus
FVELMRRGDLPVWLS

SEQ ID NO: 255932 - protein, 15 aa, Dengue virus
GCWYGMEIRPLKEKE

SEQ ID NO: 255933 - protein, 15 aa, Dengue virus
RTPQDNQLIYVILTI

SEQ ID NO: 255934 - protein, 15 aa, Dengue virus
VSRGSAKLRWFVERN

SEQ ID NO: 255935 - protein, 15 aa, Dengue virus
NSTANVSLAAIANQA

SEQ ID NO: 255936 - protein, 15 aa, Dengue virus
KKKNLTIMDLHPGAG

SEQ ID NO: 255937 - protein, 15 aa, Dengue virus
RGSAKLRWIVERGMV

SEQ ID NO: 255938 - protein, 15 aa, Dengue virus
REAIKRKLRTLILAP

SEQ ID NO: 255939 - protein, 15 aa, Dengue virus
TRVVASEMAEALKGL

SEQ ID NO: 255940 - protein, 15 aa, Dengue virus
MGLGKGWPLSKMDLG

SEQ ID NO: 255941 - protein, 15 aa, Dengue virus
PVWLSYKVASAGISY

SEQ ID NO: 255942 - protein, 15 aa, Dengue virus
LLVTFKTAHAKKQEV

SEQ ID NO: 255943 - protein, 15 aa, Dengue virus
KTWAYHGSYEVKATG

SEQ ID NO: 255944 - protein, 15 aa, Dengue virus
ALKGMPIRYQTTAVK

SEQ ID NO: 255945 - protein, 15 aa, Dengue virus
GWNLVRLQSGVDVFF

SEQ ID NO: 255946 - protein, 15 aa, Dengue virus
MLTILIRTGLLVISG

SEQ ID NO: 255947 - protein, 15 aa, Dengue virus
YMWLGARYLEFEALG

SEQ ID NO: 255948 - protein, 15 aa, Dengue virus
ESRTIRVLSLVENWL

SEQ ID NO: 255949 - protein, 15 aa, Dengue virus
NKELKCGSGIFVVDN

SEQ ID NO: 255950 - protein, 15 aa, Dengue virus
TWSIHATHQWMTTED

SEQ ID NO: 255951 - protein, 15 aa, Dengue virus
IRSVTRLENIMWKQI

SEQ ID NO: 255952 - protein, 15 aa, Dengue virus
WAYHGSYEVKATGSA

SEQ ID NO: 255953 - protein, 15 aa, Dengue virus
SLAAIANQAAILMGL

SEQ ID NO: 255954 - protein, 15 aa, Dengue virus
IKQRGILGRSQVGVG

SEQ ID NO: 255955 - protein, 15 aa, Dengue virus
VLGSQEGAMHSALTG

SEQ ID NO: 255956 - protein, 15 aa, Dengue virus
GRSQVGVGIHMENVF

SEQ ID NO: 255957 - protein, 15 aa, Dengue virus
AKHQWMTTEDMLKVW

SEQ ID NO: 255958 - protein, 15 aa, Dengue virus
QPQWIAASIILEFFL

SEQ ID NO: 255959 - protein, 15 aa, Dengue virus
GMLVRNPLSRNSTHE

SEQ ID NO: 255960 - protein, 15 aa, Dengue virus
ERVILAGPMPVTAAS

SEQ ID NO: 255961 - protein, 15 aa, Dengue virus
VILAGPMPVTHASAA

SEQ ID NO: 255962 - protein, 15 aa, Dengue virus
RVPNYNLIIMDEAHF

SEQ ID NO: 255963 - protein, 15 aa, Dengue virus
PSIVREAIKRGLRTL

SEQ ID NO: 255964 - protein, 15 aa, Dengue virus
NGVCGIRSATRMENL

SEQ ID NO: 255965 - protein, 15 aa, Dengue virus
ALTLATGPITTLWEG

SEQ ID NO: 255966 - protein, 15 aa, Dengue virus
VEDYGFGMFTTNIWM

SEQ ID NO: 255967 - protein, 15 aa, Dengue virus
AAIKDQRAVHADMGY

SEQ ID NO: 255968 - protein, 15 aa, Dengue virus
RLLSPVRVPNYNLII

SEQ ID NO: 255969 - protein, 15 aa, Dengue virus
SQEGAMRTALTGATE

SEQ ID NO: 255970 - protein, 15 aa, Dengue virus
ACLGKSYAQMWQLMY

SEQ ID NO: 255971 - protein, 15 aa, Dengue virus
ANFKAERVIDPRRCL

SEQ ID NO: 255972 - protein, 15 aa, Dengue virus
LLRNDVPLAGPLIAG

SEQ ID NO: 255973 - protein, 15 aa, Dengue virus
RTEQYKFQPESPARV

SEQ ID NO: 255974 - protein, 15 aa, Dengue virus
DLVLEHGGCVTTIAK

SEQ ID NO: 255975 - protein, 15 aa, Dengue virus
TDPSSIAARGYISTR

SEQ ID NO: 255976 - protein, 15 aa, Dengue virus
NIVASVNTTSRLLLN

SEQ ID NO: 255977 - protein, 15 aa, Dengue virus
SLIGLSSRATWAKNI

SEQ ID NO: 255978 - protein, 15 aa, Dengue virus
LQRGLLGKTQVGVGI

SEQ ID NO: 255979 - protein, 15 aa, Dengue virus
ILLMRTTWAFCEVLT

SEQ ID NO: 255980 - protein, 15 aa, Dengue virus
GPSLRTTTASGKLIH

SEQ ID NO: 255981 - protein, 15 aa, Dengue virus
WCCRSCTLPPLRYLG

SEQ ID NO: 255982 - protein, 15 aa, Dengue virus
ATTFITPMMRHTIEN

SEQ ID NO: 255983 - protein, 15 aa, Dengue virus
EVEDYGFGVFSTNIW

SEQ ID NO: 255984 - protein, 15 aa, Dengue virus
PTSRTTWSIHAKHEW

SEQ ID NO: 255985 - protein, 15 aa, Dengue virus
MAGPLVAGGLLIACY

SEQ ID NO: 255986 - protein, 15 aa, Dengue virus
EFTRKVRSNAAIGAV

SEQ ID NO: 255987 - protein, 15 aa, Dengue virus
YWIESQKNGSWKLAR

SEQ ID NO: 255988 - protein, 15 aa, Dengue virus
GARFLEFEALGFMNE

SEQ ID NO: 255989 - protein, 15 aa, Dengue virus
TWTEQYKFQPESPAR

SEQ ID NO: 255990 - protein, 15 aa, Dengue virus
EFFMMVLLVPEPEKQ

SEQ ID NO: 255991 - protein, 15 aa, Dengue virus
GSGQVVTYSLNTFTN

SEQ ID NO: 255992 - protein, 15 aa, Dengue virus
HRLMSAAVKDERAVH

SEQ ID NO: 255993 - protein, 15 aa, Dengue virus
ILGRSQVGVGIHMEN

SEQ ID NO: 255994 - protein, 15 aa, Dengue virus
VRSTTRLENLLWKQV

SEQ ID NO: 255995 - protein, 15 aa, Dengue virus
SKMDIGVPLLAMGCY

SEQ ID NO: 255996 - protein, 15 aa, Dengue virus
EQYKFQADSPKKLAS

SEQ ID NO: 255997 - protein, 15 aa, Dengue virus
GKKVIQLSRKTFDTE

SEQ ID NO: 255998 - protein, 15 aa, Dengue virus
FLRFLAIPPTAGILA

SEQ ID NO: 255999 - protein, 15 aa, Dengue virus
TFTNMEAQLIRQMEG

SEQ ID NO: 256000 - protein, 15 aa, Dengue virus
THEWMTTEDMLSVWN

SEQ ID NO: 256001 - protein, 15 aa, Dengue virus
SLIGLTSRATWAKNI

SEQ ID NO: 256002 - protein, 15 aa, Dengue virus
VLSIPPTAGVLARWG

SEQ ID NO: 256003 - protein, 15 aa, Dengue virus
RFWNTTIAVSTANIF

SEQ ID NO: 256004 - protein, 15 aa, Dengue virus
TVLMGLGRGWPLHRV

SEQ ID NO: 256005 - protein, 15 aa, Dengue virus
GQGPMKLVMAFIAFL

SEQ ID NO: 256006 - protein, 15 aa, Dengue virus
FTTRLLSSTRVPNYN

SEQ ID NO: 256007 - protein, 15 aa, Dengue virus
EDLWCGSLIGLSSRA

SEQ ID NO: 256008 - protein, 15 aa, Dengue virus
GGMLIACYVITGTSA

SEQ ID NO: 256009 - protein, 15 aa, Dengue virus
KPWDVIPMVTQMAMT

SEQ ID NO: 256010 - protein, 15 aa, Dengue virus
HGGCVTTMAQGKPTL

SEQ ID NO: 256011 - protein, 15 aa, Dengue virus
AWVDVVLEHGGCVTT

SEQ ID NO: 256012 - protein, 15 aa, Dengue virus
PVTVASAAQRRGRIG

SEQ ID NO: 256013 - protein, 15 aa, Dengue virus
LEFFLMVLLVPEPEK

SEQ ID NO: 256014 - protein, 15 aa, Dengue virus
KFQADSPSKLASAIQ

SEQ ID NO: 256015 - protein, 15 aa, Dengue virus
VEMGEAAAIFMTATP

SEQ ID NO: 256016 - protein, 15 aa, Dengue virus
EGSPGKFWNTTIAVS

SEQ ID NO: 256017 - protein, 15 aa, Dengue virus
AVLMGLGKGWPLSKM

SEQ ID NO: 256018 - protein, 15 aa, Dengue virus
ELLSGRGPLKLFMAF

SEQ ID NO: 256019 - protein, 15 aa, Dengue virus
GKGPLRMVLAFITFL

SEQ ID NO: 256020 - protein, 15 aa, Dengue virus
HRRDLRLASMAICSA

SEQ ID NO: 256021 - protein, 15 aa, Dengue virus
NDTWKMERASFIEVK

SEQ ID NO: 256022 - protein, 15 aa, Dengue virus
EVQVIALEPGKNPRA

SEQ ID NO: 256023 - protein, 15 aa, Dengue virus
REDQWCGSLIGLTSR

SEQ ID NO: 256024 - protein, 15 aa, Dengue virus
GWSLRETACLGKAYA

SEQ ID NO: 256025 - protein, 15 aa, Dengue virus
ALGCYSQVNPLTLIA

SEQ ID NO: 256026 - protein, 15 aa, Dengue virus
TDPSSVAARGYISTR

SEQ ID NO: 256027 - protein, 15 aa, Dengue virus
LILCTGQLLMMRTTW

SEQ ID NO: 256028 - protein, 15 aa, Dengue virus
RRLTIMDLHPGAGKT

SEQ ID NO: 256029 - protein, 15 aa, Dengue virus
SSIGKMFEATARGAR

SEQ ID NO: 256030 - protein, 15 aa, Dengue virus
KRVIQLSRKTFDTEY

SEQ ID NO: 256031 - protein, 15 aa, Dengue virus
ELMKRGDLPVWLAYR

SEQ ID NO: 256032 - protein, 15 aa, Dengue virus
LYAVATTVLTPMLRH

SEQ ID NO: 256033 - protein, 15 aa, Dengue virus
WYMWLGARFLEFEAL

SEQ ID NO: 256034 - protein, 15 aa, Dengue virus
LKLFMALVAFLRFLA

SEQ ID NO: 256035 - protein, 15 aa, Dengue virus
EGEGLHKLGYILRDI

SEQ ID NO: 256036 - protein, 15 aa, Dengue virus
PVWLAHKVASEGFQY

SEQ ID NO: 256037 - protein, 15 aa, Dengue virus
GNGVVTTSGTYVSAI

SEQ ID NO: 256038 - protein, 15 aa, Dengue virus
QRTPQDNQLAYVVIG

SEQ ID NO: 256039 - protein, 15 aa, Dengue virus
GVVTRSGTYVSAIAQ

SEQ ID NO: 256040 - protein, 15 aa, Dengue virus
AVGVVSILASSFLRN

SEQ ID NO: 256041 - protein, 15 aa, Dengue virus
AAYVMTGRSADLELE

SEQ ID NO: 256042 - protein, 15 aa, Dengue virus
PASAWTLYAVATTVL

SEQ ID NO: 256043 - protein, 15 aa, Dengue virus
DGPERVILAGPMPVT

SEQ ID NO: 256044 - skipped

SEQ ID NO: 256045 - protein, 15 aa, Dengue virus
AGGLLIACYVITGTS

SEQ ID NO: 256046 - protein, 15 aa, Dengue virus
VQQLTKRFSLGLLSG

SEQ ID NO: 256047 - protein, 15 aa, Dengue virus
RFLAIPPTAGILARW

SEQ ID NO: 256048 - protein, 15 aa, Dengue virus
MRCVGISSRDFVEGV

SEQ ID NO: 256049 - protein, 15 aa, Dengue virus
LPIRYQTTATKTEHT

SEQ ID NO: 256050 - protein, 15 aa, Dengue virus
RREKRSVALAPHVGL

SEQ ID NO: 256051 - protein, 15 aa, Dengue virus
AIKDSKAVHADMGYW

SEQ ID NO: 256052 - protein, 15 aa, Dengue virus
NVSLAAIANQATVLM

SEQ ID NO: 256053 - protein, 15 aa, Dengue virus
ITLATGPLSTLWEGS

SEQ ID NO: 256054 - protein, 15 aa, Dengue virus
PQWIAASIILEFFLI

SEQ ID NO: 256055 - protein, 15 aa, Dengue virus
RGSAKLRWFVERNLV

SEQ ID NO: 256056 - protein, 15 aa, Dengue virus
KLMSAAVKDNRAVHA

SEQ ID NO: 256057 - protein, 15 aa, Dengue virus
HMENVFHTMWHVTRG

SEQ ID NO: 256058 - protein, 15 aa, Dengue virus
SSIGQMFESTYRGAK

SEQ ID NO: 256059 - protein, 15 aa, Dengue virus
TAIANQAAVLMGLGK

SEQ ID NO: 256060 - protein, 15 aa, Dengue virus
DQYIYMGQPLNNDED

SEQ ID NO: 256061 - protein, 15 aa, Dengue virus
IGCYSQVNPITLTAA

SEQ ID NO: 256062 - protein, 15 aa, Dengue virus
REIVDLMCHATFTMR

SEQ ID NO: 256063 - protein, 15 aa, Dengue virus
RGGWSYYMATLKNVR

SEQ ID NO: 256064 - protein, 15 aa, Dengue virus
ETRTETWMSSEGAWK

SEQ ID NO: 256065 - protein, 15 aa, Dengue virus
AVATTIITPMLRHTI

SEQ ID NO: 256066 - protein, 15 aa, Dengue virus
GEYRLKGESRKTFVE

SEQ ID NO: 256067 - protein, 15 aa, Dengue virus
GGCVTTMAQGKPTLD

SEQ ID NO: 256068 - protein, 15 aa, Dengue virus
DSKLMSAAVKDNRAV

SEQ ID NO: 256069 - protein, 15 aa, Dengue virus
VVSILASSFLRNDVP

SEQ ID NO: 256070 - protein, 15 aa, Dengue virus
RTTWALCESITLATG

SEQ ID NO: 256071 - protein, 15 aa, Dengue virus
PGAGKTKRILPSIVR

SEQ ID NO: 256072 - protein, 15 aa, Dengue virus
KRSVALVPHVGMGLE

SEQ ID NO: 256073 - protein, 15 aa, Dengue virus
RLLSPVRVPNYNMVI

SEQ ID NO: 256074 - protein, 15 aa, Dengue virus
WSYYMATLKNVREVK

SEQ ID NO: 256075 - protein, 15 aa, Dengue virus
GRARISQGAGWSLKE

SEQ ID NO: 256076 - protein, 15 aa, Dengue virus
TVLGSQEGAMHSALA

SEQ ID NO: 256077 - protein, 15 aa, Dengue virus
SIGKMLEATAKGARR

SEQ ID NO: 256078 - protein, 15 aa, Dengue virus
AGGLLIACYVITGRS

SEQ ID NO: 256079 - protein, 15 aa, Dengue virus
VVTTSGTYVSAIAQT

SEQ ID NO: 256080 - protein, 15 aa, Dengue virus
RDFVEGVSGGAWVDV

SEQ ID NO: 256081 - protein, 15 aa, Dengue virus
ALTALNDMGKVRKDI

SEQ ID NO: 256082 - protein, 15 aa, Dengue virus
EMAEALKGLPIRYQT

SEQ ID NO: 256083 - protein, 15 aa, Dengue virus
LRPKWLDARTYSDPL

SEQ ID NO: 256084 - protein, 15 aa, Dengue virus
QLTKRFSLGLLSGRG

SEQ ID NO: 256085 - protein, 15 aa, Dengue virus
HTLWSNGVLESQMLI

SEQ ID NO: 256086 - protein, 15 aa, Dengue virus
LETLLLLALLGAMTA

SEQ ID NO: 256087 - protein, 15 aa, Dengue virus
CKKVRSNAAMGAVFT

SEQ ID NO: 256088 - protein, 15 aa, Dengue virus
VRNRVSTVQQLTKRF

SEQ ID NO: 256089 - protein, 15 aa, Dengue virus
AKHEWMTTEDMLKVW

SEQ ID NO: 256090 - protein, 15 aa, Dengue virus
STVQQLTKRFSLGLL

SEQ ID NO: 256091 - protein, 15 aa, Dengue virus
VEDYGFGIFTTNIWL

SEQ ID NO: 256092 - protein, 15 aa, Dengue virus
GAIFQEEQGWTSASE

SEQ ID NO: 256093 - protein, 15 aa, Dengue virus
DYGFGMFSTNIWLKL

SEQ ID NO: 256094 - protein, 15 aa, Dengue virus
VDLVLEHGGCVTTMA

SEQ ID NO: 256095 - protein, 15 aa, Dengue virus
FHTMWHVTRGAVLMY

SEQ ID NO: 256096 - protein, 15 aa, Dengue virus
KCGSGIFVIDNVHTR

SEQ ID NO: 256097 - protein, 15 aa, Dengue virus
FLRFLAIPPTAGILK

SEQ ID NO: 256098 - protein, 15 aa, Dengue virus
PRWLDARVYADPMAL

SEQ ID NO: 256099 - protein, 15 aa, Dengue virus
RLMSAAIKDSKAVHA

SEQ ID NO: 256100 - protein, 15 aa, Dengue virus
VVLMGLGRGWPIHRV

SEQ ID NO: 256101 - protein, 15 aa, Dengue virus
LLTKPWDVLPMVTQI

SEQ ID NO: 256102 - protein, 15 aa, Dengue virus
GPLVAGGLLTVCYVL

SEQ ID NO: 256103 - protein, 15 aa, Dengue virus
DTWKIEKASFIEIKS

SEQ ID NO: 256104 - protein, 15 aa, Dengue virus
GIRSVTRLENIMWKQ

SEQ ID NO: 256105 - protein, 15 aa, Dengue virus
AKRMAILGDTAWDFG

SEQ ID NO: 256106 - protein, 15 aa, Dengue virus
SPGRFWNTTIAVSTA

SEQ ID NO: 256107 - protein, 15 aa, Dengue virus
VSSVNTISKMLLNRF

SEQ ID NO: 256108 - protein, 15 aa, Dengue virus
VTQMAMTDTTPFGQQ

SEQ ID NO: 256109 - protein, 15 aa, Dengue virus
THEMYWVSGATGNIV

SEQ ID NO: 256110 - protein, 15 aa, Dengue virus
LETRAQTWMSAEGAW

SEQ ID NO: 256111 - protein, 15 aa, Dengue virus
SSVNVSLTAIANQAA

SEQ ID NO: 256112 - protein, 15 aa, Dengue virus
NKVRSNAALGAVFTD

SEQ ID NO: 256113 - protein, 15 aa, Dengue virus
KRFSRGMLQGQGPMK

SEQ ID NO: 256114 - protein, 15 aa, Dengue virus
IHASHEWMTTEDMLA

SEQ ID NO: 256115 - protein, 15 aa, Dengue virus
EGIMAIGIVSILASS

SEQ ID NO: 256116 - protein, 15 aa, Dengue virus
HTIENTSANLSLTAI

SEQ ID NO: 256117 - protein, 15 aa, Dengue virus
HRGPSLRTTTVSGKL

SEQ ID NO: 256118 - protein, 15 aa, Dengue virus
TTWSIHAKHQWMTTE

SEQ ID NO: 256119 - protein, 15 aa, Dengue virus
KFQPESPARLASAIL

SEQ ID NO: 256120 - protein, 15 aa, Dengue virus
SSNPTIEEGRTLRVL

SEQ ID NO: 256121 - protein, 15 aa, Dengue virus
VFQEGTFHTMWHVTR

SEQ ID NO: 256122 - protein, 15 aa, Dengue virus
AHHQWMTTEDMLTVW

SEQ ID NO: 256123 - protein, 15 aa, Dengue virus
VVTYGLNTFTNMEVQ

SEQ ID NO: 256124 - protein, 15 aa, Dengue virus
PNPTIEESRTIRVLK

SEQ ID NO: 256125 - protein, 15 aa, Dengue virus
GSVYTTMFGGVSWVM

SEQ ID NO: 256126 - protein, 15 aa, Dengue virus
IANQAAVLMGLGKGW

SEQ ID NO: 256127 - protein, 15 aa, Dengue virus
ACLRKNGKRVIQLSR

SEQ ID NO: 256128 - protein, 15 aa, Dengue virus
GSLVRCPLSRNSTHE

SEQ ID NO: 256129 - protein, 15 aa, Dengue virus
HRREKRSVALVPHVG

SEQ ID NO: 256130 - protein, 15 aa, Dengue virus
MYWVSGATGNIVSSV

SEQ ID NO: 256131 - protein, 15 aa, Dengue virus
VVRLLTKPWDVLPMV

SEQ ID NO: 256132 - protein, 15 aa, Dengue virus
FLAIPPTAGILARWG

SEQ ID NO: 256133 - protein, 15 aa, Dengue virus
EEALRGLPIRYQTPA

SEQ ID NO: 256134 - protein, 15 aa, Dengue virus
HRGPSLRTTTVTGKI

SEQ ID NO: 256135 - protein, 15 aa, Dengue virus
LPVWLAYKVAAEGIN

SEQ ID NO: 256136 - protein, 15 aa, Dengue virus
EVEDYGFGMFSTNIW

SEQ ID NO: 256137 - protein, 15 aa, Dengue virus
TLYAVATTFITPMLR

SEQ ID NO: 256138 - protein, 15 aa, Dengue virus
RGEARKTFVELMRRG

SEQ ID NO: 256139 - protein, 15 aa, Dengue virus
FKGKTVWFVPSIKAG

SEQ ID NO: 256140 - protein, 15 aa, Dengue virus
ASALLKNDIPMTGPL

SEQ ID NO: 256141 - protein, 15 aa, Dengue virus
TTIAVSTANIFRGSY

SEQ ID NO: 256142 - protein, 15 aa, Dengue virus
KMVMAFIAFLRFLTI

SEQ ID NO: 256143 - protein, 15 aa, Dengue virus
CWCNATSAWVMYGTC

SEQ ID NO: 256144 - protein, 15 aa, Dengue virus
LDARIYSDPLALREF

SEQ ID NO: 256145 - protein, 15 aa, Dengue virus
EAVMAVGVVSILLSS

SEQ ID NO: 256146 - protein, 15 aa, Dengue virus
GAGKTKRYLPAIVRE

SEQ ID NO: 256147 - protein, 15 aa, Dengue virus
PPFNMLKRERNRVST

SEQ ID NO: 256148 - protein, 15 aa, Dengue virus
FQPESPARLATAIAG

SEQ ID NO: 256149 - protein, 15 aa, Dengue virus
QYKFQADSPSKLASA

SEQ ID NO: 256150 - protein, 15 aa, Dengue virus
GNDIAACLRKSGKRV

SEQ ID NO: 256151 - protein, 15 aa, Dengue virus
LNDTWKMERASFIEV

SEQ ID NO: 256152 - protein, 15 aa, Dengue virus
QADSPKKLASAILNA

SEQ ID NO: 256153 - protein, 15 aa, Dengue virus
FPGKTVWFVPSIKSG

SEQ ID NO: 256154 - protein, 15 aa, Dengue virus
SASSMINGVVKLLTK

SEQ ID NO: 256155 - protein, 15 aa, Dengue virus
SVNMISRMLINRFTM

SEQ ID NO: 256156 - protein, 15 aa, Dengue virus
IDGEYRLKGEARKTF

SEQ ID NO: 256157 - protein, 15 aa, Dengue virus
PRLCTKAEFCKKVRS

SEQ ID NO: 256158 - protein, 15 aa, Dengue virus
IMAIGIVSILASSLL

SEQ ID NO: 256159 - protein, 15 aa, Dengue virus
LPMVTQIAMTDTTPF

SEQ ID NO: 256160 - protein, 15 aa, Dengue virus
NSTHEMYWVSNASGN

SEQ ID NO: 256161 - protein, 15 aa, Dengue virus
STHEMYWVSGATGNI

SEQ ID NO: 256162 - protein, 15 aa, Dengue virus
KELKCGSGIFVTNEV

SEQ ID NO: 256163 - protein, 15 aa, Dengue virus
ERVILAGPMPVTHAS

SEQ ID NO: 256164 - protein, 15 aa, Dengue virus
ANFRAERVIDPRRCM

SEQ ID NO: 256165 - protein, 15 aa, Dengue virus
KLKPRWLDARVYADP

SEQ ID NO: 256166 - protein, 15 aa, Dengue virus
KTVWFVPSIKAGNDI

SEQ ID NO: 256167 - protein, 15 aa, Dengue virus
SSRDFVEGVSGGSWV

SEQ ID NO: 256168 - protein, 15 aa, Dengue virus
MAVGLVSLLGSSLLK

SEQ ID NO: 256169 - protein, 15 aa, Dengue virus
GIRSATRMENLLWKQ

SEQ ID NO: 256170 - protein, 15 aa, Dengue virus
MCTLMAMDLGEMCED

SEQ ID NO: 256171 - protein, 15 aa, Dengue virus
NIFRGSYLAGAGLAF

SEQ ID NO: 256172 - protein, 15 aa, Dengue virus
CGSGIFVIDNVHTWT

SEQ ID NO: 256173 - protein, 15 aa, Dengue virus
RGSSKIRWFVERNMV

SEQ ID NO: 256174 - protein, 15 aa, Dengue virus
SVALAPHVGMGLETR

SEQ ID NO: 256175 - protein, 15 aa, Dengue virus
KKQEVVVLGSQEGAM

SEQ ID NO: 256176 - protein, 15 aa, Dengue virus
NDIANCLRKNGKKVI

SEQ ID NO: 256177 - protein, 15 aa, Dengue virus
DCWCNLTSTWVTYGT

SEQ ID NO: 256178 - protein, 15 aa, Dengue virus
PLNEGIMAVGMVSIL

SEQ ID NO: 256179 - protein, 15 aa, Dengue virus
IQPHWIAASIILEFF

SEQ ID NO: 256180 - protein, 15 aa, Dengue virus
VATTFITPMMRHTIE

SEQ ID NO: 256181 - protein, 15 aa, Dengue virus
SHEWMTTEDMLAVWN

SEQ ID NO: 256182 - protein, 15 aa, Dengue virus
VSTVQQLTKRFSLGL

SEQ ID NO: 256183 - protein, 15 aa, Dengue virus
VDCWCNATSTWVMYG

SEQ ID NO: 256184 - protein, 15 aa, Dengue virus
SHHFHKIFMKDGREI

SEQ ID NO: 256185 - protein, 15 aa, Dengue virus
LLSGRGPLKLFMALV

SEQ ID NO: 256186 - protein, 15 aa, Dengue virus
GEERVVLAGPMPVTH

SEQ ID NO: 256187 - protein, 15 aa, Dengue virus
GCGRGGWSYYMATLK

SEQ ID NO: 256188 - protein, 15 aa, Dengue virus
YAQMWQLMYFHRRDL

SEQ ID NO: 256189 - protein, 15 aa, Dengue virus
TAIANQAVVLMGLDK

SEQ ID NO: 256190 - protein, 15 aa, Dengue virus
DKRSVALAPHVGMGL

SEQ ID NO: 256191 - protein, 15 aa, Dengue virus
GAGVYKEGVFHTMWH

SEQ ID NO: 256192 - protein, 15 aa, Dengue virus
WLDARIYADPMALKD

SEQ ID NO: 256193 - protein, 15 aa, Dengue virus
SPIRVPNYNLVVMDE

SEQ ID NO: 256194 - protein, 15 aa, Dengue virus
AAGIMKNPTVDGITV

SEQ ID NO: 256195 - protein, 15 aa, Dengue virus
LIGRARISQGAGWSL

SEQ ID NO: 256196 - protein, 15 aa, Dengue virus
RGYISTRVEMGEAAA

SEQ ID NO: 256197 - protein, 15 aa, Dengue virus
SITLATGPLSTLWEG

SEQ ID NO: 256198 - protein, 15 aa, Dengue virus
FGRAKGSRAIWYMWL

SEQ ID NO: 256199 - protein, 15 aa, Dengue virus
GQLLMMRTTWALCES

SEQ ID NO: 256200 - protein, 15 aa, Dengue virus
GEAAGIFMTATPPGT

SEQ ID NO: 256201 - protein, 15 aa, Dengue virus
ATWVDVVLEHGSCVT

SEQ ID NO: 256202 - protein, 15 aa, Dengue virus
HAVSRGSAKIRWIVE

SEQ ID NO: 256203 - protein, 15 aa, Dengue virus
LPVWLSYKVASAGIS

SEQ ID NO: 256204 - protein, 15 aa, Dengue virus
ARISQGAGWSLRETA

SEQ ID NO: 256205 - protein, 15 aa, Dengue virus
KRGDLPVWLAYKVAS

SEQ ID NO: 256206 - protein, 15 aa, Dengue virus
KKLKPRWLDARVYAD

SEQ ID NO: 256207 - protein, 15 aa, Dengue virus
IREAIKRKLRTLILA

SEQ ID NO: 256208 - protein, 15 aa, Dengue virus
MAEALKGLPIRYQTT

SEQ ID NO: 256209 - protein, 15 aa, Dengue virus
SSVNTISKMLLNRFT

SEQ ID NO: 256210 - protein, 15 aa, Dengue virus
NTSANLSLAAIANQA

SEQ ID NO: 256211 - protein, 15 aa, Dengue virus
VSILASALLKNDIPM

SEQ ID NO: 256212 - protein, 15 aa, Dengue virus
YFHRRDLRLASMAIC

SEQ ID NO: 256213 - protein, 15 aa, Dengue virus
GVVTRSGAYVSAIAQ

SEQ ID NO: 256214 - protein, 15 aa, Dengue virus
TRVPNYNLIVMDEAH

SEQ ID NO: 256215 - protein, 15 aa, Dengue virus
IDGEFRLRGEQRKTF

SEQ ID NO: 256216 - protein, 15 aa, Dengue virus
AIFKLTYQNKVVKVL

SEQ ID NO: 256217 - protein, 15 aa, Dengue virus
ANFRADRVIDPRRCL

SEQ ID NO: 256218 - protein, 15 aa, Dengue virus
RMCTREEFIKKVRTN

SEQ ID NO: 256219 - protein, 15 aa, Dengue virus
FGYSQIGAGVYKEGV

SEQ ID NO: 256220 - protein, 15 aa, Dengue virus
YDSKFEKQLGQVMLL

SEQ ID NO: 256221 - protein, 15 aa, Dengue virus
RFLTIPPTAGILARW

SEQ ID NO: 256222 - protein, 15 aa, Dengue virus
QDVTVLGSQEGAMHS

SEQ ID NO: 256223 - protein, 15 aa, Dengue virus
LPESLETLMLVALLA

SEQ ID NO: 256224 - protein, 15 aa, Dengue virus
RVILAGPMPVTASSA

SEQ ID NO: 256225 - protein, 15 aa, Dengue virus
TACLGKSYAQMWQLM

SEQ ID NO: 256226 - protein, 15 aa, Dengue virus
MTTEDMLSVWNRVWI

SEQ ID NO: 256227 - protein, 15 aa, Dengue virus
YYCGGLKNVKEVRGF

SEQ ID NO: 256228 - protein, 15 aa, Dengue virus
WCGSLIGLTSRATWA

SEQ ID NO: 256229 - protein, 15 aa, Dengue virus
LMCHATFTTRLLSST

SEQ ID NO: 256230 - protein, 15 aa, Dengue virus
RAIWYMWLGARFLEF

SEQ ID NO: 256231 - protein, 15 aa, Dengue virus
ILAPTRVVASEMAEA

SEQ ID NO: 256232 - protein, 15 aa, Dengue virus
RARISQGAGWSLRET

SEQ ID NO: 256233 - protein, 15 aa, Dengue virus
LVHKQWFFDLPLPWA

SEQ ID NO: 256234 - protein, 15 aa, Dengue virus
QERMVTFKVPHAKKQ

SEQ ID NO: 256235 - protein, 15 aa, Dengue virus
DVKNDMISYGGGWRL

SEQ ID NO: 256236 - protein, 15 aa, Dengue virus
ENTSANLSLAAIANQ

SEQ ID NO: 256237 - protein, 15 aa, Dengue virus
CEVITLATGPLSTLW

SEQ ID NO: 256238 - protein, 15 aa, Dengue virus
RKYLPAIIREAIKRK

SEQ ID NO: 256239 - protein, 15 aa, Dengue virus
VNGVVRLLTKPWDVV

SEQ ID NO: 256240 - protein, 15 aa, Dengue virus
QATVLMGLGKGWPIH

SEQ ID NO: 256241 - protein, 15 aa, Dengue virus
LLMRTTWAFCEVLTL

SEQ ID NO: 256242 - protein, 15 aa, Dengue virus
RKRRLTIMDLHPGSG

SEQ ID NO: 256243 - protein, 15 aa, Dengue virus
FLNEDHWFSRGNSLS

SEQ ID NO: 256244 - protein, 15 aa, Dengue virus
LRPASAWTLYAVATT

SEQ ID NO: 256245 - protein, 15 aa, Dengue virus
PESLETLMLVALIAV

SEQ ID NO: 256246 - protein, 15 aa, Dengue virus
GNPGKFWNTTIAVSM

SEQ ID NO: 256247 - protein, 15 aa, Dengue virus
FQADSPSKLASAIQK

SEQ ID NO: 256248 - protein, 15 aa, Dengue virus
MWSLMYFHRRDLRLA

SEQ ID NO: 256249 - protein, 15 aa, Dengue virus
QQVPFCSHHFHQLIM

SEQ ID NO: 256250 - protein, 15 aa, Dengue virus
IPMTGPLVAGGLLTV

SEQ ID NO: 256251 - protein, 15 aa, Dengue virus
GPSLRTTTASGKLVT

SEQ ID NO: 256252 - protein, 15 aa, Dengue virus
VVTRSGTYVSSIAQT

SEQ ID NO: 256253 - protein, 15 aa, Dengue virus
IRSTTRLENVMWKQI

SEQ ID NO: 256254 - protein, 15 aa, Dengue virus
LKGLPIRYQTTAVKS

SEQ ID NO: 256255 - protein, 15 aa, Dengue virus
LKNVKEVRGFTKGGP

SEQ ID NO: 256256 - protein, 15 aa, Dengue virus
QQVPFCSHHFHELIM

SEQ ID NO: 256257 - protein, 15 aa, Dengue virus
SAVNMTSKMLLNRFT

SEQ ID NO: 256258 - protein, 15 aa, Dengue virus
YRILQRGLLGKTQVG

SEQ ID NO: 256259 - protein, 15 aa, Dengue virus
GLLTVCYVLSGSSAD

SEQ ID NO: 256260 - protein, 15 aa, Dengue virus
SWALCEVLTLATGPV

SEQ ID NO: 256261 - protein, 15 aa, Dengue virus
QILLMRTSWAFCEVL

SEQ ID NO: 256262 - protein, 15 aa, Dengue virus
ILCTGQLLMMRTTWA

SEQ ID NO: 256263 - protein, 15 aa, Dengue virus
SHHFHQLIMKDGRVL

SEQ ID NO: 256264 - protein, 15 aa, Dengue virus
SVALAPHVGLGLDTR

SEQ ID NO: 256265 - protein, 15 aa, Dengue virus
AVSRGSAKLRWFVER

SEQ ID NO: 256266 - protein, 15 aa, Dengue virus
TMRLLSPVRVPNYNM

SEQ ID NO: 256267 - protein, 15 aa, Dengue virus
CLRKSGKKVIQLSRK

SEQ ID NO: 256268 - protein, 15 aa, Dengue virus
KVRTNAAMGAVFTEE

SEQ ID NO: 256269 - protein, 15 aa, Dengue virus
DYGFGIFTTNIWMKF

SEQ ID NO: 256270 - protein, 15 aa, Dengue virus
PAIVREALKRRLRTL

SEQ ID NO: 256271 - protein, 15 aa, Dengue virus
AVSRGTAKLRWIVER

SEQ ID NO: 256272 - protein, 15 aa, Dengue virus
AVSRGSSKLRWFVER

SEQ ID NO: 256273 - protein, 15 aa, Dengue virus
SYDAKFEKQLGQIML

SEQ ID NO: 256274 - protein, 15 aa, Dengue virus
QRGLFGYSQIGAGVY

SEQ ID NO: 256275 - protein, 15 aa, Dengue virus
LGKSYAQMWQLMYFH

SEQ ID NO: 256276 - protein, 15 aa, Dengue virus
RVVASEMAEALKGLP

SEQ ID NO: 256277 - protein, 15 aa, Dengue virus
RPRWLDARTYSDPLA

SEQ ID NO: 256278 - protein, 15 aa, Dengue virus
RRMAILGDTAWDFGS

SEQ ID NO: 256279 - protein, 15 aa, Dengue virus
SLRTTTASGKLVTQW

SEQ ID NO: 256280 - protein, 15 aa, Dengue virus
SQKNGSWKLARASFI

SEQ ID NO: 256281 - protein, 15 aa, Dengue virus
KLTYQNKVVRVQRPT

SEQ ID NO: 256282 - protein, 15 aa, Dengue virus
VTYGLNTFTNMEVQL

SEQ ID NO: 256283 - protein, 15 aa, Dengue virus
LKRARNRVSTPQGLV

SEQ ID NO: 256284 - protein, 15 aa, Dengue virus
LVLCAVQLLLMRTSW

SEQ ID NO: 256285 - protein, 15 aa, Dengue virus
LNEDHWFSRENSLSG

SEQ ID NO: 256286 - protein, 15 aa, Dengue virus
ATARGARRMAILGDT

SEQ ID NO: 256287 - protein, 15 aa, Dengue virus
EDYGFGVFSTNIWLK

SEQ ID NO: 256288 - protein, 15 aa, Dengue virus
KMLLDNINTPEGIIP

SEQ ID NO: 256289 - protein, 15 aa, Dengue virus
IRYQTTAIKAEHTGR

SEQ ID NO: 256290 - protein, 15 aa, Dengue virus
KLTYQNKVVKVLRPT

SEQ ID NO: 256291 - protein, 15 aa, Dengue virus
EYRLKGEARKTFVEL

SEQ ID NO: 256292 - protein, 15 aa, Dengue virus
GRARISQGAGWSLRE

SEQ ID NO: 256293 - protein, 15 aa, Dengue virus
VDCWCNATSAWVMYG

SEQ ID NO: 256294 - protein, 15 aa, Dengue virus
QYKFQADSPKRLATA

SEQ ID NO: 256295 - protein, 15 aa, Dengue virus
GPMPVTAASAAQRRG

SEQ ID NO: 256296 - protein, 15 aa, Dengue virus
KVIGLYGNGVVTTSG

SEQ ID NO: 256297 - protein, 15 aa, Dengue virus
DLMCHATFTTRLLSS

SEQ ID NO: 256298 - protein, 15 aa, Dengue virus
TPQGLVKRFSTGLLN

SEQ ID NO: 256299 - protein, 15 aa, Dengue virus
QRGILGRSQVGVGIH

SEQ ID NO: 256300 - protein, 15 aa, Dengue virus
ARFLEFEALGFMNED

SEQ ID NO: 256301 - protein, 15 aa, Dengue virus
NGKGPLRMVLAFITF

SEQ ID NO: 256302 - protein, 15 aa, Dengue virus
PSLRTTTASGKLVTQ

SEQ ID NO: 256303 - protein, 15 aa, Dengue virus
GVVKLLTKPWDVVPM

SEQ ID NO: 256304 - protein, 15 aa, Dengue virus
GCWYGMEIRPVSEKE

SEQ ID NO: 256305 - protein, 15 aa, Dengue virus
EGAMHSALAGATEVD

SEQ ID NO: 256306 - protein, 15 aa, Dengue virus
MGLDKGWPLHRMDIG

SEQ ID NO: 256307 - protein, 15 aa, Dengue virus
GKTKRILPSIVREAI

SEQ ID NO: 256308 - protein, 15 aa, Dengue virus
MLRHTIENSTANVSL

SEQ ID NO: 256309 - protein, 15 aa, Dengue virus
TIEESRTIRVLSLVE

SEQ ID NO: 256310 - protein, 15 aa, Dengue virus
GEQRKTFVDLMRRGD

SEQ ID NO: 256311 - protein, 15 aa, Dengue virus
GEFRLRGEQRKTFVD

SEQ ID NO: 256312 - protein, 15 aa, Dengue virus
YGLNTFTNMEAQLIR

SEQ ID NO: 256313 - protein, 15 aa, Dengue virus
EAKMLLDNINTPEGI

SEQ ID NO: 256314 - protein, 15 aa, Dengue virus
NFRAERVIDPRRCLK

SEQ ID NO: 256315 - protein, 15 aa, Dengue virus
LGARFLEFEALGFLN

SEQ ID NO: 256316 - protein, 15 aa, Dengue virus
MPIRYQTPAIRAEHT

SEQ ID NO: 256317 - protein, 15 aa, Dengue virus
ALNDTWKMERASFIE

SEQ ID NO: 256318 - protein, 15 aa, Dengue virus
SKVDIGVPLLAMGCY

SEQ ID NO: 256319 - protein, 15 aa, Dengue virus
IFAGHLKCRLKMDKL

SEQ ID NO: 256320 - protein, 15 aa, Dengue virus
TREEFTRKVRSNAAI

SEQ ID NO: 256321 - protein, 15 aa, Dengue virus
AMYADDTAGWDTRIT

SEQ ID NO: 256322 - protein, 15 aa, Dengue virus
KAWMVHRQWFFDLPL

SEQ ID NO: 256323 - protein, 15 aa, Dengue virus
SAAVKDNRAVHADMG

SEQ ID NO: 256324 - protein, 15 aa, Dengue virus
KLMSAAVKDQRAVHA

SEQ ID NO: 256325 - protein, 15 aa, Dengue virus
RGSSKLRWFVERNMV

SEQ ID NO: 256326 - protein, 15 aa, Dengue virus
RTTWSIHAHHQWMTT

SEQ ID NO: 256327 - protein, 15 aa, Dengue virus
MRCIGIGNRDFVEGL

SEQ ID NO: 256328 - protein, 15 aa, Dengue virus
GTWVDVVLEHGSCVT

SEQ ID NO: 256329 - protein, 15 aa, Dengue virus
LTLATGPVMTLWEGN

SEQ ID NO: 256330 - protein, 15 aa, Dengue virus
FKTAHAKKQEVVVLG

SEQ ID NO: 256331 - protein, 15 aa, Dengue virus
RVILAGPIPVTPSSA

SEQ ID NO: 256332 - protein, 15 aa, Dengue virus
RMAILGDTAWDFGSL

SEQ ID NO: 256333 - protein, 15 aa, Dengue virus
AIANQAVVLMGLDKG

SEQ ID NO: 256334 - protein, 15 aa, Dengue virus
GKTRRYLPAMVREAI

SEQ ID NO: 256335 - protein, 15 aa, Dengue virus
PMPVTAASAAQRRGR

SEQ ID NO: 256336 - protein, 15 aa, Dengue virus
GNIVSSVNTISKMLL

SEQ ID NO: 256337 - protein, 15 aa, Dengue virus
LYAVATTIITPMLRH

SEQ ID NO: 256338 - protein, 15 aa, Dengue virus
LLMRTSWAFCESLTL

SEQ ID NO: 256339 - protein, 15 aa, Dengue virus
SLRETACLGKSYAQM

SEQ ID NO: 256340 - protein, 15 aa, Dengue virus
IPPTAGILKRWGTIK

SEQ ID NO: 256341 - protein, 15 aa, Dengue virus
EALKGMPIRYQTTAV

SEQ ID NO: 256342 - protein, 15 aa, Dengue virus
ITFLRVLSIPPTAGV

SEQ ID NO: 256343 - protein, 15 aa, Dengue virus
GKCETCVYNMMGKRE

SEQ ID NO: 256344 - protein, 15 aa, Dengue virus
EKRSVALTPHSGMGL

SEQ ID NO: 256345 - protein, 15 aa, Dengue virus
LNEDHWFSRGNSLSG

SEQ ID NO: 256346 - protein, 15 aa, Dengue virus
PIHKMDLGVPLLALG

SEQ ID NO: 256347 - protein, 15 aa, Dengue virus
KRILPSIVREAIKRG

SEQ ID NO: 256348 - protein, 15 aa, Dengue virus
EGAMHSALTGATEIQ

SEQ ID NO: 256349 - protein, 15 aa, Dengue virus
LFLNDMGKVRKDIPQ

SEQ ID NO: 256350 - protein, 15 aa, Dengue virus
TGPLVAGGLLTVCYV

SEQ ID NO: 256351 - protein, 15 aa, Dengue virus
DVVVLGSQEGAMHSA

SEQ ID NO: 256352 - protein, 15 aa, Dengue virus
SWKLARASFIEVKSC

SEQ ID NO: 256353 - protein, 15 aa, Dengue virus
RLRTLILAPTRVVAA

SEQ ID NO: 256354 - protein, 15 aa, Dengue virus
SWLVHKQWFLDLPLP

SEQ ID NO: 256355 - protein, 15 aa, Dengue virus
TTMAKNKPTLDFELI

SEQ ID NO: 256356 - protein, 15 aa, Dengue virus
PGKTVWFVPSIKSGN

SEQ ID NO: 256357 - protein, 15 aa, Dengue virus
IPMATYGWNLVKLHS

SEQ ID NO: 256358 - protein, 15 aa, Dengue virus
FLEFEALGFMNEDHW

SEQ ID NO: 256359 - protein, 15 aa, Dengue virus
MYFHRRDLRLASMAI

SEQ ID NO: 256360 - protein, 15 aa, Dengue virus
GDLMYADDTAGWDTR

SEQ ID NO: 256361 - protein, 15 aa, Dengue virus
HPGSGKTRKYLPAII

SEQ ID NO: 256362 - protein, 15 aa, Dengue virus
GLLLAAYVMTGRSAD

SEQ ID NO: 256363 - protein, 15 aa, Dengue virus
RGLPIRYQTPAVKSE

SEQ ID NO: 256364 - protein, 15 aa, Dengue virus
SPVRVPNYNLIIMDE

SEQ ID NO: 256365 - protein, 15 aa, Dengue virus
HRLMSAAIKDSKAVH

SEQ ID NO: 256366 - protein, 15 aa, Dengue virus
DVTVLGSQEGAMHSA

SEQ ID NO: 256367 - protein, 15 aa, Dengue virus
YKFQADSPKKLASAI

SEQ ID NO: 256368 - protein, 15 aa, Dengue virus
GVEGEGLHKLGYILR

SEQ ID NO: 256369 - protein, 15 aa, Dengue virus
MRTSWAFCEALTLAT

SEQ ID NO: 256370 - protein, 15 aa, Dengue virus
GPERVILAGPMPVTV

SEQ ID NO: 256371 - protein, 15 aa, Dengue virus
KRVRNRVSTVQQLTK

SEQ ID NO: 256372 - protein, 15 aa, Dengue virus
IEPSWADVRNDMISY

SEQ ID NO: 256373 - protein, 15 aa, Dengue virus
LGKSYAQMWALMYFH

SEQ ID NO: 256374 - protein, 15 aa, Dengue virus
IQPQWIASSIILEFF

SEQ ID NO: 256375 - protein, 15 aa, Dengue virus
GWPLSKMDLGVPLLA

SEQ ID NO: 256376 - protein, 15 aa, Dengue virus
FCSHHFHQLIMKDGR

SEQ ID NO: 256377 - protein, 15 aa, Dengue virus
TGSASSMINGVVRLL

SEQ ID NO: 256378 - protein, 15 aa, Dengue virus
CYVLSGSSADLSLEK

SEQ ID NO: 256379 - protein, 15 aa, Dengue virus
ASEMAEALKGMPIRY

SEQ ID NO: 256380 - protein, 15 aa, Dengue virus
GNGVVTRSGTYVSAI

SEQ ID NO: 256381 - protein, 15 aa, Dengue virus
RSVALAPHVGLGLDT

SEQ ID NO: 256382 - protein, 15 aa, Dengue virus
VSILLSSLLKNDVPL

SEQ ID NO: 256383 - protein, 15 aa, Dengue virus
SVNMISRMLLNRFTT

SEQ ID NO: 256384 - protein, 15 aa, Dengue virus
ENTSANLSLTAIANQ

SEQ ID NO: 256385 - protein, 15 aa, Dengue virus
YLPAIIREAIKRKLR

SEQ ID NO: 256386 - protein, 15 aa, Dengue virus
KGWPIHRMDLGVPLL

SEQ ID NO: 256387 - protein, 15 aa, Dengue virus
YQHALSELPETLETL

SEQ ID NO: 256388 - protein, 15 aa, Dengue virus
HKMDLGVPLLALGCY

SEQ ID NO: 256389 - protein, 15 aa, Dengue virus
EFCIKVLNPYMPSVI

SEQ ID NO: 256390 - protein, 15 aa, Dengue virus
PVWLAYKVASEGFQY

SEQ ID NO: 256391 - protein, 15 aa, Dengue virus
KTRRYLPAMVREAIR

SEQ ID NO: 256392 - protein, 15 aa, Dengue virus
EGVMAVGLVSLLGSS

SEQ ID NO: 256393 - protein, 15 aa, Dengue virus
FCIKVLNPYMPSVIE

SEQ ID NO: 256394 - protein, 15 aa, Dengue virus
AQMWTLMYFHRRDLR

SEQ ID NO: 256395 - protein, 15 aa, Dengue virus
GAMHSALTGATEIQM

SEQ ID NO: 256396 - protein, 15 aa, Dengue virus
VPLAGPMVAGGLLLA

SEQ ID NO: 256397 - protein, 15 aa, Dengue virus
GQVMLLVLCAVQLLL

SEQ ID NO: 256398 - protein, 15 aa, Dengue virus
NFKAGRVIDPRRCLK

SEQ ID NO: 256399 - protein, 15 aa, Dengue virus
RPQDELIGRARISQG

SEQ ID NO: 256400 - protein, 15 aa, Dengue virus
WYGMEIRPVSEKEEN

SEQ ID NO: 256401 - protein, 15 aa, Dengue virus
AVGLVSILLSSLLKN

SEQ ID NO: 256402 - protein, 15 aa, Dengue virus
TEQYKFQADSPKRLA

SEQ ID NO: 256403 - protein, 15 aa, Dengue virus
HRMDIGVPLLAIGCY

SEQ ID NO: 256404 - protein, 15 aa, Dengue virus
DVPMAGPLVAGGLLI

SEQ ID NO: 256405 - protein, 15 aa, Dengue virus
GAGWSLRETACLGKS

SEQ ID NO: 256406 - protein, 15 aa, Dengue virus
TWALCEVITLATGPL

SEQ ID NO: 256407 - protein, 15 aa, Dengue virus
RWLDARIYADPMALK

SEQ ID NO: 256408 - protein, 15 aa, Dengue virus
WCNLTSTWVTYGTCS

SEQ ID NO: 256409 - protein, 15 aa, Dengue virus
GNIVSSVNMVSRMLL

SEQ ID NO: 256410 - protein, 15 aa, Dengue virus
WPIHKMDLGVPLLAL

SEQ ID NO: 256411 - protein, 15 aa, Dengue virus
KGKVVGLYGNGVVTK

SEQ ID NO: 256412 - protein, 15 aa, Dengue virus
NQAVVLMGLGKGWPI

SEQ ID NO: 256413 - protein, 15 aa, Dengue virus
SCGTGNIVSAVNMTS

SEQ ID NO: 256414 - protein, 15 aa, Dengue virus
AGPMPVTVASAAQRR

SEQ ID NO: 256415 - protein, 15 aa, Dengue virus
QLIMKDGRVLVVPCR

SEQ ID NO: 256416 - protein, 15 aa, Dengue virus
IEESRTIRVLKMVEP

SEQ ID NO: 256417 - protein, 15 aa, Dengue virus
QADSPKRLASAIQKA

SEQ ID NO: 256418 - protein, 15 aa, Dengue virus
SVAARGYISTRVEMG

SEQ ID NO: 256419 - protein, 15 aa, Dengue virus
WDVIPMVTQMAMTDT

SEQ ID NO: 256420 - protein, 15 aa, Dengue virus
RIMQRGLFGYSQIGA

SEQ ID NO: 256421 - protein, 15 aa, Dengue virus
PLQWIASAIILEFFM

SEQ ID NO: 256422 - protein, 15 aa, Dengue virus
ESITLATGPLSTLWE

SEQ ID NO: 256423 - protein, 15 aa, Dengue virus
YYCGGLKNVTEVRGF

SEQ ID NO: 256424 - protein, 15 aa, Dengue virus
DLPVWLSYKVASAGI

SEQ ID NO: 256425 - protein, 15 aa, Dengue virus
FVEGLSGATWVDVVL

SEQ ID NO: 256426 - protein, 15 aa, Dengue virus
DLPVWLAHKVAAEGI

SEQ ID NO: 256427 - protein, 15 aa, Dengue virus
NDIANCLRKSGKKVI

SEQ ID NO: 256428 - protein, 15 aa, Dengue virus
GSLIGLSSRATWAQN

SEQ ID NO: 256429 - protein, 15 aa, Dengue virus
CGSGIFITDNVHTWT

SEQ ID NO: 256430 - protein, 15 aa, Dengue virus
MRCIGISNRDFVEGV

SEQ ID NO: 256431 - protein, 15 aa, Dengue virus
GESRKTFVELMKRGD

SEQ ID NO: 256432 - protein, 15 aa, Dengue virus
VSGNIVSSVNTISKM

SEQ ID NO: 256433 - protein, 15 aa, Dengue virus
MRGAKRMAILGETAW

SEQ ID NO: 256434 - protein, 15 aa, Dengue virus
RGDLPVWLAHKVAAE

SEQ ID NO: 256435 - protein, 15 aa, Dengue virus
GKGWPLHRMDIGVPL

SEQ ID NO: 256436 - protein, 15 aa, Dengue virus
GNGCGLFGKGSLLTC

SEQ ID NO: 256437 - protein, 15 aa, Dengue virus
GSCVTTIAKSKPTLD

SEQ ID NO: 256438 - protein, 15 aa, Dengue virus
PLVAGGLLIACYVIT

SEQ ID NO: 256439 - protein, 15 aa, Dengue virus
RTSWAFCEVLTLATG

SEQ ID NO: 256440 - protein, 15 aa, Dengue virus
KTRKYLPAIIREAIK

SEQ ID NO: 256441 - protein, 15 aa, Dengue virus
WTEQYKFQADSPKRL

SEQ ID NO: 256442 - protein, 15 aa, Dengue virus
FFLIVLLIPEPDRQR

SEQ ID NO: 256443 - protein, 15 aa, Dengue virus
SGNIVSSVNMISRML

SEQ ID NO: 256444 - protein, 15 aa, Dengue virus
ERKKLRPRWLDARVY

SEQ ID NO: 256445 - protein, 15 aa, Dengue virus
EDYGFGMFSTNIWLK

SEQ ID NO: 256446 - protein, 15 aa, Dengue virus
WSYYCAGLKKVTEVK

SEQ ID NO: 256447 - protein, 15 aa, Dengue virus
IKKVRTNAAIGAVFV

SEQ ID NO: 256448 - protein, 15 aa, Dengue virus
EHRREKRSVALVPHV

SEQ ID NO: 256449 - protein, 15 aa, Dengue virus
IVREALKRRLRTLIL

SEQ ID NO: 256450 - protein, 15 aa, Dengue virus
EVLTLATGPVMTLWE

SEQ ID NO: 256451 - protein, 15 aa, Dengue virus
VVGLYGNGVVTKSGT

SEQ ID NO: 256452 - protein, 15 aa, Dengue virus
EFTSKVRSNAALGAI

SEQ ID NO: 256453 - protein, 15 aa, Dengue virus
PISKVDIGVPLLAMG

SEQ ID NO: 256454 - protein, 15 aa, Dengue virus
KGWPLHRMDIGVPLL

SEQ ID NO: 256455 - protein, 15 aa, Dengue virus
EVPFCSHHFHKIFMK

SEQ ID NO: 256456 - protein, 15 aa, Dengue virus
TQTWMSSEGAWKQIQ

SEQ ID NO: 256457 - protein, 15 aa, Dengue virus
RGEQRKTFVELMKRG

SEQ ID NO: 256458 - protein, 15 aa, Dengue virus
CSHHFHKIFMKDGRE

SEQ ID NO: 256459 - protein, 15 aa, Dengue virus
KQRGILGRSQVGVGI

SEQ ID NO: 256460 - protein, 15 aa, Dengue virus
AGPLIAGGMLIACYV

SEQ ID NO: 256461 - protein, 15 aa, Dengue virus
WGNGCGLFGKGSLLT

SEQ ID NO: 256462 - protein, 15 aa, Dengue virus
KKVRSNAAMGAVFTE

SEQ ID NO: 256463 - protein, 15 aa, Dengue virus
LWSNGVLESQMLIPK

SEQ ID NO: 256464 - protein, 15 aa, Dengue virus
RELHKLGKCGSCVYN

SEQ ID NO: 256465 - protein, 15 aa, Dengue virus
PYRTWAYHGSYEAPS

SEQ ID NO: 256466 - protein, 15 aa, Dengue virus
ILCASQILLMRTSWA

SEQ ID NO: 256467 - protein, 15 aa, Dengue virus
RVIQLSRKTFDSEYI

SEQ ID NO: 256468 - protein, 15 aa, Dengue virus
GCVTTMAKNKPTLDI

SEQ ID NO: 256469 - protein, 15 aa, Dengue virus
KRRLRTLILAPTRVV

SEQ ID NO: 256470 - protein, 15 aa, Dengue virus
KELLVTFKNPHAKRQ

SEQ ID NO: 256471 - protein, 15 aa, Dengue virus
EGKIVGLYGNGVVTR

SEQ ID NO: 256472 - protein, 15 aa, Dengue virus
LGSQEGAMHSALAGA

SEQ ID NO: 256473 - protein, 15 aa, Dengue virus
LPVWLAYKVASEGFQ

SEQ ID NO: 256474 - protein, 15 aa, Dengue virus
KRARNRVSTPQGLVK

SEQ ID NO: 256475 - protein, 15 aa, Dengue virus
KHEWMTTEDMLKVWN

SEQ ID NO: 256476 - protein, 15 aa, Dengue virus
RPKWLDARTYSDPLA

SEQ ID NO: 256477 - protein, 15 aa, Dengue virus
MGYWIESQKNGSWKL

SEQ ID NO: 256478 - protein, 15 aa, Dengue virus
LEFFLMVLLIPEPEK

SEQ ID NO: 256479 - protein, 15 aa, Dengue virus
HRREKRSVALAPHVG

SEQ ID NO: 256480 - protein, 15 aa, Dengue virus
DHPYKTWAYHGSYEV

SEQ ID NO: 256481 - protein, 15 aa, Dengue virus
NEAVMAVGVVSILAS

SEQ ID NO: 256482 - protein, 15 aa, Dengue virus
KNDVPLAGPMVAGGL

SEQ ID NO: 256483 - protein, 15 aa, Dengue virus
TWALCEALTLATGPI

SEQ ID NO: 256484 - protein, 15 aa, Dengue virus
LTKPWDVLPMVTQIA

SEQ ID NO: 256485 - protein, 15 aa, Dengue virus
GSASSMVNGVVKLLT

SEQ ID NO: 256486 - protein, 15 aa, Dengue virus
GSTIGKMFETTMRGA

SEQ ID NO: 256487 - protein, 15 aa, Dengue virus
LTAIANQAVVLMGLD

SEQ ID NO: 256488 - protein, 15 aa, Dengue virus
YQFQADSPKRLATAI

SEQ ID NO: 256489 - protein, 15 aa, Dengue virus
TPQDNQLTYVVIAIL

SEQ ID NO: 256490 - protein, 15 aa, Dengue virus
RKRRLTIMDLHPGAG

SEQ ID NO: 256491 - protein, 15 aa, Dengue virus
GSPGKFWNTTIAVST

SEQ ID NO: 256492 - protein, 15 aa, Dengue virus
LWSNGVLESEMIIPK

SEQ ID NO: 256493 - protein, 15 aa, Dengue virus
ATVLMGLGKGWPISK

SEQ ID NO: 256494 - protein, 15 aa, Dengue virus
TTDISEMGANFKAGR

SEQ ID NO: 256495 - protein, 15 aa, Dengue virus
AKRFSKGLFSGQGPM

SEQ ID NO: 256496 - protein, 15 aa, Dengue virus
GTWVDIVLEHGGCVT

SEQ ID NO: 256497 - protein, 15 aa, Dengue virus
RRGDLPVWLAYKVAA

SEQ ID NO: 256498 - protein, 15 aa, Dengue virus
VIQLSRKTFDSEYIK

SEQ ID NO: 256499 - protein, 15 aa, Dengue virus
GCGLFGKGSLVTCAK

SEQ ID NO: 256500 - protein, 15 aa, Dengue virus
VMLLILCASQILLMR

SEQ ID NO: 256501 - protein, 15 aa, Dengue virus
GYWIESALNDTWKME

SEQ ID NO: 256502 - protein, 15 aa, Dengue virus
AKFEKQLGQIMLLIL

SEQ ID NO: 256503 - protein, 15 aa, Dengue virus
GIFVIDNVHTWTEQY

SEQ ID NO: 256504 - protein, 15 aa, Dengue virus
LRTLILAPTRVVAAE

SEQ ID NO: 256505 - protein, 15 aa, Dengue virus
TRAQTWMSSEGAWRQ

SEQ ID NO: 256506 - protein, 15 aa, Dengue virus
KKLGEFGKAKGSRAI

SEQ ID NO: 256507 - protein, 15 aa, Dengue virus
VDLRPASAWTLYAVA

SEQ ID NO: 256508 - protein, 15 aa, Dengue virus
KHAVSRGTAKLRWIV

SEQ ID NO: 256509 - protein, 15 aa, Dengue virus
EAHFTDPSSVAARGY

SEQ ID NO: 256510 - protein, 15 aa, Dengue virus
ARKTFVELMKRGDLP

SEQ ID NO: 256511 - protein, 15 aa, Dengue virus
RGAKRMAILGDTAWD

SEQ ID NO: 256512 - protein, 15 aa, Dengue virus
QVMLLILCASQILLM

SEQ ID NO: 256513 - protein, 15 aa, Dengue virus
LYAVATTIVTPMLRH

SEQ ID NO: 256514 - protein, 15 aa, Dengue virus
NQAVVLMGLGRGWPI

SEQ ID NO: 256515 - protein, 15 aa, Dengue virus
WLGARYLEFEALGFM

SEQ ID NO: 256516 - protein, 15 aa, Dengue virus
KRGDLPVWLAYRVAA

SEQ ID NO: 256517 - protein, 15 aa, Dengue virus
LCESITLATGPLSTL

SEQ ID NO: 256518 - protein, 15 aa, Dengue virus
NMLKRERNRVSTGSQ

SEQ ID NO: 256519 - protein, 15 aa, Dengue virus
YAVATTFITPMMRHT

SEQ ID NO: 256520 - protein, 15 aa, Dengue virus
PTSRTTWSIHATHEW

SEQ ID NO: 256521 - protein, 15 aa, Dengue virus
FAGHLKCRLKMDKLE

SEQ ID NO: 256522 - protein, 15 aa, Dengue virus
KQKGIFGKTQVGVGV

SEQ ID NO: 256523 - protein, 15 aa, Dengue virus
ISTRVGMGEAAAIFM

SEQ ID NO: 256524 - protein, 15 aa, Dengue virus
GLLNGKGPLRMVLAF

SEQ ID NO: 256525 - protein, 15 aa, Dengue virus
SKGLFSGQGPMKLVM

SEQ ID NO: 256526 - protein, 15 aa, Dengue virus
GAMHSALAGATEVDS

SEQ ID NO: 256527 - protein, 15 aa, Dengue virus
LFMALVAFLRFLAIP

SEQ ID NO: 256528 - protein, 15 aa, Dengue virus
HAHHQWMTTEDMLTV

SEQ ID NO: 256529 - protein, 15 aa, Dengue virus
IKHAVSRGTAKLRWI

SEQ ID NO: 256530 - protein, 15 aa, Dengue virus
DIDCWCNLTSTWVTY

SEQ ID NO: 256531 - protein, 15 aa, Dengue virus
RRDLRLASNAICSAV

SEQ ID NO: 256532 - protein, 15 aa, Dengue virus
DGEYRLRGEARKTFV

SEQ ID NO: 256533 - protein, 15 aa, Dengue virus
PSLRTTTVSGKLIHE

SEQ ID NO: 256534 - protein, 15 aa, Dengue virus
PGRFWNTTIAVSTAN

SEQ ID NO: 256535 - protein, 15 aa, Dengue virus
LPVWLAHKVASEGFQ

SEQ ID NO: 256536 - protein, 15 aa, Dengue virus
PLHRMDIGVPLLAIG

SEQ ID NO: 256537 - protein, 15 aa, Dengue virus
TSRTTWSIHASHEWM

SEQ ID NO: 256538 - protein, 15 aa, Dengue virus
LFTGHLKCKVRMEKL

SEQ ID NO: 256539 - protein, 15 aa, Dengue virus
IWYMWLGARYLEFEA

SEQ ID NO: 256540 - protein, 15 aa, Dengue virus
QGKTVWFVPSIKAGN

SEQ ID NO: 256541 - protein, 15 aa, Dengue virus
TRGPSLRTTTVTGKI

SEQ ID NO: 256542 - protein, 15 aa, Dengue virus
TQMAMTDTTPFGQQR

SEQ ID NO: 256543 - protein, 15 aa, Dengue virus
SILASSLLRNDVPMA

SEQ ID NO: 256544 - protein, 15 aa, Dengue virus
LRTTTVSGKLIHEWC

SEQ ID NO: 256545 - protein, 15 aa, Dengue virus
EWCCRSCTMPPLRFR

SEQ ID NO: 256546 - protein, 15 aa, Dengue virus
IENSSVNVSLTAIAN

SEQ ID NO: 256547 - protein, 15 aa, Dengue virus
IDCWCNLTSTWVTYG

SEQ ID NO: 256548 - protein, 15 aa, Dengue virus
AAVLMGLDKGWPLSK

SEQ ID NO: 256549 - protein, 15 aa, Dengue virus
IIREAIKRKLRTLIL

SEQ ID NO: 256550 - protein, 15 aa, Dengue virus
NEAVMAVGVVSILLS

SEQ ID NO: 256551 - protein, 15 aa, Dengue virus
FQADSPKKLASAILN

SEQ ID NO: 256552 - protein, 15 aa, Dengue virus
DHAHWTEAKMLLDNI

SEQ ID NO: 256553 - protein, 15 aa, Dengue virus
CGSLIGLTARATWAT

SEQ ID NO: 256554 - protein, 15 aa, Dengue virus
TRTETWMSSEGAWKQ

SEQ ID NO: 256555 - protein, 15 aa, Dengue virus
TSWALCEVLTLATGP

SEQ ID NO: 256556 - protein, 15 aa, Dengue virus
DPASIAARGYISTRV

SEQ ID NO: 256557 - protein, 15 aa, Dengue virus
ALCEVITLATGPLST

SEQ ID NO: 256558 - protein, 15 aa, Dengue virus
RGGWSYYCGGLKNVT

SEQ ID NO: 256559 - protein, 15 aa, Dengue virus
EQYKFQPESPARVAS

SEQ ID NO: 256560 - protein, 15 aa, Dengue virus
KFQPESPARVASAIL

SEQ ID NO: 256561 - protein, 15 aa, Dengue virus
YRIKQQGILGKTQVG

SEQ ID NO: 256562 - protein, 15 aa, Dengue virus
EGTFHTMWHVTRGAV

SEQ ID NO: 256563 - protein, 15 aa, Dengue virus
WVDVVLEHGSCVTTM

SEQ ID NO: 256564 - protein, 15 aa, Dengue virus
GNGCGLFGKGSLVTC

SEQ ID NO: 256565 - protein, 15 aa, Dengue virus
TACLGKSYAQMWTLM

SEQ ID NO: 256566 - protein, 15 aa, Dengue virus
KLGEFGKAKGSRAIW

SEQ ID NO: 256567 - protein, 15 aa, Dengue virus
SRAIWYMWLGARYLE

SEQ ID NO: 256568 - protein, 15 aa, Dengue virus
GVYRIKQQGILGKTQ

SEQ ID NO: 256569 - protein, 15 aa, Dengue virus
AGPMVAGGLLLAAYV

SEQ ID NO: 256570 - protein, 15 aa, Dengue virus
GPLIAGGMLIACYVI

SEQ ID NO: 256571 - protein, 15 aa, Dengue virus
VGMVSILASALLKND

SEQ ID NO: 256572 - protein, 15 aa, Dengue virus
YWISNGTGNIVASVN

SEQ ID NO: 256573 - protein, 15 aa, Dengue virus
LTAIANQAAVLMGLG

SEQ ID NO: 256574 - protein, 15 aa, Dengue virus
MSTYGWNLVKLMSGK

SEQ ID NO: 256575 - protein, 15 aa, Dengue virus
KSGKRVIQLSRKTFD

SEQ ID NO: 256576 - protein, 15 aa, Dengue virus
GKTVWFVPSIKAGND

SEQ ID NO: 256577 - protein, 15 aa, Dengue virus
ILASALLKNDIPMTG

SEQ ID NO: 256578 - protein, 15 aa, Dengue virus
VTKSGDYVSAITQAE

SEQ ID NO: 256579 - protein, 15 aa, Dengue virus
VIQLSRKTFDSEYVK

SEQ ID NO: 256580 - protein, 15 aa, Dengue virus
STANVSLAAIANQAT

SEQ ID NO: 256581 - protein, 15 aa, Dengue virus
MWTLMYFHRRDLRLA

SEQ ID NO: 256582 - protein, 15 aa, Dengue virus
AWVDLVLEHGGCVTT

SEQ ID NO: 256583 - protein, 15 aa, Dengue virus
CTREEFTRKVRSNAA

SEQ ID NO: 256584 - protein, 15 aa, Dengue virus
TWAYHGSYEVKATGS

SEQ ID NO: 256585 - protein, 15 aa, Dengue virus
NGCGLFGKGGIVTCA

SEQ ID NO: 256586 - protein, 15 aa, Dengue virus
YRIKQRGILGRSQVG

SEQ ID NO: 256587 - protein, 15 aa, Dengue virus
GVVSILASSFLRNDV

SEQ ID NO: 256588 - protein, 15 aa, Dengue virus
TTWSIHASHEWMTTE

SEQ ID NO: 256589 - protein, 15 aa, Dengue virus
YDPKFEKQLGQVMLL

SEQ ID NO: 256590 - protein, 15 aa, Dengue virus
SYYMATLKNVREVKG

SEQ ID NO: 256591 - protein, 15 aa, Dengue virus
FHRRDLRLASMAICS

SEQ ID NO: 256592 - protein, 15 aa, Dengue virus
NLTIMDLHPGAGKTK

SEQ ID NO: 256593 - protein, 15 aa, Dengue virus
QYQFQPESPARVASA

SEQ ID NO: 256594 - protein, 15 aa, Dengue virus
LGSSLLKNDVPLAGP

SEQ ID NO: 256595 - protein, 15 aa, Dengue virus
EMYWVSNASGNIVSS

SEQ ID NO: 256596 - protein, 15 aa, Dengue virus
SKFEKQLGQVMLLIL

SEQ ID NO: 256597 - protein, 15 aa, Dengue virus
KKVIQLSRKTFDSEY

SEQ ID NO: 256598 - protein, 15 aa, Dengue virus
VRSNAAMGAVFTEEN

SEQ ID NO: 256599 - protein, 15 aa, Dengue virus
NYNLVIMDEAHFTDP

SEQ ID NO: 256600 - protein, 15 aa, Dengue virus
ELIMKDGRSLVVPCR

SEQ ID NO: 256601 - protein, 15 aa, Dengue virus
GKIVGLYGNGVVTRS

SEQ ID NO: 256602 - protein, 15 aa, Dengue virus
HATHEWMTTEDMLSV

SEQ ID NO: 256603 - protein, 15 aa, Dengue virus
VSNASGNIVSSVNMI

SEQ ID NO: 256604 - protein, 15 aa, Dengue virus
GQVMLLVLCVTQVLL

SEQ ID NO: 256605 - protein, 15 aa, Dengue virus
NTSANLSLTAIANQA

SEQ ID NO: 256606 - protein, 15 aa, Dengue virus
EWMTTEDMLSVWNRV

SEQ ID NO: 256607 - protein, 15 aa, Dengue virus
VPMSTYGWNLVKLMS

SEQ ID NO: 256608 - protein, 15 aa, Dengue virus
MRCIGIGNRDFVEGV

SEQ ID NO: 256609 - protein, 15 aa, Dengue virus
KSYAQMWQLMYFHRR

SEQ ID NO: 256610 - protein, 15 aa, Dengue virus
GTYGLNTFTNMEAQL

SEQ ID NO: 256611 - protein, 15 aa, Dengue virus
PMATYGWNLVKLHSG

SEQ ID NO: 256612 - protein, 15 aa, Dengue virus
GWPISKMDIGVPLLA

SEQ ID NO: 256613 - protein, 15 aa, Dengue virus
GEERVILAGPIPVTP

SEQ ID NO: 256614 - protein, 15 aa, Dengue virus
EESRTIRVLSLVENW

SEQ ID NO: 256615 - protein, 15 aa, Dengue virus
NRVSTGSQLAKRFSK

SEQ ID NO: 256616 - protein, 15 aa, Dengue virus
DTRTQTWMSSEGAWK

SEQ ID NO: 256617 - protein, 15 aa, Dengue virus
GGWSYYCAGLKKVTE

SEQ ID NO: 256618 - protein, 15 aa, Dengue virus
FVPSIKAGNDIAACL

SEQ ID NO: 256619 - protein, 15 aa, Dengue virus
TLYAVATTIITPMLR

SEQ ID NO: 256620 - protein, 15 aa, Dengue virus
PDTIETLMLLTLIAV

SEQ ID NO: 256621 - protein, 15 aa, Dengue virus
DIGVPLLAIGCYSQV

SEQ ID NO: 256622 - protein, 15 aa, Dengue virus
ASEMAEALKGLPIRY

SEQ ID NO: 256623 - protein, 15 aa, Dengue virus
GSGIFITDNVHTWTE

SEQ ID NO: 256624 - protein, 15 aa, Dengue virus
KTWLVHRQWFLNLPL

SEQ ID NO: 256625 - protein, 15 aa, Dengue virus
ADSPKKLASAILNAH

SEQ ID NO: 256626 - protein, 15 aa, Dengue virus
EELPETMETLLLLGL

SEQ ID NO: 256627 - protein, 15 aa, Dengue virus
EIVDLMCHATFTTRL

SEQ ID NO: 256628 - protein, 15 aa, Dengue virus
IENTTANISLAAIAN

SEQ ID NO: 256629 - protein, 15 aa, Dengue virus
RRREKRSVALAPHVG

SEQ ID NO: 256630 - protein, 15 aa, Dengue virus
VHYAIIGPGLQAKAT

SEQ ID NO: 256631 - protein, 15 aa, Dengue virus
AIANQAAILMGLDKG

SEQ ID NO: 256632 - protein, 15 aa, Dengue virus
TWVDIVLEHGGCVTT

SEQ ID NO: 256633 - protein, 15 aa, Dengue virus
NRDFVEGVSGGAWVD

SEQ ID NO: 256634 - protein, 15 aa, Dengue virus
LCVTQVLLMRTTWAL

SEQ ID NO: 256635 - protein, 15 aa, Dengue virus
DCWCNATSAWVTYGT

SEQ ID NO: 256636 - protein, 15 aa, Dengue virus
NSYSGVEGEGLHRLG

SEQ ID NO: 256637 - protein, 15 aa, Dengue virus
SWPLNEGVMAVGLVS

SEQ ID NO: 256638 - protein, 15 aa, Dengue virus
KNLTIMDLHPGAGKT

SEQ ID NO: 256639 - protein, 15 aa, Dengue virus
LRKNGKRVIQLSRKT

SEQ ID NO: 256640 - protein, 15 aa, Dengue virus
RMAILGETAWDFGSV

SEQ ID NO: 256641 - protein, 15 aa, Dengue virus
IGQMFESTYRGAKRM

SEQ ID NO: 256642 - protein, 15 aa, Dengue virus
LTVCYVLSGSSADLS

SEQ ID NO: 256643 - protein, 15 aa, Dengue virus
GTGNIVASVNTTSRL

SEQ ID NO: 256644 - protein, 15 aa, Dengue virus
RNRVSTGSQLAKRFS

SEQ ID NO: 256645 - protein, 15 aa, Dengue virus
TDPASIAARGYISTR

SEQ ID NO: 256646 - protein, 15 aa, Dengue virus
MLLILCASQILLMRT

SEQ ID NO: 256647 - protein, 15 aa, Dengue virus
GLKNVKEVRGFTKGG

SEQ ID NO: 256648 - protein, 15 aa, Dengue virus
ICTREEFTSKVRSNA

SEQ ID NO: 256649 - protein, 15 aa, Dengue virus
VPSIKTGNDIAACLR

SEQ ID NO: 256650 - protein, 15 aa, Dengue virus
GRELKCGSGIFITNE

SEQ ID NO: 256651 - protein, 15 aa, Dengue virus
YAQMWTLMYFHRRDL

SEQ ID NO: 256652 - protein, 15 aa, Dengue virus
DKGWPLHRMDIGVPL

SEQ ID NO: 256653 - protein, 15 aa, Dengue virus
AVSRGSAKLQWIVER

SEQ ID NO: 256654 - protein, 15 aa, Dengue virus
EMYWVSGATGNIVSS

SEQ ID NO: 256655 - protein, 15 aa, Dengue virus
LIACYVITGTSADLE

SEQ ID NO: 256656 - protein, 15 aa, Dengue virus
FGSAYTALFSGVSWM

SEQ ID NO: 256657 - protein, 15 aa, Dengue virus
LNEAIMAVGLVSILL

SEQ ID NO: 256658 - protein, 15 aa, Dengue virus
TEAKMLLDNIYTPEG

SEQ ID NO: 256659 - protein, 15 aa, Dengue virus
AAILMGLDKGWPLHR

SEQ ID NO: 256660 - protein, 15 aa, Dengue virus
PIRYQTTATKTEHTG

SEQ ID NO: 256661 - protein, 15 aa, Dengue virus
QGPMKMVMAFIAFLR

SEQ ID NO: 256662 - protein, 15 aa, Dengue virus
DGCWYGMEIRPINEK

SEQ ID NO: 256663 - protein, 15 aa, Dengue virus
VRTNAAMGAVFTEEN

SEQ ID NO: 256664 - protein, 15 aa, Dengue virus
GSGQVVTYGLNTFTN

SEQ ID NO: 256665 - protein, 15 aa, Dengue virus
SGATGNIVSSVNMVS

SEQ ID NO: 256666 - protein, 15 aa, Dengue virus
LMGLGKGWPLSKMDL

SEQ ID NO: 256667 - protein, 15 aa, Dengue virus
ENSTANVSLAAIANQ

SEQ ID NO: 256668 - protein, 15 aa, Dengue virus
QEGAMHSALTGATEV

SEQ ID NO: 256669 - protein, 15 aa, Dengue virus
VPLAGPLIAGGMLIA

SEQ ID NO: 256670 - protein, 15 aa, Dengue virus
PMVTQMAMTDTTPFG

SEQ ID NO: 256671 - protein, 15 aa, Dengue virus
IGKMFETTMRGAKRM

SEQ ID NO: 256672 - protein, 15 aa, Dengue virus
REEFTRKVRSNAAIG

SEQ ID NO: 256673 - protein, 15 aa, Dengue virus
GSYLAGAGLAFSLIK

SEQ ID NO: 256674 - protein, 15 aa, Dengue virus
ASVNTTSRLLINRFT

SEQ ID NO: 256675 - protein, 15 aa, Dengue virus
SVNVSLTAIANQAAV

SEQ ID NO: 256676 - protein, 15 aa, Dengue virus
SQVGVGIHMENVFHT

SEQ ID NO: 256677 - protein, 15 aa, Dengue virus
TANISLAAIANQATV

SEQ ID NO: 256678 - protein, 15 aa, Dengue virus
LAAIANQAAILMGLD

SEQ ID NO: 256679 - protein, 15 aa, Dengue virus
SPTVEAGRTLRVLNL

SEQ ID NO: 256680 - protein, 15 aa, Dengue virus
IRYQTTAVKSEHTGK

SEQ ID NO: 256681 - protein, 15 aa, Dengue virus
WTLYAVATTFITPMM

SEQ ID NO: 256682 - protein, 15 aa, Dengue virus
GVFHTMWHVTRGSVI

SEQ ID NO: 256683 - protein, 15 aa, Dengue virus
ALTLATGPVSTLWEG

SEQ ID NO: 256684 - protein, 15 aa, Dengue virus
QPHWIAASIILEFFL

SEQ ID NO: 256685 - protein, 15 aa, Dengue virus
LTAIANQATVLMGLG

SEQ ID NO: 256686 - protein, 15 aa, Dengue virus
LTKPWDVVPMVTQLA

SEQ ID NO: 256687 - protein, 15 aa, Dengue virus
RGDLPVWLSYKVASA

SEQ ID NO: 256688 - protein, 15 aa, Dengue virus
ITVIDLEPVIYDSKF

SEQ ID NO: 256689 - protein, 15 aa, Dengue virus
LGKAYAQMWSLMYFH

SEQ ID NO: 256690 - protein, 15 aa, Dengue virus
SEGVYRIKQRGILGR

SEQ ID NO: 256691 - protein, 15 aa, Dengue virus
AYQHALSELPETLET

SEQ ID NO: 256692 - protein, 15 aa, Dengue virus
LLSSTRVPNYNLIVM

SEQ ID NO: 256693 - protein, 15 aa, Dengue virus
HPGAGKTKRYLPAIV

SEQ ID NO: 256694 - protein, 15 aa, Dengue virus
WAFCEALTLATGPVS

SEQ ID NO: 256695 - protein, 15 aa, Dengue virus
KRQDVIVLGSQEGAM

SEQ ID NO: 256696 - protein, 15 aa, Dengue virus
YKFQPESPARLASAI

SEQ ID NO: 256697 - protein, 15 aa, Dengue virus
TPMLRHSIENSSVNV

SEQ ID NO: 256698 - protein, 15 aa, Dengue virus
RAQTWMSAEGAWRQV

SEQ ID NO: 256699 - protein, 15 aa, Dengue virus
EWMTTEDMLAVWNRV

SEQ ID NO: 256700 - protein, 15 aa, Dengue virus
PNYNLVVMDEAHFTD

SEQ ID NO: 256701 - protein, 15 aa, Dengue virus
HQLIMKDGRVLVVPC

SEQ ID NO: 256702 - protein, 15 aa, Dengue virus
DGVCGVRSTTRLENL

SEQ ID NO: 256703 - protein, 15 aa, Dengue virus
IVAIDLDPISYDAKF

SEQ ID NO: 256704 - protein, 15 aa, Dengue virus
MRTTWALCEVITLAT

SEQ ID NO: 256705 - protein, 15 aa, Dengue virus
GEERVILAGPMPVTH

SEQ ID NO: 256706 - protein, 15 aa, Dengue virus
EMGANFKAERVIDPR

SEQ ID NO: 256707 - protein, 15 aa, Dengue virus
FAGKTVWFVPSIKTG

SEQ ID NO: 256708 - protein, 15 aa, Dengue virus
WAFCESLTLATGPVL

SEQ ID NO: 256709 - protein, 15 aa, Dengue virus
KELKCGNGIFVADNV

SEQ ID NO: 256710 - protein, 15 aa, Dengue virus
LNDWDFVVTTDISEM

SEQ ID NO: 256711 - protein, 15 aa, Dengue virus
QAAILMGLGKGWPLH

SEQ ID NO: 256712 - protein, 15 aa, Dengue virus
PYKTWAYHGSYEVKP

SEQ ID NO: 256713 - protein, 15 aa, Dengue virus
VLMGLDKGWPISKMD

SEQ ID NO: 256714 - protein, 15 aa, Dengue virus
TGLLNGKGPLRMVLA

SEQ ID NO: 256715 - protein, 15 aa, Dengue virus
IMQRGLFGYSQIGAG

SEQ ID NO: 256716 - protein, 15 aa, Dengue virus
TIETLMLLTLLATVT

SEQ ID NO: 256717 - protein, 15 aa, Dengue virus
TIENTSANLSLAAIA

SEQ ID NO: 256718 - protein, 15 aa, Dengue virus
AKRFSRGMLQGQGPM

SEQ ID NO: 256719 - protein, 15 aa, Dengue virus
ASSMINGVVRLLTKP

SEQ ID NO: 256720 - protein, 15 aa, Dengue virus
QVLLMRTTWALCEAL

SEQ ID NO: 256721 - protein, 15 aa, Dengue virus
EWCCRSCTLPPLRYM

SEQ ID NO: 256722 - protein, 15 aa, Dengue virus
VSMANIFRGSYLAGA

SEQ ID NO: 256723 - protein, 15 aa, Dengue virus
PILTLWEGNPGRFWN

SEQ ID NO: 256724 - protein, 15 aa, Dengue virus
VAFLRFLAIPPTAGI

SEQ ID NO: 256725 - protein, 15 aa, Dengue virus
ETACLGKAYAQMWSL

SEQ ID NO: 256726 - protein, 15 aa, Dengue virus
AGWSLKETACLGKSY

SEQ ID NO: 256727 - protein, 15 aa, Dengue virus
IFVIDNVHTWTEQYQ

SEQ ID NO: 256728 - protein, 15 aa, Dengue virus
LLALNDMGKIRKDIQ

SEQ ID NO: 256729 - protein, 15 aa, Dengue virus
MAVGLVSILLSSLLK

SEQ ID NO: 256730 - protein, 15 aa, Dengue virus
SSVAARGYISTRVEM

SEQ ID NO: 256731 - protein, 15 aa, Dengue virus
RDLRLASMAICSAVP

SEQ ID NO: 256732 - protein, 15 aa, Dengue virus
ADMGYWIESRLNDTW

SEQ ID NO: 256733 - protein, 15 aa, Dengue virus
IHAHHQWMTTEDMLT

SEQ ID NO: 256734 - protein, 15 aa, Dengue virus
VGAVTLDFSPGTSGS

SEQ ID NO: 256735 - protein, 15 aa, Dengue virus
TTDISEMGANFKAER

SEQ ID NO: 256736 - protein, 15 aa, Dengue virus
QFCVKVLNPYMPAVI

SEQ ID NO: 256737 - protein, 15 aa, Dengue virus
KMFETTMRGAKRMAI

SEQ ID NO: 256738 - protein, 15 aa, Dengue virus
LRNDVPLAGPLIAGG

SEQ ID NO: 256739 - protein, 15 aa, Dengue virus
ADSPKRLASAIQKAH

SEQ ID NO: 256740 - protein, 15 aa, Dengue virus
PESLETLMLVALLAT

SEQ ID NO: 256741 - protein, 15 aa, Dengue virus
YGNGVVTTSGTYVSA

SEQ ID NO: 256742 - protein, 15 aa, Dengue virus
MQRGLFGYSQIGAGV

SEQ ID NO: 256743 - protein, 15 aa, Dengue virus
GATGNIVSSVNMVSR

SEQ ID NO: 256744 - protein, 15 aa, Dengue virus
GIMTIDLDPVVYDSK

SEQ ID NO: 256745 - protein, 15 aa, Dengue virus
PSFNMLKRARNRVST

SEQ ID NO: 256746 - protein, 15 aa, Dengue virus
LMGLGKGWPIHRMDL

SEQ ID NO: 256747 - protein, 15 aa, Dengue virus
TFTNMEAQLIRQMES

SEQ ID NO: 256748 - protein, 15 aa, Dengue virus
VTTIAKSKPTLDIEL

SEQ ID NO: 256749 - protein, 15 aa, Dengue virus
ISLTAIANQATVLMG

SEQ ID NO: 256750 - protein, 15 aa, Dengue virus
GERKKLRPRWLDARV

SEQ ID NO: 256751 - protein, 15 aa, Dengue virus
PDTIETLMLLTLLAT

SEQ ID NO: 256752 - protein, 15 aa, Dengue virus
VGTYGLNTFTNMEAQ

SEQ ID NO: 256753 - protein, 15 aa, Dengue virus
GPMKLVMAFIAFLRF

SEQ ID NO: 256754 - protein, 15 aa, Dengue virus
FGSVYTTMFGGVSWV

SEQ ID NO: 256755 - protein, 15 aa, Dengue virus
AGVYKEGVFHTMWHV

SEQ ID NO: 256756 - protein, 15 aa, Dengue virus
WCCRSCTLPPLRFKG

SEQ ID NO: 256757 - protein, 15 aa, Dengue virus
SGRGPLKLFMALVAF

SEQ ID NO: 256758 - protein, 15 aa, Dengue virus
LLMRTTWALCEALTL

SEQ ID NO: 256759 - protein, 15 aa, Dengue virus
VALAPHVGMGLETRA

SEQ ID NO: 256760 - protein, 15 aa, Dengue virus
RENSFSGVEGEGLHK

SEQ ID NO: 256761 - protein, 15 aa, Dengue virus
VKRFSSELLSGRGPL

SEQ ID NO: 256762 - protein, 15 aa, Dengue virus
RVIDPRRCLKPVILK

SEQ ID NO: 256763 - protein, 15 aa, Dengue virus
IANQAVVLMGLDKGW

SEQ ID NO: 256764 - protein, 15 aa, Dengue virus
GSCVTTMAKNKPTLD

SEQ ID NO: 256765 - protein, 15 aa, Dengue virus
LGARYLEFEALGFMN

SEQ ID NO: 256766 - protein, 15 aa, Dengue virus
FEKQLGQIMLLILCT

SEQ ID NO: 256767 - protein, 15 aa, Dengue virus
GIFVADNVHTRTEQY

SEQ ID NO: 256768 - protein, 15 aa, Dengue virus
QAAILMGLDKGWPLH

SEQ ID NO: 256769 - protein, 15 aa, Dengue virus
TGNDIAACLRKSGKR

SEQ ID NO: 256770 - protein, 15 aa, Dengue virus
RYLPAMVREAIRRGL

SEQ ID NO: 256771 - protein, 15 aa, Dengue virus
SALLKNDIPMTGPLV

SEQ ID NO: 256772 - protein, 15 aa, Dengue virus
QAVVLMGLGKGWPIH

SEQ ID NO: 256773 - protein, 15 aa, Dengue virus
VSLAAIANQAVVLMG

SEQ ID NO: 256774 - protein, 15 aa, Dengue virus
NETWKLEKASFIEVK

SEQ ID NO: 256775 - protein, 15 aa, Dengue virus
DVDLHPASAWTLYAV

SEQ ID NO: 256776 - protein, 15 aa, Dengue virus
GIFVTDNVHTWTEQY

SEQ ID NO: 256777 - protein, 15 aa, Dengue virus
MEEALKGLPIRYQTP

SEQ ID NO: 256778 - protein, 15 aa, Dengue virus
ADMGYWIESSKNQTW

SEQ ID NO: 256779 - protein, 15 aa, Dengue virus
QAVVLMGLGRGWPIH

SEQ ID NO: 256780 - protein, 15 aa, Dengue virus
YVITGTSADLTVEKA

SEQ ID NO: 256781 - protein, 15 aa, Dengue virus
HAHWTEAKMLLDNIN

SEQ ID NO: 256782 - protein, 15 aa, Dengue virus
YLPAIVREALKRRLR

SEQ ID NO: 256783 - protein, 15 aa, Dengue virus
WQLMYFHRRDLRLAS

SEQ ID NO: 256784 - protein, 15 aa, Dengue virus
QMWTLMYFHRRDLRL

SEQ ID NO: 256785 - protein, 15 aa, Dengue virus
SPNPTIEESRTIRVL

SEQ ID NO: 256786 - protein, 15 aa, Dengue virus
FNMLKRARNRVSTPQ

SEQ ID NO: 256787 - protein, 15 aa, Dengue virus
TRVEMGEAAGIFMTA

SEQ ID NO: 256788 - protein, 15 aa, Dengue virus
GPMPVTVASAAQRRG

SEQ ID NO: 256789 - protein, 15 aa, Dengue virus
SKMDLGVPLLALGCY

SEQ ID NO: 256790 - protein, 15 aa, Dengue virus
ETACLGKSYAQMWAL

SEQ ID NO: 256791 - protein, 15 aa, Dengue virus
GPLKLFMALVAFLRF

SEQ ID NO: 256792 - protein, 15 aa, Dengue virus
YNMVIMDEAHFTDPS

SEQ ID NO: 256793 - protein, 15 aa, Dengue virus
CGLFGKGSLLTCAKF

SEQ ID NO: 256794 - protein, 15 aa, Dengue virus
ILLMRTSWAFCESLT

SEQ ID NO: 256795 - protein, 15 aa, Dengue virus
MLVRNPLSRNSTHEM

SEQ ID NO: 256796 - protein, 15 aa, Dengue virus
VVGLYGNGVVTKNGG

SEQ ID NO: 256797 - protein, 15 aa, Dengue virus
VALVPHVGMGLETRA

SEQ ID NO: 256798 - protein, 15 aa, Dengue virus
SIGQMFESTYRGAKR

SEQ ID NO: 256799 - protein, 15 aa, Dengue virus
CAVQLLLMRTSWALC

SEQ ID NO: 256800 - protein, 15 aa, Dengue virus
VPNYNLVIMDEAHFT

SEQ ID NO: 256801 - protein, 15 aa, Dengue virus
KLRPRWLDARIYSDP

SEQ ID NO: 256802 - protein, 15 aa, Dengue virus
LMRTTWALCEALTLA

SEQ ID NO: 256803 - protein, 15 aa, Dengue virus
TVCYVLSGSSADLSL

SEQ ID NO: 256804 - protein, 15 aa, Dengue virus
MENVFHTMWHVTRGA

SEQ ID NO: 256805 - protein, 15 aa, Dengue virus
GSGKTRKYLPAIIRE

SEQ ID NO: 256806 - protein, 15 aa, Dengue virus
PIHRMDLGVPLLALG

SEQ ID NO: 256807 - protein, 15 aa, Dengue virus
VRSNAAIGAVFVDEN

SEQ ID NO: 256808 - protein, 15 aa, Dengue virus
LPAMVREAIRRGLRT

SEQ ID NO: 256809 - protein, 15 aa, Dengue virus
TAIANQAAILMGLGK

SEQ ID NO: 256810 - protein, 15 aa, Dengue virus
KNGKRVIQLSRKTFD

SEQ ID NO: 256811 - protein, 15 aa, Dengue virus
GSLIGLSSRATWAKN

SEQ ID NO: 256812 - protein, 15 aa, Dengue virus
SWAFCEALTLATGPV

SEQ ID NO: 256813 - protein, 15 aa, Dengue virus
KYLPAIVREAIKRKL

SEQ ID NO: 256814 - protein, 15 aa, Dengue virus
CGSGIFITNNVHTWT

SEQ ID NO: 256815 - protein, 15 aa, Dengue virus
PTIEESRTIRVLSLV

SEQ ID NO: 256816 - protein, 15 aa, Dengue virus
LEFFMMVLLVPEPEK

SEQ ID NO: 256817 - protein, 15 aa, Dengue virus
TRLLSSTRVPNYNLI

SEQ ID NO: 256818 - protein, 15 aa, Dengue virus
QWCCRSCTLPPLRYL

SEQ ID NO: 256819 - protein, 15 aa, Dengue virus
MGYWIESSKNQTWQI

SEQ ID NO: 256820 - protein, 15 aa, Dengue virus
EMYWVSCGTGNIVSA

SEQ ID NO: 256821 - protein, 15 aa, Dengue virus
LDVDLRPASAWTLYA

SEQ ID NO: 256822 - protein, 15 aa, Dengue virus
SYSGVEGEGLHRLGY

SEQ ID NO: 256823 - protein, 15 aa, Dengue virus
LNEAVMAVGVVSILL

SEQ ID NO: 256824 - protein, 15 aa, Dengue virus
RRGDLPVWLSYKVAS

SEQ ID NO: 256825 - protein, 15 aa, Dengue virus
RFLEFEALGFLNEDH

SEQ ID NO: 256826 - protein, 15 aa, Dengue virus
NDQYIYMGQPLNNDE

SEQ ID NO: 256827 - protein, 15 aa, Dengue virus
THEMYWVSNASGNIV

SEQ ID NO: 256828 - protein, 15 aa, Dengue virus
RGARRMAILGDTAWD

SEQ ID NO: 256829 - protein, 15 aa, Dengue virus
EDYGFGVFTTNIWLK

SEQ ID NO: 256830 - protein, 15 aa, Dengue virus
LKETACLGKSYAQMW

SEQ ID NO: 256831 - protein, 15 aa, Dengue virus
ETLLLLALLGAMTAG

SEQ ID NO: 256832 - protein, 15 aa, Dengue virus
RFWNTTIAVSMANIF

SEQ ID NO: 256833 - protein, 15 aa, Dengue virus
PFNMLKRERNRVSTG

SEQ ID NO: 256834 - protein, 15 aa, Dengue virus
VVTRSGAYVSAIAQA

SEQ ID NO: 256835 - protein, 15 aa, Dengue virus
SLIGLTARATWATNI

SEQ ID NO: 256836 - protein, 15 aa, Dengue virus
CLGKSYAQMWTLMYF

SEQ ID NO: 256837 - protein, 15 aa, Dengue virus
AYRHAVEELPETMET

SEQ ID NO: 256838 - protein, 15 aa, Dengue virus
CVTTMAQGKPTLDIE

SEQ ID NO: 256839 - protein, 15 aa, Dengue virus
AIVREALKRRLRTLI

SEQ ID NO: 256840 - protein, 15 aa, Dengue virus
LHKLGKCGSCVYNMM

SEQ ID NO: 256841 - protein, 15 aa, Dengue virus
ANFRAERVIDPRRCL

SEQ ID NO: 256842 - protein, 15 aa, Dengue virus
WVSNASGNIVSSVNM

SEQ ID NO: 256843 - protein, 15 aa, Dengue virus
WCCRSCTLPPLRYMG

SEQ ID NO: 256844 - protein, 15 aa, Dengue virus
DGEYRLRGESRKTFV

SEQ ID NO: 256845 - protein, 15 aa, Dengue virus
EWCCRSCTLPPLRFK

SEQ ID NO: 256846 - protein, 15 aa, Dengue virus
ILTVLLKTALLIVSG

SEQ ID NO: 256847 - protein, 15 aa, Dengue virus
SLLKNDVPLAGPMVA

SEQ ID NO: 256848 - protein, 15 aa, Dengue virus
KFEKQLGQVMLLVLC

SEQ ID NO: 256849 - protein, 15 aa, Dengue virus
DLRLAANAICSAVPV

SEQ ID NO: 256850 - protein, 15 aa, Dengue virus
VIALEPGKNPRAVQT

SEQ ID NO: 256851 - protein, 15 aa, Dengue virus
TIAKNKPTLDIELQK

SEQ ID NO: 256852 - protein, 15 aa, Dengue virus
LLLMRTSWALCEVLT

SEQ ID NO: 256853 - protein, 15 aa, Dengue virus
ASAWTLYAVATTVLT

SEQ ID NO: 256854 - protein, 15 aa, Dengue virus
FIKKVRTNAAIGAVF

SEQ ID NO: 256855 - protein, 15 aa, Dengue virus
GSCVTTMAQGKPTLD

SEQ ID NO: 256856 - protein, 15 aa, Dengue virus
CGIRSATRMENLLWK

SEQ ID NO: 256857 - protein, 15 aa, Dengue virus
ISLTAIANQAVVLMG

SEQ ID NO: 256858 - protein, 15 aa, Dengue virus
GAGKTKRILPSIVRE

SEQ ID NO: 256859 - protein, 15 aa, Dengue virus
KRAAAGIMKNPTVDG

SEQ ID NO: 256860 - protein, 15 aa, Dengue virus
GAVTLDFSPGTSGSP

SEQ ID NO: 256861 - protein, 15 aa, Dengue virus
IKTGNDIAACLRKSG

SEQ ID NO: 256862 - protein, 15 aa, Dengue virus
TWQIEKASLIEVKTC

SEQ ID NO: 256863 - protein, 15 aa, Dengue virus
RNRVSTVQQLTKRFS

SEQ ID NO: 256864 - protein, 15 aa, Dengue virus
SLTAIANQATVLMGL

SEQ ID NO: 256865 - protein, 15 aa, Dengue virus
SWAFCESLTLATGPV

SEQ ID NO: 256866 - protein, 15 aa, Dengue virus
VTFKNAHAKRQDVIV

SEQ ID NO: 256867 - protein, 15 aa, Dengue virus
AIWYMWLGARFLEFE

SEQ ID NO: 256868 - protein, 15 aa, Dengue virus
RFSLGLLSGRGPLKL

SEQ ID NO: 256869 - protein, 15 aa, Dengue virus
HGGCVTTMAKNKPTL

SEQ ID NO: 256870 - protein, 15 aa, Dengue virus
SSRDFVEGVSGGAWV

SEQ ID NO: 256871 - protein, 15 aa, Dengue virus
VIGLYGNGVVTTSGD

SEQ ID NO: 256872 - protein, 15 aa, Dengue virus
AGGLLTVCYVLSGSS

SEQ ID NO: 256873 - protein, 15 aa, Dengue virus
RGTAKLQWFVERNMV

SEQ ID NO: 256874 - protein, 15 aa, Dengue virus
MVMAFIAFLRFLTIP

SEQ ID NO: 256875 - protein, 15 aa, Dengue virus
LLSPVRVPNYNMVIM

SEQ ID NO: 256876 - protein, 15 aa, Dengue virus
MLVTFKNAHAKRQDV

SEQ ID NO: 256877 - protein, 15 aa, Dengue virus
EFFLIVLLIPEPDRQ

SEQ ID NO: 256878 - protein, 15 aa, Dengue virus
ANIFRGSYLAGAGLL

SEQ ID NO: 256879 - protein, 15 aa, Dengue virus
TVEAGRTLRVLNLVE

SEQ ID NO: 256880 - protein, 15 aa, Dengue virus
NRDFVEGLSGATWVD

SEQ ID NO: 256881 - protein, 15 aa, Dengue virus
NIFRGSYLAGAGLLF

SEQ ID NO: 256882 - protein, 15 aa, Dengue virus
RGPSLRTTTASGKLI

SEQ ID NO: 256883 - protein, 15 aa, Dengue virus
EAHFTDPASIAARGY

SEQ ID NO: 256884 - protein, 15 aa, Dengue virus
PWDVVPTVTQMAMTD

SEQ ID NO: 256885 - protein, 15 aa, Dengue virus
TSKVRSNAALGAIFQ

SEQ ID NO: 256886 - protein, 15 aa, Dengue virus
VGLYGNGVVTRSGAY

SEQ ID NO: 256887 - protein, 15 aa, Dengue virus
MPVTHASAAQRRGRI

SEQ ID NO: 256888 - protein, 15 aa, Dengue virus
DGCWYGMEIRPLKEK

SEQ ID NO: 256889 - protein, 15 aa, Dengue virus
LETLMLVALIAVLTG

SEQ ID NO: 256890 - protein, 15 aa, Dengue virus
RGSSIGKMLEATAKG

SEQ ID NO: 256891 - protein, 15 aa, Dengue virus
RVSTVSQLAKRFSRG

SEQ ID NO: 256892 - protein, 15 aa, Dengue virus
TFITPMMRHTIENTT

SEQ ID NO: 256893 - protein, 15 aa, Dengue virus
RKTFVDLMRRGDLPV

SEQ ID NO: 256894 - protein, 15 aa, Dengue virus
QYKFQPESPARLASA

SEQ ID NO: 256895 - protein, 15 aa, Dengue virus
STRVEMGEAAGIFMT

SEQ ID NO: 256896 - protein, 15 aa, Dengue virus
DIVLEHGGCVTTMAK

SEQ ID NO: 256897 - protein, 15 aa, Dengue virus
SLLRNDVPMAGPLVA

SEQ ID NO: 256898 - protein, 15 aa, Dengue virus
RTPQDNQLTYVVIAI

SEQ ID NO: 256899 - protein, 15 aa, Dengue virus
QVPFCSHHFHQLIMK

SEQ ID NO: 256900 - protein, 15 aa, Dengue virus
LLMMRTTWALCEVIT

SEQ ID NO: 256901 - protein, 15 aa, Dengue virus
WDYVVTTDISEMGAN

SEQ ID NO: 256902 - protein, 15 aa, Dengue virus
SVNMVSRMLLNRFTM

SEQ ID NO: 256903 - protein, 15 aa, Dengue virus
GVVKLLTKPWDVIPM

SEQ ID NO: 256904 - protein, 15 aa, Dengue virus
MFEATARGARRMAIL

SEQ ID NO: 256905 - protein, 15 aa, Dengue virus
MRTTWALCEALTLAT

SEQ ID NO: 256906 - protein, 15 aa, Dengue virus
TQVLLMRTTWALCEA

SEQ ID NO: 256907 - protein, 15 aa, Dengue virus
ALLKNDIPMTGPLVA

SEQ ID NO: 256908 - protein, 15 aa, Dengue virus
KGSTIGKMFETTMRG

SEQ ID NO: 256909 - protein, 15 aa, Dengue virus
AKRQDVIVLGSQEGA

SEQ ID NO: 256910 - protein, 15 aa, Dengue virus
HATHQWMTTEDMLSV

SEQ ID NO: 256911 - protein, 15 aa, Dengue virus
YRGAKRMAILGETAW

SEQ ID NO: 256912 - protein, 15 aa, Dengue virus
RFSKGLFSGQGPMKL

SEQ ID NO: 256913 - protein, 15 aa, Dengue virus
LRKNGKKVIQLSRKT

SEQ ID NO: 256914 - protein, 15 aa, Dengue virus
QFQPESPARVASAIL

SEQ ID NO: 256915 - protein, 15 aa, Dengue virus
FCIKILNPYMPSVVE

SEQ ID NO: 256916 - protein, 15 aa, Dengue virus
RFSRGMLQGQGPMKM

SEQ ID NO: 256917 - protein, 15 aa, Dengue virus
GSGIFVVDNVHTWTE

SEQ ID NO: 256918 - protein, 15 aa, Dengue virus
AVTLDFSPGTSGSPI

SEQ ID NO: 256919 - protein, 15 aa, Dengue virus
IGRARISQGAGWSLK

SEQ ID NO: 256920 - protein, 15 aa, Dengue virus
LLGSSLLKNDVPLAG

SEQ ID NO: 256921 - protein, 15 aa, Dengue virus
RGLPIRYQTTATKTE

SEQ ID NO: 256922 - protein, 15 aa, Dengue virus
AAIANQAAILMGLGK

SEQ ID NO: 256923 - protein, 15 aa, Dengue virus
GDLPVWLAHKVAAEG

SEQ ID NO: 256924 - protein, 15 aa, Dengue virus
VVVLGSQEGAMHSAL

SEQ ID NO: 256925 - protein, 15 aa, Dengue virus
EEFIKKVRTNAAIGA

SEQ ID NO: 256926 - protein, 15 aa, Dengue virus
LLSSLLKNDVPLAGP

SEQ ID NO: 256927 - protein, 15 aa, Dengue virus
KRSVALTPHSGTGLE

SEQ ID NO: 256928 - protein, 15 aa, Dengue virus
GVEGEGLHRLGYILE

SEQ ID NO: 256929 - protein, 15 aa, Dengue virus
RPRWLDARVYSDPLA

SEQ ID NO: 256930 - protein, 15 aa, Dengue virus
GLLIACYVITGTSAD

SEQ ID NO: 256931 - protein, 15 aa, Dengue virus
KNGKKVIQLSRKTFD

SEQ ID NO: 256932 - protein, 15 aa, Dengue virus
MVTQMAMTDTTPFGQ

SEQ ID NO: 256933 - protein, 15 aa, Dengue virus
NMCTLMALDLGEFCE

SEQ ID NO: 256934 - protein, 15 aa, Dengue virus
KNQTWQIEKASLIEV

SEQ ID NO: 256935 - protein, 15 aa, Dengue virus
QAVVLMGLDKGWPIS

SEQ ID NO: 256936 - protein, 15 aa, Dengue virus
MYFHRRDLRLAANAI

SEQ ID NO: 256937 - protein, 15 aa, Dengue virus
NCLRKNGKKVIQLSR

SEQ ID NO: 256938 - protein, 15 aa, Dengue virus
VSILASSLLRNDVPM

SEQ ID NO: 256939 - protein, 15 aa, Dengue virus
EDDQYVFMGEPLEND

SEQ ID NO: 256940 - protein, 15 aa, Dengue virus
YKFQPESPKRLSAAI

SEQ ID NO: 256941 - protein, 15 aa, Dengue virus
MAFIAFLRFLAIPPT

SEQ ID NO: 256942 - protein, 15 aa, Dengue virus
PNYNLVIMDEAHFTD

SEQ ID NO: 256943 - protein, 15 aa, Dengue virus
EPSWADVRNDLISYG

SEQ ID NO: 256944 - protein, 15 aa, Dengue virus
IENSTANVSLAAIAN

SEQ ID NO: 256945 - protein, 15 aa, Dengue virus
FRLRGEQRKTFVDLM

SEQ ID NO: 256946 - protein, 15 aa, Dengue virus
PGSGKTRKYLPAIVR

SEQ ID NO: 256947 - protein, 15 aa, Dengue virus
VSSVNMVSRMLLNRF

SEQ ID NO: 256948 - protein, 15 aa, Dengue virus
GWNLVKLYSGKDVFF

SEQ ID NO: 256949 - protein, 15 aa, Dengue virus
LVPHVGMGLETRAQT

SEQ ID NO: 256950 - protein, 15 aa, Dengue virus
KHQWMTTEDMLKVWN

SEQ ID NO: 256951 - protein, 15 aa, Dengue virus
YGWNLVKLYSGKDVF

SEQ ID NO: 256952 - protein, 15 aa, Dengue virus
NDVPLAGPMVAGGLL

SEQ ID NO: 256953 - protein, 15 aa, Dengue virus
FWNTTIAVSMANIFR

SEQ ID NO: 256954 - protein, 15 aa, Dengue virus
KPWDVVPTVTQMAMT

SEQ ID NO: 256955 - protein, 15 aa, Dengue virus
RVSTGSQLAKRFSKG

SEQ ID NO: 256956 - protein, 15 aa, Dengue virus
YISTRVGMGEAAAIF

SEQ ID NO: 256957 - protein, 15 aa, Dengue virus
RMDIGVPLLAIGCYS

SEQ ID NO: 256958 - protein, 15 aa, Dengue virus
GIHMENVFHTMWHVT

SEQ ID NO: 256959 - protein, 15 aa, Dengue virus
ILQRGLLGKTQVGVG

SEQ ID NO: 256960 - protein, 15 aa, Dengue virus
CHATFTMRLLSPVRV

SEQ ID NO: 256961 - protein, 15 aa, Dengue virus
RLRRMAISGDDCVVK

SEQ ID NO: 256962 - protein, 15 aa, Dengue virus
EDGCWYGMEIRPLKE

SEQ ID NO: 256963 - protein, 15 aa, Dengue virus
TTWSIHATHEWMTTE

SEQ ID NO: 256964 - protein, 15 aa, Dengue virus
VVTRSGAYVSAIAQT

SEQ ID NO: 256965 - protein, 15 aa, Dengue virus
KKQDVVVLGSQEGAM

SEQ ID NO: 256966 - protein, 15 aa, Dengue virus
MSAAIKDQRAVHADM

SEQ ID NO: 256967 - protein, 15 aa, Dengue virus
ALLALNDMGKIRKDI

SEQ ID NO: 256968 - protein, 15 aa, Dengue virus
NMLKRARNRVSTPQG

SEQ ID NO: 256969 - protein, 15 aa, Dengue virus
MVSILASALLKNDIP

SEQ ID NO: 256970 - protein, 15 aa, Dengue virus
FFLMVLLIPEPEKQR

SEQ ID NO: 256971 - protein, 15 aa, Dengue virus
KYLPAIIREAIKRKL

SEQ ID NO: 256972 - protein, 15 aa, Dengue virus
AGKTVWFVPSIKTGN

SEQ ID NO: 256973 - protein, 15 aa, Dengue virus
VYTTMFGGVSWVMKI

SEQ ID NO: 256974 - protein, 15 aa, Dengue virus
NGVVRLLTKPWDVLP

SEQ ID NO: 256975 - protein, 15 aa, Dengue virus
SGIFVTNEVHTWTEQ

SEQ ID NO: 256976 - protein, 15 aa, Dengue virus
LALGCYSQVNPLTLI

SEQ ID NO: 256977 - protein, 15 aa, Dengue virus
GGCVTTMAKNKPTLD

SEQ ID NO: 256978 - protein, 15 aa, Dengue virus
SLGLLSGRGPLKLFM

SEQ ID NO: 256979 - protein, 15 aa, Dengue virus
WSYYCGGLKNVTEVR

SEQ ID NO: 256980 - protein, 15 aa, Dengue virus
MAVGVVSILASSFLR

SEQ ID NO: 256981 - protein, 15 aa, Dengue virus
NRVWIRDNPNMTDKT

SEQ ID NO: 256982 - protein, 15 aa, Dengue virus
HFHELIMKDGRSLVV

SEQ ID NO: 256983 - protein, 15 aa, Dengue virus
FITFLRVLSIPPTAG

SEQ ID NO: 256984 - protein, 15 aa, Dengue virus
LCTKAEFCKKVRSNA

SEQ ID NO: 256985 - protein, 15 aa, Dengue virus
FTNMEAQLIRQMEGE

SEQ ID NO: 256986 - protein, 15 aa, Dengue virus
KKGSSIGKMFEATAR

SEQ ID NO: 256987 - protein, 15 aa, Dengue virus
RGYISTRVEMGEAAG

SEQ ID NO: 256988 - protein, 15 aa, Dengue virus
GQVVTYSLNTFTNME

SEQ ID NO: 256989 - protein, 15 aa, Dengue virus
TVEAGRTLRVLSLVE

SEQ ID NO: 256990 - protein, 15 aa, Dengue virus
VPTSRTTWSIHAHHQ

SEQ ID NO: 256991 - protein, 15 aa, Dengue virus
GNIVASVNTTSRLLI

SEQ ID NO: 256992 - protein, 15 aa, Dengue virus
EATARGARRMAILGD

SEQ ID NO: 256993 - protein, 15 aa, Dengue virus
FGTAYGVLFSGVSWT

SEQ ID NO: 256994 - protein, 15 aa, Dengue virus
ARRMAILGDTAWDFG

SEQ ID NO: 256995 - protein, 15 aa, Dengue virus
QYKFQPESPARLATA

SEQ ID NO: 256996 - protein, 15 aa, Dengue virus
GKSYAQMWALMYFHR

SEQ ID NO: 256997 - protein, 15 aa, Dengue virus
LILCASQILLMRTSW

SEQ ID NO: 256998 - protein, 15 aa, Dengue virus
KSWLVHKQWFLDLPL

SEQ ID NO: 256999 - protein, 15 aa, Dengue virus
ERVILAGPMPVTASS

SEQ ID NO: 257000 - protein, 15 aa, Dengue virus
PYKTWAYHGSYEVKA

SEQ ID NO: 257001 - protein, 15 aa, Dengue virus
HELIMKDGRSLVVPC

SEQ ID NO: 257002 - protein, 15 aa, Dengue virus
NPTIEEGRTLRVLKM

SEQ ID NO: 257003 - protein, 15 aa, Dengue virus
PLIAGGMLIACYVIT

SEQ ID NO: 257004 - protein, 15 aa, Dengue virus
MAVGMVSILASALLK

SEQ ID NO: 257005 - protein, 15 aa, Dengue virus
YKTWAYHGSYEVKPT

SEQ ID NO: 257006 - protein, 15 aa, Dengue virus
IAVSMANIFRGSYLA

SEQ ID NO: 257007 - protein, 15 aa, Dengue virus
GEDGCWYGMEIRPVS

SEQ ID NO: 257008 - protein, 15 aa, Dengue virus
IHATHQWMTTEDMLS

SEQ ID NO: 257009 - protein, 15 aa, Dengue virus
EMGANFKAGRVIDPR

SEQ ID NO: 257010 - protein, 15 aa, Dengue virus
VPFCSHHFHELIMKD

SEQ ID NO: 257011 - protein, 15 aa, Dengue virus
RSVALAPHVGMGLET

SEQ ID NO: 257012 - protein, 15 aa, Dengue virus
LLSSLLRNDVPLAGP

SEQ ID NO: 257013 - protein, 15 aa, Dengue virus
ANISLTAIANQATVL

SEQ ID NO: 257014 - protein, 15 aa, Dengue virus
STYRGAKRMAILGDT

SEQ ID NO: 257015 - protein, 15 aa, Dengue virus
QYKFQPESPSRLSAA

SEQ ID NO: 257016 - protein, 15 aa, Dengue virus
FCKKVRSNAAMGAVF

SEQ ID NO: 257017 - protein, 15 aa, Dengue virus
AIANQAAILMGLGKG

SEQ ID NO: 257018 - protein, 15 aa, Dengue virus
TWSIHASHEWMTTED

SEQ ID NO: 257019 - protein, 15 aa, Dengue virus
DIANCLRKNGKKVIQ

SEQ ID NO: 257020 - protein, 15 aa, Dengue virus
GRGGWSYYMATLKNV

SEQ ID NO: 257021 - protein, 15 aa, Dengue virus
DLPVWLAYKVASEGF

SEQ ID NO: 257022 - protein, 15 aa, Dengue virus
LRTTTVTGKIITEWC

SEQ ID NO: 257023 - protein, 15 aa, Dengue virus
SGQVVTYGLNTFTNM

SEQ ID NO: 257024 - protein, 15 aa, Dengue virus
EHRRDKRSVALAPHV

SEQ ID NO: 257025 - protein, 15 aa, Dengue virus
RDFVEGLSGATWVDV

SEQ ID NO: 257026 - protein, 15 aa, Dengue virus
NEGIMAVGMVSILAS

SEQ ID NO: 257027 - protein, 15 aa, Dengue virus
PSSIAARGYISTRVE

SEQ ID NO: 257028 - protein, 15 aa, Dengue virus
VMAVGLVSLLGSSLL

SEQ ID NO: 257029 - protein, 15 aa, Dengue virus
GCVTTIAKNKPTLDI

SEQ ID NO: 257030 - protein, 15 aa, Dengue virus
SGQGPMKLVMAFIAF

SEQ ID NO: 257031 - protein, 15 aa, Dengue virus
AARGYISTRVGMGEA

SEQ ID NO: 257032 - protein, 15 aa, Dengue virus
AGWSLRETACLGKAY

SEQ ID NO: 257033 - protein, 15 aa, Dengue virus
KAWLVHKQWFFDLPL

SEQ ID NO: 257034 - protein, 15 aa, Dengue virus
QVLALEPGKNPKHVQ

SEQ ID NO: 257035 - protein, 15 aa, Dengue virus
QVIALEPGKNPRAVQ

SEQ ID NO: 257036 - protein, 15 aa, Dengue virus
KLKPRWLDARIYADP

SEQ ID NO: 257037 - protein, 15 aa, Dengue virus
NQATVLMGLGKGWPI

SEQ ID NO: 257038 - protein, 15 aa, Dengue virus
REKRSVALAPHVGLG

SEQ ID NO: 257039 - protein, 15 aa, Dengue virus
TIETLMLLTLIAVLT

SEQ ID NO: 257040 - protein, 15 aa, Dengue virus
YKFQPESPARVASAI

SEQ ID NO: 257041 - protein, 15 aa, Dengue virus
EDGCWYGMEIRPVSE

SEQ ID NO: 257042 - protein, 15 aa, Dengue virus
GEQRKTFVELMKRGD

SEQ ID NO: 257043 - protein, 15 aa, Dengue virus
SNGTGNIVASVNTTS

SEQ ID NO: 257044 - protein, 15 aa, Dengue virus
FSTGLLNGKGPLRMV

SEQ ID NO: 257045 - protein, 15 aa, Dengue virus
PISKMDIGVPLLAMG

SEQ ID NO: 257046 - protein, 15 aa, Dengue virus
LVTFKNPHAKRQDVT

SEQ ID NO: 257047 - protein, 15 aa, Dengue virus
VVRLLTKPWDVVPMV

SEQ ID NO: 257048 - protein, 15 aa, Dengue virus
TTMRGAKRMAILGET

SEQ ID NO: 257049 - protein, 15 aa, Dengue virus
AEALKGMPIRYQTTA

SEQ ID NO: 257050 - protein, 15 aa, Dengue virus
KRTAAGIMKNPTVDG

SEQ ID NO: 257051 - protein, 15 aa, Dengue virus
VFHTMWHVTRGAVLT

SEQ ID NO: 257052 - protein, 15 aa, Dengue virus
FLRVLSIPPTAGVLA

SEQ ID NO: 257053 - protein, 15 aa, Dengue virus
KREDLWCGSLIGLSS

SEQ ID NO: 257054 - protein, 15 aa, Dengue virus
VTTMAKNKPTLDIEL

SEQ ID NO: 257055 - protein, 15 aa, Dengue virus
LMRTSWALCEVLTLA

SEQ ID NO: 257056 - protein, 15 aa, Dengue virus
RREKRSVALTPHSGM

SEQ ID NO: 257057 - protein, 15 aa, Dengue virus
MKRGDLPVWLAYKVA

SEQ ID NO: 257058 - protein, 15 aa, Dengue virus
PMVTQIAMTDTTPFG

SEQ ID NO: 257059 - protein, 15 aa, Dengue virus
KCGSGIFVIDNVHTW

SEQ ID NO: 257060 - protein, 15 aa, Dengue virus
GPSLRTTTVTGKIIT

SEQ ID NO: 257061 - protein, 15 aa, Dengue virus
KCGNGIFVADNVHTW

SEQ ID NO: 257062 - protein, 15 aa, Dengue virus
EGAMHSALTGATEVD

SEQ ID NO: 257063 - protein, 15 aa, Dengue virus
ERVILAGPIPVTPSS

SEQ ID NO: 257064 - protein, 15 aa, Dengue virus
DNIYTPEGIIPTLFE

SEQ ID NO: 257065 - protein, 15 aa, Dengue virus
VVLMGLDKGWPISKM

SEQ ID NO: 257066 - protein, 15 aa, Dengue virus
LPIRYQTPAIRAEHT

SEQ ID NO: 257067 - protein, 15 aa, Dengue virus
LLAIGCYSQVNPITL

SEQ ID NO: 257068 - protein, 15 aa, Dengue virus
EAKMLLDNIYTPEGI

SEQ ID NO: 257069 - protein, 15 aa, Dengue virus
HEWMTTEDMLAVWNR

SEQ ID NO: 257070 - protein, 15 aa, Dengue virus
RKLRTLILAPTRVVA

SEQ ID NO: 257071 - protein, 15 aa, Dengue virus
VNTISKMLINRFTMR

SEQ ID NO: 257072 - protein, 15 aa, Dengue virus
GKKVIQLSRKTFDSE

SEQ ID NO: 257073 - protein, 15 aa, Dengue virus
AVVLMGLGRGWPIHR

SEQ ID NO: 257074 - protein, 15 aa, Dengue virus
GGSWVDLVLEHGGCV

SEQ ID NO: 257075 - protein, 15 aa, Dengue virus
SVALTPHSGMGLDTR

SEQ ID NO: 257076 - protein, 15 aa, Dengue virus
EQYKFQPESPSRLSA

SEQ ID NO: 257077 - protein, 15 aa, Dengue virus
TETWMSSEGAWKHAQ

SEQ ID NO: 257078 - protein, 15 aa, Dengue virus
LSKMDLGVPLLALGC

SEQ ID NO: 257079 - protein, 15 aa, Dengue virus
PPTAGVLARWGTFKK

SEQ ID NO: 257080 - protein, 15 aa, Dengue virus
AFIAFLRFLAIPPTA

SEQ ID NO: 257081 - protein, 15 aa, Dengue virus
LVTFKNPHAKRQDVV

SEQ ID NO: 257082 - protein, 15 aa, Dengue virus
AIKRGLRTLILAPTR

SEQ ID NO: 257083 - protein, 15 aa, Dengue virus
TRVVASEMAEALKGM

SEQ ID NO: 257084 - protein, 15 aa, Dengue virus
DWDFVVTTDISEMGA

SEQ ID NO: 257085 - protein, 15 aa, Dengue virus
TWAFCEVLTLATGPI

SEQ ID NO: 257086 - protein, 15 aa, Dengue virus
PVPMSTYGWNIVKLM

SEQ ID NO: 257087 - protein, 15 aa, Dengue virus
RARVSQGAGWSLRET

SEQ ID NO: 257088 - protein, 15 aa, Dengue virus
QIMLLILCTGQLLMM

SEQ ID NO: 257089 - protein, 15 aa, Dengue virus
TVLMGLGKGWPIHKM

SEQ ID NO: 257090 - protein, 15 aa, Dengue virus
LLAAYVMTGRSADLE

SEQ ID NO: 257091 - protein, 15 aa, Dengue virus
WCCRSCTMPPLRFRG

SEQ ID NO: 257092 - protein, 15 aa, Dengue virus
LRGLPIRYQTTATKT

SEQ ID NO: 257093 - protein, 15 aa, Dengue virus
MSAAIKDSKAVHADM

SEQ ID NO: 257094 - protein, 15 aa, Dengue virus
GSYETKQTGSASSMV

SEQ ID NO: 257095 - protein, 15 aa, Dengue virus
LSGRGPLKLFMALVA

SEQ ID NO: 257096 - protein, 15 aa, Dengue virus
QMFESTYRGAKRMAI

SEQ ID NO: 257097 - protein, 15 aa, Dengue virus
VLTPMLRHSIENSSV

SEQ ID NO: 257098 - protein, 15 aa, Dengue virus
EQYKFQPESPKRLSA

SEQ ID NO: 257099 - protein, 15 aa, Dengue virus
IQPQWIASAIILEFF

SEQ ID NO: 257100 - protein, 15 aa, Dengue virus
WMTTEDMLSVWNRVW

SEQ ID NO: 257101 - protein, 15 aa, Dengue virus
VAARGYISTRVEMGE

SEQ ID NO: 257102 - protein, 15 aa, Dengue virus
VVLGSQEGAMHTALT

SEQ ID NO: 257103 - protein, 15 aa, Dengue virus
AAGIMKNPTVDGIVA

SEQ ID NO: 257104 - protein, 15 aa, Dengue virus
SWVDIVLEHGSCVTT

SEQ ID NO: 257105 - protein, 15 aa, Dengue virus
SSKNQTWQIEKASLI

SEQ ID NO: 257106 - protein, 15 aa, Dengue virus
YRLKGESRKTFVELM

SEQ ID NO: 257107 - protein, 15 aa, Dengue virus
FCEALTLATGPVSTL

SEQ ID NO: 257108 - protein, 15 aa, Dengue virus
PGAGKTKRYLPAIVR

SEQ ID NO: 257109 - protein, 15 aa, Dengue virus
KMDIGVPLLAMGCYS

SEQ ID NO: 257110 - protein, 15 aa, Dengue virus
GNGIFVADNVHTWTE

SEQ ID NO: 257111 - protein, 15 aa, Dengue virus
GAIYGAAFSGVSWIM

SEQ ID NO: 257112 - protein, 15 aa, Dengue virus
VTFKVPHAKKQDVVV

SEQ ID NO: 257113 - protein, 15 aa, Dengue virus
VGQLLLMRTSWAFCE

SEQ ID NO: 257114 - protein, 15 aa, Dengue virus
ILASSLLRNDVPMAG

SEQ ID NO: 257115 - protein, 15 aa, Dengue virus
SGRGPLKLFMAFVAF

SEQ ID NO: 257116 - protein, 15 aa, Dengue virus
TYGWNLVKLHSGVDV

SEQ ID NO: 257117 - protein, 15 aa, Dengue virus
RRLRTLILAPTRVVA

SEQ ID NO: 257118 - protein, 15 aa, Dengue virus
KMDLGVPLLALGCYS

SEQ ID NO: 257119 - protein, 15 aa, Dengue virus
RHTIENTSANLSLTA

SEQ ID NO: 257120 - protein, 15 aa, Dengue virus
DGEERVILAGPIPVT

SEQ ID NO: 257121 - protein, 15 aa, Dengue virus
TTIITPMLRHTIENT

SEQ ID NO: 257122 - protein, 15 aa, Dengue virus
GKVVGLYGNGVVTKN

SEQ ID NO: 257123 - protein, 15 aa, Dengue virus
YVITGTSADLELEKA

SEQ ID NO: 257124 - protein, 15 aa, Dengue virus
LKPRWLDARVYADPM

SEQ ID NO: 257125 - protein, 15 aa, Dengue virus
AVNMTSKMLLNRFTT

SEQ ID NO: 257126 - protein, 15 aa, Dengue virus
TWKMERASFIEVKNC

SEQ ID NO: 257127 - protein, 15 aa, Dengue virus
STHEMYWVSNASGNI

SEQ ID NO: 257128 - protein, 15 aa, Dengue virus
RNSTHEMYWVSNASG

SEQ ID NO: 257129 - protein, 15 aa, Dengue virus
AFLRFLTIPPTAGIL

SEQ ID NO: 257130 - protein, 15 aa, Dengue virus
RTAAGIMKNPTVDGI

SEQ ID NO: 257131 - protein, 15 aa, Dengue virus
ELHKLGKCGSCVYNM

SEQ ID NO: 257132 - protein, 15 aa, Dengue virus
LVMAFIAFLRFLAIP

SEQ ID NO: 257133 - protein, 15 aa, Dengue virus
GEYRLRGESRKTFVE

SEQ ID NO: 257134 - protein, 15 aa, Dengue virus
GIFITNEVHTWTEQY

SEQ ID NO: 257135 - protein, 15 aa, Dengue virus
VELQWIASAIVLEFF

SEQ ID NO: 257136 - protein, 15 aa, Dengue virus
VSTANIFRGSYLAGA

SEQ ID NO: 257137 - protein, 15 aa, Dengue virus
EDYGFGVFTTNIWLR

SEQ ID NO: 257138 - protein, 15 aa, Dengue virus
AVGMVSILASALLKN

SEQ ID NO: 257139 - protein, 15 aa, Dengue virus
LSTLWEGSPGRFWNT

SEQ ID NO: 257140 - protein, 15 aa, Dengue virus
KRERNRVSTGSQLAK

SEQ ID NO: 257141 - protein, 15 aa, Dengue virus
LILCASQILLMRTTW

SEQ ID NO: 257142 - protein, 15 aa, Dengue virus
AAIANQAAILMGLDK

SEQ ID NO: 257143 - protein, 15 aa, Dengue virus
QEVVVLGSQEGAMHT

SEQ ID NO: 257144 - protein, 15 aa, Dengue virus
NISLAAIANQATVLM

SEQ ID NO: 257145 - protein, 15 aa, Dengue virus
RRGDLPVWLAHKVAS

SEQ ID NO: 257146 - protein, 15 aa, Dengue virus
REEFIKKVRTNAAIG

SEQ ID NO: 257147 - protein, 15 aa, Dengue virus
VPMATYGWNLVKLYS

SEQ ID NO: 257148 - protein, 15 aa, Dengue virus
GNIVSSVNMISRMLL

SEQ ID NO: 257149 - protein, 15 aa, Dengue virus
VNTTSRLLINRFTMK

SEQ ID NO: 257150 - protein, 15 aa, Dengue virus
KKKLKPRWLDARVYA

SEQ ID NO: 257151 - protein, 15 aa, Dengue virus
HTIENTSANLSLAAI

SEQ ID NO: 257152 - protein, 15 aa, Dengue virus
RQDVTVLGSQEGAMH

SEQ ID NO: 257153 - protein, 15 aa, Dengue virus
TKRYLPAIVREALKR

SEQ ID NO: 257154 - protein, 15 aa, Dengue virus
QRKTFVDLMKRGDLP

SEQ ID NO: 257155 - protein, 15 aa, Dengue virus
AHFTDPSSVAARGYI

SEQ ID NO: 257156 - protein, 15 aa, Dengue virus
LVTFKNPHAKRQDVI

SEQ ID NO: 257157 - protein, 15 aa, Dengue virus
AFIAFLRFLTIPPTA

SEQ ID NO: 257158 - protein, 15 aa, Dengue virus
AKMLLDNINTPEGII

SEQ ID NO: 257159 - protein, 15 aa, Dengue virus
GKTRKYLPAIVREAI

SEQ ID NO: 257160 - protein, 15 aa, Dengue virus
KELKCGSGIFVVDNV

SEQ ID NO: 257161 - protein, 15 aa, Dengue virus
KTGNDIAACLRKSGK

SEQ ID NO: 257162 - protein, 15 aa, Dengue virus
EVQVLALEPGKNPKH

SEQ ID NO: 257163 - protein, 15 aa, Dengue virus
LAAIANQATVLMGLG

SEQ ID NO: 257164 - protein, 15 aa, Dengue virus
LMRRGDLPVWLAYKV

SEQ ID NO: 257165 - protein, 15 aa, Dengue virus
TLYAVATTFITPMMR

SEQ ID NO: 257166 - protein, 15 aa, Dengue virus
NRVSTVSQLAKRFSR

SEQ ID NO: 257167 - protein, 15 aa, Dengue virus
WPLNEGVMAVGLVSL

SEQ ID NO: 257168 - protein, 15 aa, Dengue virus
DGPERVILAGPIPVT

SEQ ID NO: 257169 - protein, 15 aa, Dengue virus
HEWMTTEDMLSVWNR

SEQ ID NO: 257170 - protein, 15 aa, Dengue virus
QWIASSIILEFFLIV

SEQ ID NO: 257171 - protein, 15 aa, Dengue virus
SQILLMRTSWAFCEV

SEQ ID NO: 257172 - protein, 15 aa, Dengue virus
EPIPMATYGWNLVKL

SEQ ID NO: 257173 - protein, 15 aa, Dengue virus
LMKRGDLPVWLAHKV

SEQ ID NO: 257174 - protein, 15 aa, Dengue virus
FSLGLLSGRGPLKLF

SEQ ID NO: 257175 - protein, 15 aa, Dengue virus
LKGMPIRYQTTAVKS

SEQ ID NO: 257176 - protein, 15 aa, Dengue virus
TTDISEMGANFRAER

SEQ ID NO: 257177 - protein, 15 aa, Dengue virus
CLGKSYAQMWALMYF

SEQ ID NO: 257178 - protein, 15 aa, Dengue virus
LMRTSWAFCESLTLA

SEQ ID NO: 257179 - protein, 15 aa, Dengue virus
HAVSRGSAKLQWIVE

SEQ ID NO: 257180 - protein, 15 aa, Dengue virus
RCVGISSRDFVEGVS

SEQ ID NO: 257181 - protein, 15 aa, Dengue virus
VFHTMWHVTRGAVLM

SEQ ID NO: 257182 - protein, 15 aa, Dengue virus
TMRGAKRMAILGETA

SEQ ID NO: 257183 - protein, 15 aa, Dengue virus
WVDLVLEHGGCVTTI

SEQ ID NO: 257184 - protein, 15 aa, Dengue virus
FQPESPARLASAILN

SEQ ID NO: 257185 - protein, 15 aa, Dengue virus
LRHTIENTSANLSLA

SEQ ID NO: 257186 - protein, 15 aa, Dengue virus
THQWMTTEDMLSVWN

SEQ ID NO: 257187 - protein, 15 aa, Dengue virus
SLETLMLVALIAVLT

SEQ ID NO: 257188 - protein, 15 aa, Dengue virus
GGCVTTIAKNKPTLD

SEQ ID NO: 257189 - protein, 15 aa, Dengue virus
SANLSLTAIANQAAI

SEQ ID NO: 257190 - protein, 15 aa, Dengue virus
MVREAIRRGLRTLIL

SEQ ID NO: 257191 - protein, 15 aa, Dengue virus
LPIRYQTTAIKAEHT

SEQ ID NO: 257192 - protein, 15 aa, Dengue virus
EERVILAGPIPVTPS

SEQ ID NO: 257193 - protein, 15 aa, Dengue virus
LIACYVITGTSADLT

SEQ ID NO: 257194 - protein, 15 aa, Dengue virus
IEESRTIRVLSLVEN

SEQ ID NO: 257195 - protein, 15 aa, Dengue virus
FGAIYGAAFSGVSWI

SEQ ID NO: 257196 - protein, 15 aa, Dengue virus
GSQLAKRFSKGLFSG

SEQ ID NO: 257197 - protein, 15 aa, Dengue virus
ISKMDIGVPLLAMGC

SEQ ID NO: 257198 - protein, 15 aa, Dengue virus
GKTVWFVPSIKTGND

SEQ ID NO: 257199 - protein, 15 aa, Dengue virus
GEAAAIFMTATPPGT

SEQ ID NO: 257200 - protein, 15 aa, Dengue virus
FEKQLGQVMLLVLCV

SEQ ID NO: 257201 - protein, 15 aa, Dengue virus
RMAILGETAWDFGSI

SEQ ID NO: 257202 - protein, 15 aa, Dengue virus
TIENTTANISLTAIA

SEQ ID NO: 257203 - protein, 15 aa, Dengue virus
PTIEEGRTLRVLKMV

SEQ ID NO: 257204 - protein, 15 aa, Dengue virus
PGKFWNTTIAVSMAN

SEQ ID NO: 257205 - protein, 15 aa, Dengue virus
ATHEWMTTEDMLSVW

SEQ ID NO: 257206 - protein, 15 aa, Dengue virus
GANFRADRVIDPRRC

SEQ ID NO: 257207 - protein, 15 aa, Dengue virus
GIFITDNVHTWTEQY

SEQ ID NO: 257208 - protein, 15 aa, Dengue virus
HRGSSLRTTTVSGKL

SEQ ID NO: 257209 - protein, 15 aa, Dengue virus
FCIKVLNPYMPTVIE

SEQ ID NO: 257210 - protein, 15 aa, Dengue virus
PQWIASSIILEFFLI

SEQ ID NO: 257211 - protein, 15 aa, Dengue virus
MCHATFTTRLLSSTR

SEQ ID NO: 257212 - protein, 15 aa, Dengue virus
GPMPVTHSSAAQRRG

SEQ ID NO: 257213 - protein, 15 aa, Dengue virus
KGKVIGLYGNGVVTT

SEQ ID NO: 257214 - protein, 15 aa, Dengue virus
DVKKDMISYGGGWRF

SEQ ID NO: 257215 - protein, 15 aa, Dengue virus
NISLTAIANQATVLM

SEQ ID NO: 257216 - protein, 15 aa, Dengue virus
NELPESLETLMLVAL

SEQ ID NO: 257217 - protein, 15 aa, Dengue virus
DGIMTIDLDPVVYDS

SEQ ID NO: 257218 - protein, 15 aa, Dengue virus
VIYDSKFEKQLGQVM

SEQ ID NO: 257219 - protein, 15 aa, Dengue virus
SAAIKDQRAVHADMG

SEQ ID NO: 257220 - protein, 15 aa, Dengue virus
IAFLRFLTIPPTAGI

SEQ ID NO: 257221 - protein, 15 aa, Dengue virus
MAIGIVSILASSLLR

SEQ ID NO: 257222 - protein, 15 aa, Dengue virus
RTWAYHGSYEAPSSG

SEQ ID NO: 257223 - protein, 15 aa, Dengue virus
HHFHELIMKDGRSLV

SEQ ID NO: 257224 - protein, 15 aa, Dengue virus
EVLTLATGPILTLWE

SEQ ID NO: 257225 - protein, 15 aa, Dengue virus
LPVWLAYKVASEGIK

SEQ ID NO: 257226 - protein, 15 aa, Dengue virus
GMPIRYQTTAVKSEH

SEQ ID NO: 257227 - protein, 15 aa, Dengue virus
RSNAALGAVFTEENQ

SEQ ID NO: 257228 - protein, 15 aa, Dengue virus
GLRTLILAPTRVVAS

SEQ ID NO: 257229 - protein, 15 aa, Dengue virus
STIGKMFETTMRGAK

SEQ ID NO: 257230 - protein, 15 aa, Dengue virus
GQIMLLILCTGQLLM

SEQ ID NO: 257231 - protein, 15 aa, Dengue virus
PFCSHHFHKIFMKDG

SEQ ID NO: 257232 - protein, 15 aa, Dengue virus
YRLRGEQRKTFVELM

SEQ ID NO: 257233 - protein, 15 aa, Dengue virus
LTYQNKVVRVQRPAK

SEQ ID NO: 257234 - protein, 15 aa, Dengue virus
TLYAVATTVLTPMLR

SEQ ID NO: 257235 - protein, 15 aa, Dengue virus
PVPMATYGWNLVKLY

SEQ ID NO: 257236 - protein, 15 aa, Dengue virus
VATTFITPMLRHSIE

SEQ ID NO: 257237 - protein, 15 aa, Dengue virus
LLLMRTSWAFCEALT

SEQ ID NO: 257238 - protein, 15 aa, Dengue virus
ARGARRMAILGDTAW

SEQ ID NO: 257239 - protein, 15 aa, Dengue virus
TLMYFHRRDLRLASN

SEQ ID NO: 257240 - protein, 15 aa, Dengue virus
LFGYSQIGAGVYKEG

SEQ ID NO: 257241 - protein, 15 aa, Dengue virus
GSASSMINGVVRLLT

SEQ ID NO: 257242 - protein, 15 aa, Dengue virus
LLTVCYVLSGSSADL

SEQ ID NO: 257243 - protein, 15 aa, Dengue virus
VASEMAEALKGLPIR

SEQ ID NO: 257244 - protein, 15 aa, Dengue virus
GGLLTVCYVLSGSSA

SEQ ID NO: 257245 - protein, 15 aa, Dengue virus
FLMVLLIPEPEKQRT

SEQ ID NO: 257246 - protein, 15 aa, Dengue virus
KGMPIRYQTPAIRAE

SEQ ID NO: 257247 - protein, 15 aa, Dengue virus
DVDCWCNATSTWVMY

SEQ ID NO: 257248 - protein, 15 aa, Dengue virus
KPWDVVPMVTQLAMT

SEQ ID NO: 257249 - protein, 15 aa, Dengue virus
KSGKKVIQLSRKTFD

SEQ ID NO: 257250 - protein, 15 aa, Dengue virus
QMWSLMYFHRRDLRL

SEQ ID NO: 257251 - protein, 15 aa, Dengue virus
EYRLRGESRKTFVEL

SEQ ID NO: 257252 - protein, 15 aa, Dengue virus
SGKTRRYLPAMVREA

SEQ ID NO: 257253 - protein, 15 aa, Dengue virus
ILTLWEGNPGKFWNT

SEQ ID NO: 257254 - protein, 15 aa, Dengue virus
GMLQGQGPMKMVMAF

SEQ ID NO: 257255 - protein, 15 aa, Dengue virus
NIVASVNTTSRLLIN

SEQ ID NO: 257256 - protein, 15 aa, Dengue virus
LPESLETLMLVALIA

SEQ ID NO: 257257 - protein, 15 aa, Dengue virus
LPDTIETLMLLTLLA

SEQ ID NO: 257258 - protein, 15 aa, Dengue virus
RHAVSRGSAKIRWIV

SEQ ID NO: 257259 - protein, 15 aa, Dengue virus
VVASEMAEALKGMPI

SEQ ID NO: 257260 - protein, 15 aa, Dengue virus
VVTYSLNTFTNMEVQ

SEQ ID NO: 257261 - protein, 15 aa, Dengue virus
TGSQLAKRFSKGLFS

SEQ ID NO: 257262 - protein, 15 aa, Dengue virus
AIFKLTYQNKVVRVQ

SEQ ID NO: 257263 - protein, 15 aa, Dengue virus
MATYGWNLVKLHSGV

SEQ ID NO: 257264 - protein, 15 aa, Dengue virus
CWYGMEIRPINEKEE

SEQ ID NO: 257265 - protein, 15 aa, Dengue virus
VIVLGSQEGAMRTAL

SEQ ID NO: 257266 - protein, 15 aa, Dengue virus
VFHTMWHVTRGSVIC

SEQ ID NO: 257267 - protein, 15 aa, Dengue virus
PWDVLPMVTQIAMTD

SEQ ID NO: 257268 - protein, 15 aa, Dengue virus
PPTAGILARWGSFKK

SEQ ID NO: 257269 - protein, 15 aa, Dengue virus
MCTREEFIKKVRTNA

SEQ ID NO: 257270 - protein, 15 aa, Dengue virus
GMVSILASALLKNDI

SEQ ID NO: 257271 - protein, 15 aa, Dengue virus
VLTLATGPILTLWEG

SEQ ID NO: 257272 - protein, 15 aa, Dengue virus
IGLYGNGVVTTSGDY

SEQ ID NO: 257273 - protein, 15 aa, Dengue virus
ALVPHVGMGLETRTE

SEQ ID NO: 257274 - protein, 15 aa, Dengue virus
CGNGIFVADNVHTWT

SEQ ID NO: 257275 - protein, 15 aa, Dengue virus
CTGQLLMMRTTWALC

SEQ ID NO: 257276 - protein, 15 aa, Dengue virus
ISKVDIGVPLLAMGC

SEQ ID NO: 257277 - protein, 15 aa, Dengue virus
NMEAQLIRQMESEGI

SEQ ID NO: 257278 - protein, 15 aa, Dengue virus
VPFCSHHFHQLIMKD

SEQ ID NO: 257279 - protein, 15 aa, Dengue virus
GAGWSLRETACLGKA

SEQ ID NO: 257280 - protein, 15 aa, Dengue virus
GKELKCGSGIFVTNE

SEQ ID NO: 257281 - protein, 15 aa, Dengue virus
YAVATTIVTPMLRHT

SEQ ID NO: 257282 - protein, 15 aa, Dengue virus
PMATYGWNLVKLYSG

SEQ ID NO: 257283 - protein, 15 aa, Dengue virus
DVVPMVTQLAMTDTT

SEQ ID NO: 257284 - protein, 15 aa, Dengue virus
NSWSGVEGEGLHRLG

SEQ ID NO: 257285 - protein, 15 aa, Dengue virus
QWIASAIVLEFFMMV

SEQ ID NO: 257286 - protein, 15 aa, Dengue virus
DSKLMSAAIKDQRAV

SEQ ID NO: 257287 - protein, 15 aa, Dengue virus
RSGILEVDRTLAKEG

SEQ ID NO: 257288 - protein, 15 aa, Dengue virus
KTVWFVPSIKTGNDI

SEQ ID NO: 257289 - protein, 15 aa, Dengue virus
VILAGPMPVTVASAA

SEQ ID NO: 257290 - protein, 15 aa, Dengue virus
YNHALNELPESLETL

SEQ ID NO: 257291 - protein, 15 aa, Dengue virus
QLAKRFSRGMLQGQG

SEQ ID NO: 257292 - protein, 15 aa, Dengue virus
KRQDVTVLGSQEGAM

SEQ ID NO: 257293 - protein, 15 aa, Dengue virus
TKRILPSIVREAIKR

SEQ ID NO: 257294 - protein, 15 aa, Dengue virus
AKGSRAIWYMWLGAR

SEQ ID NO: 257295 - protein, 15 aa, Dengue virus
AVVLMGLDKGWPISK

SEQ ID NO: 257296 - protein, 15 aa, Dengue virus
LSLAAIANQAAILMG

SEQ ID NO: 257297 - protein, 15 aa, Dengue virus
STYGWNLVRLQSGVD

SEQ ID NO: 257298 - protein, 15 aa, Dengue virus
YRLKGEARKTFVELM

SEQ ID NO: 257299 - protein, 15 aa, Dengue virus
PRWLDARIYSDPLAL

SEQ ID NO: 257300 - protein, 15 aa, Dengue virus
GGLKNVKEVRGFTKG

SEQ ID NO: 257301 - protein, 15 aa, Dengue virus
ENSYSGVEGEGLHRL

SEQ ID NO: 257302 - protein, 15 aa, Dengue virus
VVTKSGTYVSAITQA

SEQ ID NO: 257303 - protein, 15 aa, Dengue virus
LLRNDVPMAGPLVAG

SEQ ID NO: 257304 - protein, 15 aa, Dengue virus
HHFHELVMKDGRKLV

SEQ ID NO: 257305 - protein, 15 aa, Dengue virus
IFKLTYQNKVVRVQR

SEQ ID NO: 257306 - protein, 15 aa, Dengue virus
FWNTTIAVSTANIFR

SEQ ID NO: 257307 - protein, 15 aa, Dengue virus
PLLAIGCYSQVNPIT

SEQ ID NO: 257308 - protein, 15 aa, Dengue virus
KDLLVTFKTAHAKKQ

SEQ ID NO: 257309 - protein, 15 aa, Dengue virus
LRHTIENTSANLSLT

SEQ ID NO: 257310 - protein, 15 aa, Dengue virus
ARGYISTRVGMGEAA

SEQ ID NO: 257311 - protein, 15 aa, Dengue virus
LSPVRVPNYNLIIMD

SEQ ID NO: 257312 - protein, 15 aa, Dengue virus
ACYVITGTSADLTVE

SEQ ID NO: 257313 - protein, 15 aa, Dengue virus
LCTREEFTRKVRSNA

SEQ ID NO: 257314 - protein, 15 aa, Dengue virus
NPTIEESRTIRVLKM

SEQ ID NO: 257315 - protein, 15 aa, Dengue virus
VYKEGVFHTMWHVTR

SEQ ID NO: 257316 - protein, 15 aa, Dengue virus
GLNTFTNMEVQLIRQ

SEQ ID NO: 257317 - protein, 15 aa, Dengue virus
MRHTIENTTANISLT

SEQ ID NO: 257318 - protein, 15 aa, Dengue virus
VILAGPMPVTAASAA

SEQ ID NO: 257319 - protein, 15 aa, Dengue virus
HRRDKRSVALVPHVG

SEQ ID NO: 257320 - protein, 15 aa, Dengue virus
WDVLPMVTQIAMTDT

SEQ ID NO: 257321 - protein, 15 aa, Dengue virus
SMVNGVVRLLTKPWD

SEQ ID NO: 257322 - protein, 15 aa, Dengue virus
KDGEERVVLAGPMPV

SEQ ID NO: 257323 - protein, 15 aa, Dengue virus
EGVCGIRSTTRLENV

SEQ ID NO: 257324 - protein, 15 aa, Dengue virus
QLGQIMLLILCTGQL

SEQ ID NO: 257325 - protein, 15 aa, Dengue virus
QAAVLMGLDKGWPLS

SEQ ID NO: 257326 - protein, 15 aa, Dengue virus
AIDGEYRLRGEARKT

SEQ ID NO: 257327 - protein, 15 aa, Dengue virus
IWYMWLGARFLEFEA

SEQ ID NO: 257328 - protein, 15 aa, Dengue virus
TTMRGAKRMAILGDT

SEQ ID NO: 257329 - protein, 15 aa, Dengue virus
CTREEFTSKVRSNAA

SEQ ID NO: 257330 - protein, 15 aa, Dengue virus
MYWVSNASGNIVSSV

SEQ ID NO: 257331 - protein, 15 aa, Dengue virus
KCGSGIFITDNVHTW

SEQ ID NO: 257332 - protein, 15 aa, Dengue virus
KAWLVHKQWFLNLPL

SEQ ID NO: 257333 - protein, 15 aa, Dengue virus
RTLILAPTRVVASEM

SEQ ID NO: 257334 - protein, 15 aa, Dengue virus
RGILGRSQVGVGIHM

SEQ ID NO: 257335 - protein, 9 aa, Dengue virus
LDKGWPLHR

SEQ ID NO: 257336 - protein, 9 aa, Dengue virus
AKGSRAIWY

SEQ ID NO: 257337 - protein, 9 aa, Dengue virus
FWNTTIAVS

SEQ ID NO: 257338 - protein, 9 aa, Dengue virus
YEVKPTGSA

SEQ ID NO: 257339 - protein, 9 aa, Dengue virus
LYAVATTFI

SEQ ID NO: 257340 - protein, 9 aa, Dengue virus
VTASSAAQR

SEQ ID NO: 257341 - protein, 9 aa, Dengue virus
FVEGLSGAT

SEQ ID NO: 257342 - protein, 9 aa, Dengue virus
MHSALAGAT

SEQ ID NO: 257343 - protein, 9 aa, Dengue virus
TAKGARRMA

SEQ ID NO: 257344 - protein, 9 aa, Dengue virus
ASSMVNGVV

SEQ ID NO: 257345 - protein, 9 aa, Dengue virus
VILAGPIPV

SEQ ID NO: 257346 - protein, 9 aa, Dengue virus
RSVALVPHV

SEQ ID NO: 257347 - protein, 9 aa, Dengue virus
WSYYMATLK

SEQ ID NO: 257348 - protein, 9 aa, Dengue virus
VWLAHKVAS

SEQ ID NO: 257349 - protein, 9 aa, Dengue virus
LRHTIENTS

SEQ ID NO: 257350 - protein, 9 aa, Dengue virus
FQPESPARV

SEQ ID NO: 257351 - protein, 9 aa, Dengue virus
LRPASAWTL

SEQ ID NO: 257352 - protein, 9 aa, Dengue virus
IVASVNTTS

SEQ ID NO: 257353 - protein, 9 aa, Dengue virus
VGMGLETRA

SEQ ID NO: 257354 - protein, 9 aa, Dengue virus
VWLAYKVAS

SEQ ID NO: 257355 - protein, 9 aa, Dengue virus
FRADRVIDP

SEQ ID NO: 257356 - protein, 9 aa, Dengue virus
FTTRLLSST

SEQ ID NO: 257357 - protein, 9 aa, Dengue virus
NEAVMAVGV

SEQ ID NO: 257358 - protein, 9 aa, Dengue virus
FVEGVSGGT

SEQ ID NO: 257359 - protein, 9 aa, Dengue virus
MGLGRGWPL

SEQ ID NO: 257360 - protein, 9 aa, Dengue virus
PRWLDARIY

SEQ ID NO: 257361 - protein, 9 aa, Dengue virus
MGLDKGWPL

SEQ ID NO: 257362 - protein, 9 aa, Dengue virus
VTHSSAAQR

SEQ ID NO: 257363 - protein, 9 aa, Dengue virus
IRYQTPAVK

SEQ ID NO: 257364 - protein, 9 aa, Dengue virus
ETWMSSEGA

SEQ ID NO: 257365 - protein, 9 aa, Dengue virus
FWNTTIAVS

SEQ ID NO: 257366 - protein, 9 aa, Dengue virus
SILASALLK

SEQ ID NO: 257367 - protein, 9 aa, Dengue virus
AKRFSRGML

SEQ ID NO: 257368 - protein, 9 aa, Dengue virus
MRLLSPVRV

SEQ ID NO: 257369 - protein, 9 aa, Dengue virus
PLVAGGLLT

SEQ ID NO: 257370 - protein, 9 aa, Dengue virus
IANQAVVLM

SEQ ID NO: 257371 - protein, 9 aa, Dengue virus
KRGDLPVWL

SEQ ID NO: 257372 - protein, 9 aa, Dengue virus
IESQKNGSW

SEQ ID NO: 257373 - protein, 9 aa, Dengue virus
LRPASAWTL

SEQ ID NO: 257374 - protein, 9 aa, Dengue virus
FGKAKGSRA

SEQ ID NO: 257375 - protein, 9 aa, Dengue virus
MKMVMAFIA

SEQ ID NO: 257376 - protein, 9 aa, Dengue virus
AGRTLRVLN

SEQ ID NO: 257377 - protein, 9 aa, Dengue virus
ARGYISTRV

SEQ ID NO: 257378 - protein, 9 aa, Dengue virus
MVNGVVKLL

SEQ ID NO: 257379 - protein, 9 aa, Dengue virus
LLVLCAVQL

SEQ ID NO: 257380 - protein, 9 aa, Dengue virus
VILAGPMPV

SEQ ID NO: 257381 - protein, 9 aa, Dengue virus
HQWMTTEDM

SEQ ID NO: 257382 - protein, 9 aa, Dengue virus
LGRGWPIHR

SEQ ID NO: 257383 - protein, 9 aa, Dengue virus
VLALEPGKN

SEQ ID NO: 257384 - protein, 9 aa, Dengue virus
FVEGLSGAT

SEQ ID NO: 257385 - protein, 9 aa, Dengue virus
LVLEHGGCV

SEQ ID NO: 257386 - protein, 9 aa, Dengue virus
FFDLPLPWT

SEQ ID NO: 257387 - protein, 9 aa, Dengue virus
IRRGLRTLI

SEQ ID NO: 257388 - protein, 9 aa, Dengue virus
IFMTATPPG

SEQ ID NO: 257389 - protein, 9 aa, Dengue virus
FSRENSYSG

SEQ ID NO: 257390 - protein, 9 aa, Dengue virus
LKCGSGIFV

SEQ ID NO: 257391 - protein, 9 aa, Dengue virus
PARLASAIL

SEQ ID NO: 257392 - protein, 9 aa, Dengue virus
ILLMRTSWA

SEQ ID NO: 257393 - protein, 9 aa, Dengue virus
LKRARNRVS

SEQ ID NO: 257394 - protein, 9 aa, Dengue virus
CYSQVNPLT

SEQ ID NO: 257395 - protein, 9 aa, Dengue virus
SCTMPPLRF

SEQ ID NO: 257396 - protein, 9 aa, Dengue virus
IKDSKAVHA

SEQ ID NO: 257397 - protein, 9 aa, Dengue virus
MCTLMAMDL

SEQ ID NO: 257398 - protein, 9 aa, Dengue virus
PIRVPNYNL

SEQ ID NO: 257399 - protein, 9 aa, Dengue virus
LLNGKGPLR

SEQ ID NO: 257400 - protein, 9 aa, Dengue virus
WSLRETACL

SEQ ID NO: 257401 - protein, 9 aa, Dengue virus
CYSQVNPTT

SEQ ID NO: 257402 - protein, 9 aa, Dengue virus
AVSMANIFR

SEQ ID NO: 257403 - protein, 9 aa, Dengue virus
KCKVRMEKL

SEQ ID NO: 257404 - protein, 9 aa, Dengue virus
KLMSAAIKD

SEQ ID NO: 257405 - protein, 9 aa, Dengue virus
VWFVPSIKS

SEQ ID NO: 257406 - protein, 9 aa, Dengue virus
GGMLIACYV

SEQ ID NO: 257407 - protein, 9 aa, Dengue virus
TMAKNKPTL

SEQ ID NO: 257408 - protein, 9 aa, Dengue virus
LILCTGQLL

SEQ ID NO: 257409 - protein, 9 aa, Dengue virus
MGLGKGWPI

SEQ ID NO: 257410 - protein, 9 aa, Dengue virus
LAAIANQAV

SEQ ID NO: 257411 - protein, 9 aa, Dengue virus
ETWMSSEGA

SEQ ID NO: 257412 - protein, 9 aa, Dengue virus
MGLGKGWPL

SEQ ID NO: 257413 - protein, 9 aa, Dengue virus
LGSQEGAMH

SEQ ID NO: 257414 - protein, 9 aa, Dengue virus
PQWIAASII

SEQ ID NO: 257415 - protein, 9 aa, Dengue virus
LKCGSGIFI

SEQ ID NO: 257416 - protein, 9 aa, Dengue virus
FRADRVIDP

SEQ ID NO: 257417 - protein, 9 aa, Dengue virus
FVVDNVHTR

SEQ ID NO: 257418 - protein, 9 aa, Dengue virus
WTEAKMLLD

SEQ ID NO: 257419 - protein, 9 aa, Dengue virus
KKKLKPRWL

SEQ ID NO: 257420 - protein, 9 aa, Dengue virus
MHSALAGAT

SEQ ID NO: 257421 - protein, 9 aa, Dengue virus
PMSTYGWNL

SEQ ID NO: 257422 - protein, 9 aa, Dengue virus
YAQMWSLMY

SEQ ID NO: 257423 - protein, 9 aa, Dengue virus
VTPMLRHTI

SEQ ID NO: 257424 - protein, 9 aa, Dengue virus
LRTTTVSGK

SEQ ID NO: 257425 - protein, 9 aa, Dengue virus
VKATGSASS

SEQ ID NO: 257426 - protein, 9 aa, Dengue virus
WCNATSTWV

SEQ ID NO: 257427 - protein, 9 aa, Dengue virus
MDLGVPLLA

SEQ ID NO: 257428 - protein, 9 aa, Dengue virus
VLTLATGPV

SEQ ID NO: 257429 - protein, 9 aa, Dengue virus
SVNTTSRLL

SEQ ID NO: 257430 - protein, 9 aa, Dengue virus
FTRKVRSNA

SEQ ID NO: 257431 - protein, 9 aa, Dengue virus
IAKNKPTLD

SEQ ID NO: 257432 - protein, 9 aa, Dengue virus
LLALNDMGK

SEQ ID NO: 257433 - protein, 9 aa, Dengue virus
LKRWGTIKK

SEQ ID NO: 257434 - protein, 9 aa, Dengue virus
LTIMDLHPG

SEQ ID NO: 257435 - protein, 9 aa, Dengue virus
VEAGRTLRV

SEQ ID NO: 257436 - protein, 9 aa, Dengue virus
VEAGRTLRV

SEQ ID NO: 257437 - protein, 9 aa, Dengue virus
LLRNDVPLA

SEQ ID NO: 257438 - protein, 9 aa, Dengue virus
IVLEHGSCV

SEQ ID NO: 257439 - protein, 9 aa, Dengue virus
ATFTMRLLS

SEQ ID NO: 257440 - protein, 9 aa, Dengue virus
WQIEKASLI

SEQ ID NO: 257441 - protein, 9 aa, Dengue virus
WALMYFHRR

SEQ ID NO: 257442 - protein, 9 aa, Dengue virus
IKRKLRTLV

SEQ ID NO: 257443 - protein, 9 aa, Dengue virus
LLRNDVPMA

SEQ ID NO: 257444 - protein, 9 aa, Dengue virus
ARGYISTRV

SEQ ID NO: 257445 - protein, 9 aa, Dengue virus
HTALTGATE

SEQ ID NO: 257446 - protein, 9 aa, Dengue virus
FHTMWHVTR

SEQ ID NO: 257447 - protein, 9 aa, Dengue virus
LLKNDVPLA

SEQ ID NO: 257448 - protein, 9 aa, Dengue virus
FCSHHFHQL

SEQ ID NO: 257449 - protein, 9 aa, Dengue virus
LPVWLAHKV

SEQ ID NO: 257450 - protein, 9 aa, Dengue virus
FTNMEAQLI

SEQ ID NO: 257451 - protein, 9 aa, Dengue virus
FSGVSWTMK

SEQ ID NO: 257452 - protein, 9 aa, Dengue virus
LQWIASAIV

SEQ ID NO: 257453 - protein, 9 aa, Dengue virus
LVPHVGMGL

SEQ ID NO: 257454 - protein, 9 aa, Dengue virus
WMTTEDMLS

SEQ ID NO: 257455 - protein, 9 aa, Dengue virus
FEKQLGQVM

SEQ ID NO: 257456 - protein, 9 aa, Dengue virus
IYRIKQKGI

SEQ ID NO: 257457 - protein, 9 aa, Dengue virus
MCTLMAMDL

SEQ ID NO: 257458 - protein, 9 aa, Dengue virus
VRSTTRLEN

SEQ ID NO: 257459 - protein, 9 aa, Dengue virus
IRYQTPAVK

SEQ ID NO: 257460 - protein, 9 aa, Dengue virus
LRRMAISGD

SEQ ID NO: 257461 - protein, 9 aa, Dengue virus
HEWMTTEDM

SEQ ID NO: 257462 - protein, 9 aa, Dengue virus
FVVDNVHTR

SEQ ID NO: 257463 - protein, 9 aa, Dengue virus
GQLLLMRTS

SEQ ID NO: 257464 - protein, 9 aa, Dengue virus
IKRKLRTLI

SEQ ID NO: 257465 - protein, 9 aa, Dengue virus
LQWIASAII

SEQ ID NO: 257466 - protein, 9 aa, Dengue virus
IAACLRKSG

SEQ ID NO: 257467 - protein, 9 aa, Dengue virus
RSVALAPHV

SEQ ID NO: 257468 - protein, 9 aa, Dengue virus
VLSGSSADL

SEQ ID NO: 257469 - protein, 9 aa, Dengue virus
CLRKSGKRV

SEQ ID NO: 257470 - protein, 9 aa, Dengue virus
FVELMRRGD

SEQ ID NO: 257471 - protein, 9 aa, Dengue virus
LMRTTWALC

SEQ ID NO: 257472 - protein, 9 aa, Dengue virus
WCNATSAWV

SEQ ID NO: 257473 - protein, 9 aa, Dengue virus
EEALKGLPI

SEQ ID NO: 257474 - protein, 9 aa, Dengue virus
AIANQATVL

SEQ ID NO: 257475 - protein, 9 aa, Dengue virus
VVLEHGSCV

SEQ ID NO: 257476 - protein, 9 aa, Dengue virus
GCYSQVNPL

SEQ ID NO: 257477 - protein, 9 aa, Dengue virus
FEATARGAR

SEQ ID NO: 257478 - protein, 9 aa, Dengue virus
RVIQLSRKT

SEQ ID NO: 257479 - protein, 9 aa, Dengue virus
FQPESPARV

SEQ ID NO: 257480 - protein, 9 aa, Dengue virus
HLKCKVRME

SEQ ID NO: 257481 - protein, 9 aa, Dengue virus
TRVVASEMA

SEQ ID NO: 257482 - protein, 9 aa, Dengue virus
FQADSPKRL

SEQ ID NO: 257483 - protein, 9 aa, Dengue virus
LILAPTRVV

SEQ ID NO: 257484 - protein, 9 aa, Dengue virus
LTLATGPVS

SEQ ID NO: 257485 - protein, 9 aa, Dengue virus
FGRAKGSRA

SEQ ID NO: 257486 - protein, 9 aa, Dengue virus
IHMENVFHT

SEQ ID NO: 257487 - protein, 9 aa, Dengue virus
LQWIASAIV

SEQ ID NO: 257488 - protein, 9 aa, Dengue virus
VRTNAAIGA

SEQ ID NO: 257489 - protein, 9 aa, Dengue virus
FRADRVIDP

SEQ ID NO: 257490 - protein, 9 aa, Dengue virus
QTWMSSEGA

SEQ ID NO: 257491 - protein, 9 aa, Dengue virus
AYKVAAEGI

SEQ ID NO: 257492 - protein, 9 aa, Dengue virus
LGKGWPIHR

SEQ ID NO: 257493 - protein, 9 aa, Dengue virus
IRSTTRLEN

SEQ ID NO: 257494 - protein, 9 aa, Dengue virus
LNTFTNMEV

SEQ ID NO: 257495 - protein, 9 aa, Dengue virus
FRLRGEQRK

SEQ ID NO: 257496 - protein, 9 aa, Dengue virus
LGRGWPIHR

SEQ ID NO: 257497 - protein, 9 aa, Dengue virus
FINKVRSNA

SEQ ID NO: 257498 - protein, 9 aa, Dengue virus
KRFSLGLLS

SEQ ID NO: 257499 - protein, 9 aa, Dengue virus
NAALGAIFQ

SEQ ID NO: 257500 - protein, 9 aa, Dengue virus
WSLRETACL

SEQ ID NO: 257501 - protein, 9 aa, Dengue virus
FWNTTIAVS

SEQ ID NO: 257502 - protein, 9 aa, Dengue virus
LTAIANQAV

SEQ ID NO: 257503 - protein, 9 aa, Dengue virus
MHSALTGAT

SEQ ID NO: 257504 - protein, 9 aa, Dengue virus
AEFCKKVRS

SEQ ID NO: 257505 - protein, 9 aa, Dengue virus
ITPMLRHTI

SEQ ID NO: 257506 - protein, 9 aa, Dengue virus
MCTLIAMDL

SEQ ID NO: 257507 - protein, 9 aa, Dengue virus
GGLLLAAYV

SEQ ID NO: 257508 - protein, 9 aa, Dengue virus
MGLGKGWPL

SEQ ID NO: 257509 - protein, 9 aa, Dengue virus
LGKGWPIHR

SEQ ID NO: 257510 - protein, 9 aa, Dengue virus
LYAVATTFI

SEQ ID NO: 257511 - protein, 9 aa, Dengue virus
FVEGVSGGS

SEQ ID NO: 257512 - protein, 9 aa, Dengue virus
PMSTYGWNI

SEQ ID NO: 257513 - protein, 9 aa, Dengue virus
LVHRQWFLN

SEQ ID NO: 257514 - protein, 9 aa, Dengue virus
IKDSKAVHA

SEQ ID NO: 257515 - protein, 9 aa, Dengue virus
FSSELLSGR

SEQ ID NO: 257516 - protein, 9 aa, Dengue virus
FSGVSWTMK

SEQ ID NO: 257517 - protein, 9 aa, Dengue virus
EEALKGLPI

SEQ ID NO: 257518 - protein, 9 aa, Dengue virus
ILPDGPERV

SEQ ID NO: 257519 - protein, 9 aa, Dengue virus
FCSHHFHQL

SEQ ID NO: 257520 - protein, 9 aa, Dengue virus
IENSTANVS

SEQ ID NO: 257521 - protein, 9 aa, Dengue virus
ISRMLLNRF

SEQ ID NO: 257522 - protein, 9 aa, Dengue virus
WTLMYFHRR

SEQ ID NO: 257523 - protein, 9 aa, Dengue virus
LNTFTNMEV

SEQ ID NO: 257524 - protein, 9 aa, Dengue virus
FWNTTIAVS

SEQ ID NO: 257525 - protein, 9 aa, Dengue virus
YRLRGEARK

SEQ ID NO: 257526 - protein, 9 aa, Dengue virus
DIPMTGPLV

SEQ ID NO: 257527 - protein, 9 aa, Dengue virus
VVTTSGTYV

SEQ ID NO: 257528 - protein, 9 aa, Dengue virus
FRAERVIDP

SEQ ID NO: 257529 - protein, 9 aa, Dengue virus
WSLKETACL

SEQ ID NO: 257530 - protein, 9 aa, Dengue virus
RVLSIPPTA

SEQ ID NO: 257531 - protein, 9 aa, Dengue virus
YRLKGEARK

SEQ ID NO: 257532 - protein, 9 aa, Dengue virus
AEALKGMPI

SEQ ID NO: 257533 - protein, 9 aa, Dengue virus
ASSMINGVV

SEQ ID NO: 257534 - protein, 9 aa, Dengue virus
FVTNEVHTW

SEQ ID NO: 257535 - protein, 9 aa, Dengue virus
ENTSANLSL

SEQ ID NO: 257536 - protein, 9 aa, Dengue virus
RMAILGETA

SEQ ID NO: 257537 - protein, 9 aa, Dengue virus
FNMLKRERN

SEQ ID NO: 257538 - protein, 9 aa, Dengue virus
ILGDTAWDF

SEQ ID NO: 257539 - protein, 9 aa, Dengue virus
YRGAKRMAI

SEQ ID NO: 257540 - protein, 9 aa, Dengue virus
FKLTYQNKV

SEQ ID NO: 257541 - protein, 9 aa, Dengue virus
LLGKTQVGV

SEQ ID NO: 257542 - protein, 9 aa, Dengue virus
DLPVWLAYR

SEQ ID NO: 257543 - protein, 9 aa, Dengue virus
YETKQTGSA

SEQ ID NO: 257544 - protein, 9 aa, Dengue virus
CYSQVNPLT

SEQ ID NO: 257545 - protein, 9 aa, Dengue virus
LAAIANQAT

SEQ ID NO: 257546 - protein, 9 aa, Dengue virus
ILLMRTSWA

SEQ ID NO: 257547 - protein, 9 aa, Dengue virus
LIGRARISQ

SEQ ID NO: 257548 - protein, 9 aa, Dengue virus
VYNMMGKRE

SEQ ID NO: 257549 - protein, 9 aa, Dengue virus
LFGGVSWMV

SEQ ID NO: 257550 - protein, 9 aa, Dengue virus
IKRGLRTLI

SEQ ID NO: 257551 - protein, 9 aa, Dengue virus
VVLEHGGCV

SEQ ID NO: 257552 - protein, 9 aa, Dengue virus
YCGGLKNVK

SEQ ID NO: 257553 - protein, 9 aa, Dengue virus
IENTTANIS

SEQ ID NO: 257554 - protein, 9 aa, Dengue virus
SRLNDTWKI

SEQ ID NO: 257555 - protein, 9 aa, Dengue virus
TTRMENLLW

SEQ ID NO: 257556 - protein, 9 aa, Dengue virus
GHLKCRLKM

SEQ ID NO: 257557 - protein, 9 aa, Dengue virus
RMAILGDTA

SEQ ID NO: 257558 - protein, 9 aa, Dengue virus
CYVITGRSA

SEQ ID NO: 257559 - protein, 9 aa, Dengue virus
RSVALVPHV

SEQ ID NO: 257560 - protein, 9 aa, Dengue virus
KQWFLNLPL

SEQ ID NO: 257561 - protein, 9 aa, Dengue virus
CVKVLNPYM

SEQ ID NO: 257562 - protein, 9 aa, Dengue virus
LRWFVERNM

SEQ ID NO: 257563 - protein, 9 aa, Dengue virus
LTAIANQAA

SEQ ID NO: 257564 - protein, 9 aa, Dengue virus
WTLYAVATT

SEQ ID NO: 257565 - protein, 9 aa, Dengue virus
LKCGSGIFI

SEQ ID NO: 257566 - protein, 9 aa, Dengue virus
MKRGDLPVW

SEQ ID NO: 257567 - protein, 9 aa, Dengue virus
GQLLLMRTS

SEQ ID NO: 257568 - protein, 9 aa, Dengue virus
YRILQRGLL

SEQ ID NO: 257569 - protein, 9 aa, Dengue virus
VVVLGSQEG

SEQ ID NO: 257570 - protein, 9 aa, Dengue virus
AYVMTGRSA

SEQ ID NO: 257571 - protein, 9 aa, Dengue virus
EGAMRTALT

SEQ ID NO: 257572 - protein, 9 aa, Dengue virus
FEKQLGQVM

SEQ ID NO: 257573 - protein, 9 aa, Dengue virus
WALCEALTL

SEQ ID NO: 257574 - protein, 9 aa, Dengue virus
YWIESSKNQ

SEQ ID NO: 257575 - protein, 9 aa, Dengue virus
IVSSVNMIS

SEQ ID NO: 257576 - protein, 9 aa, Dengue virus
VWFVPSIKA

SEQ ID NO: 257577 - protein, 9 aa, Dengue virus
SRLLINRFT

SEQ ID NO: 257578 - protein, 9 aa, Dengue virus
TRKYLPAIV

SEQ ID NO: 257579 - protein, 9 aa, Dengue virus
FVEGVSGGS

SEQ ID NO: 257580 - protein, 9 aa, Dengue virus
YWIESQKNG

SEQ ID NO: 257581 - protein, 9 aa, Dengue virus
FLAIPPTAG

SEQ ID NO: 257582 - protein, 9 aa, Dengue virus
IYRIKQKGI

SEQ ID NO: 257583 - protein, 9 aa, Dengue virus
LKGLPIRYQ

SEQ ID NO: 257584 - protein, 9 aa, Dengue virus
FHKIFMKDG

SEQ ID NO: 257585 - protein, 9 aa, Dengue virus
IVREAIKRG

SEQ ID NO: 257586 - protein, 9 aa, Dengue virus
FGKGSLLTC

SEQ ID NO: 257587 - protein, 9 aa, Dengue virus
WSIHATHQW

SEQ ID NO: 257588 - protein, 9 aa, Dengue virus
LLVLCAVQL

SEQ ID NO: 257589 - protein, 9 aa, Dengue virus
FKAGRVIDP

SEQ ID NO: 257590 - protein, 9 aa, Dengue virus
FITFLRVLS

SEQ ID NO: 257591 - protein, 9 aa, Dengue virus
TTAIKAEHT

SEQ ID NO: 257592 - protein, 9 aa, Dengue virus
LKCGSGIFV

SEQ ID NO: 257593 - protein, 9 aa, Dengue virus
ISYGGGWKL

SEQ ID NO: 257594 - protein, 9 aa, Dengue virus
WAYHGSYEA

SEQ ID NO: 257595 - protein, 9 aa, Dengue virus
RSGTYVSSI

SEQ ID NO: 257596 - protein, 9 aa, Dengue virus
YRIMQRGLF

SEQ ID NO: 257597 - protein, 9 aa, Dengue virus
WIASAIILE

SEQ ID NO: 257598 - protein, 9 aa, Dengue virus
LIGLTSRAT

SEQ ID NO: 257599 - protein, 9 aa, Dengue virus
IVLEHGSCV

SEQ ID NO: 257600 - protein, 9 aa, Dengue virus
YKFQADSPS

SEQ ID NO: 257601 - protein, 9 aa, Dengue virus
HTALTGATE

SEQ ID NO: 257602 - protein, 9 aa, Dengue virus
NLSLTAIAN

SEQ ID NO: 257603 - protein, 9 aa, Dengue virus
FQADSPKRL

SEQ ID NO: 257604 - protein, 9 aa, Dengue virus
FEATARGAR

SEQ ID NO: 257605 - protein, 9 aa, Dengue virus
TTWSIHAKH

SEQ ID NO: 257606 - protein, 9 aa, Dengue virus
TLYAVATTI

SEQ ID NO: 257607 - protein, 9 aa, Dengue virus
NEGVMAVGL

SEQ ID NO: 257608 - protein, 9 aa, Dengue virus
VWFVPSIKS

SEQ ID NO: 257609 - protein, 9 aa, Dengue virus
LLVLCVTQV

SEQ ID NO: 257610 - protein, 9 aa, Dengue virus
WKMERASFI

SEQ ID NO: 257611 - protein, 9 aa, Dengue virus
CVKILNPYM

SEQ ID NO: 257612 - protein, 9 aa, Dengue virus
PLIAGGMLI

SEQ ID NO: 257613 - protein, 9 aa, Dengue virus
FCESLTLAT

SEQ ID NO: 257614 - protein, 9 aa, Dengue virus
IVASVNTTS

SEQ ID NO: 257615 - protein, 9 aa, Dengue virus
DLRLAANAI

SEQ ID NO: 257616 - protein, 9 aa, Dengue virus
NRVSTPQGL

SEQ ID NO: 257617 - protein, 9 aa, Dengue virus
IWYMWLGAR

SEQ ID NO: 257618 - protein, 9 aa, Dengue virus
VMAFIAFLR

SEQ ID NO: 257619 - protein, 9 aa, Dengue virus
FSGQGPMKL

SEQ ID NO: 257620 - protein, 9 aa, Dengue virus
YLAGAGLLF

SEQ ID NO: 257621 - protein, 9 aa, Dengue virus
ILGDTAWDF

SEQ ID NO: 257622 - protein, 9 aa, Dengue virus
WNLVRLQSG

SEQ ID NO: 257623 - protein, 9 aa, Dengue virus
WALCEVITL

SEQ ID NO: 257624 - protein, 9 aa, Dengue virus
VYNMMGKRE

SEQ ID NO: 257625 - protein, 9 aa, Dengue virus
LIGRARISQ

SEQ ID NO: 257626 - protein, 9 aa, Dengue virus
CVTTIAKSK

SEQ ID NO: 257627 - protein, 9 aa, Dengue virus
GGLLIACYV

SEQ ID NO: 257628 - protein, 9 aa, Dengue virus
FVADNVHTR

SEQ ID NO: 257629 - protein, 9 aa, Dengue virus
VYNMMGKRE

SEQ ID NO: 257630 - protein, 9 aa, Dengue virus
SYLAGAGLL

SEQ ID NO: 257631 - protein, 9 aa, Dengue virus
YWIESSKNQ

SEQ ID NO: 257632 - protein, 9 aa, Dengue virus
ILQRGLLGK

SEQ ID NO: 257633 - protein, 9 aa, Dengue virus
FWNTTIAVS

SEQ ID NO: 257634 - protein, 9 aa, Dengue virus
IRYQTTAIK

SEQ ID NO: 257635 - protein, 9 aa, Dengue virus
MGLGKGWPI

SEQ ID NO: 257636 - protein, 9 aa, Dengue virus
IAVSTANIF

SEQ ID NO: 257637 - protein, 9 aa, Dengue virus
VKDQRAVHA

SEQ ID NO: 257638 - protein, 9 aa, Dengue virus
VKDQRAVHA

SEQ ID NO: 257639 - protein, 9 aa, Dengue virus
KLLTKPWDV

SEQ ID NO: 257640 - protein, 9 aa, Dengue virus
MGLGKGWPI

SEQ ID NO: 257641 - protein, 9 aa, Dengue virus
LIGLSSRAT

SEQ ID NO: 257642 - protein, 9 aa, Dengue virus
WCNLTSTWV

SEQ ID NO: 257643 - protein, 9 aa, Dengue virus
YNLVVMDEA

SEQ ID NO: 257644 - protein, 9 aa, Dengue virus
FLEFEALGF

SEQ ID NO: 257645 - protein, 9 aa, Dengue virus
VILAGPIPV

SEQ ID NO: 257646 - protein, 9 aa, Dengue virus
MWALMYFHR

SEQ ID NO: 257647 - protein, 9 aa, Dengue virus
ITLATGPLS

SEQ ID NO: 257648 - protein, 9 aa, Dengue virus
SELLSGRGP

SEQ ID NO: 257649 - protein, 9 aa, Dengue virus
ATRMENLLW

SEQ ID NO: 257650 - protein, 9 aa, Dengue virus
WYGMEIRPI

SEQ ID NO: 257651 - protein, 9 aa, Dengue virus
GIMAIGIVS

SEQ ID NO: 257652 - protein, 9 aa, Dengue virus
FITNEVHTW

SEQ ID NO: 257653 - protein, 9 aa, Dengue virus
CHATFTMRL

SEQ ID NO: 257654 - protein, 9 aa, Dengue virus
MCTLMAIDL

SEQ ID NO: 257655 - protein, 9 aa, Dengue virus
PIRVPNYNL

SEQ ID NO: 257656 - protein, 9 aa, Dengue virus
YNMVIMDEA

SEQ ID NO: 257657 - protein, 9 aa, Dengue virus
WMTTEDMLT

SEQ ID NO: 257658 - protein, 9 aa, Dengue virus
LVALLATVT

SEQ ID NO: 257659 - protein, 9 aa, Dengue virus
ISLTAIANQ

SEQ ID NO: 257660 - protein, 9 aa, Dengue virus
IMKNPTVDG

SEQ ID NO: 257661 - protein, 9 aa, Dengue virus
VYNMMGKRE

SEQ ID NO: 257662 - protein, 9 aa, Dengue virus
RVIQLSRKT

SEQ ID NO: 257663 - protein, 9 aa, Dengue virus
MAVGLVSLL

SEQ ID NO: 257664 - protein, 9 aa, Dengue virus
LQGQGPMKM

SEQ ID NO: 257665 - protein, 9 aa, Dengue virus
LLMMRTTWA

SEQ ID NO: 257666 - protein, 9 aa, Dengue virus
WLVHKQWFF

SEQ ID NO: 257667 - protein, 9 aa, Dengue virus
LLVLCAVQL

SEQ ID NO: 257668 - protein, 9 aa, Dengue virus
YRLRGEARK

SEQ ID NO: 257669 - protein, 9 aa, Dengue virus
KLLTKPWDV

SEQ ID NO: 257670 - protein, 9 aa, Dengue virus
FVEGVSGGT

SEQ ID NO: 257671 - protein, 9 aa, Dengue virus
TTWSIHAKH

SEQ ID NO: 257672 - protein, 9 aa, Dengue virus
FGVFTTNIW

SEQ ID NO: 257673 - protein, 9 aa, Dengue virus
IRRGLRTLI

SEQ ID NO: 257674 - protein, 9 aa, Dengue virus
SVNTTSRLL

SEQ ID NO: 257675 - protein, 9 aa, Dengue virus
IVMDEAHFT

SEQ ID NO: 257676 - protein, 9 aa, Dengue virus
VIVLGSQEG

SEQ ID NO: 257677 - protein, 9 aa, Dengue virus
WMTTEDMLT

SEQ ID NO: 257678 - protein, 9 aa, Dengue virus
ILGKTQVGV

SEQ ID NO: 257679 - protein, 9 aa, Dengue virus
FSRENSLSG

SEQ ID NO: 257680 - protein, 9 aa, Dengue virus
CGVRSTTRL

SEQ ID NO: 257681 - protein, 9 aa, Dengue virus
MATLKNVRE

SEQ ID NO: 257682 - protein, 9 aa, Dengue virus
WASVKKDLI

SEQ ID NO: 257683 - protein, 9 aa, Dengue virus
MRLLSPVRV

SEQ ID NO: 257684 - protein, 9 aa, Dengue virus
IFVTDNVHT

SEQ ID NO: 257685 - protein, 9 aa, Dengue virus
IAVSTANIF

SEQ ID NO: 257686 - protein, 9 aa, Dengue virus
FLTIPPTAG

SEQ ID NO: 257687 - protein, 9 aa, Dengue virus
LKGMPIRYQ

SEQ ID NO: 257688 - protein, 9 aa, Dengue virus
FVVDNVHTR

SEQ ID NO: 257689 - protein, 9 aa, Dengue virus
YIYMGQPLN

SEQ ID NO: 257690 - protein, 9 aa, Dengue virus
LLSSTRVPN

SEQ ID NO: 257691 - protein, 9 aa, Dengue virus
KLLTKPWDV

SEQ ID NO: 257692 - protein, 9 aa, Dengue virus
FGKGSLVTC

SEQ ID NO: 257693 - protein, 9 aa, Dengue virus
LKCGSGIFV

SEQ ID NO: 257694 - protein, 9 aa, Dengue virus
WKMERASFI

SEQ ID NO: 257695 - protein, 9 aa, Dengue virus
LLVLCVTQV

SEQ ID NO: 257696 - protein, 9 aa, Dengue virus
IALEPGKNP

SEQ ID NO: 257697 - protein, 9 aa, Dengue virus
IWYMWLGAR

SEQ ID NO: 257698 - protein, 9 aa, Dengue virus
ILLMRTTWA

SEQ ID NO: 257699 - protein, 9 aa, Dengue virus
WDYVVTTDI

SEQ ID NO: 257700 - protein, 9 aa, Dengue virus
VSILASSFL

SEQ ID NO: 257701 - protein, 9 aa, Dengue virus
PESLETLML

SEQ ID NO: 257702 - protein, 9 aa, Dengue virus
HRLMSAAIK

SEQ ID NO: 257703 - protein, 9 aa, Dengue virus
LILCASQIL

SEQ ID NO: 257704 - protein, 9 aa, Dengue virus
VIDLEPVIY

SEQ ID NO: 257705 - protein, 9 aa, Dengue virus
LKGLPIRYQ

SEQ ID NO: 257706 - protein, 9 aa, Dengue virus
LTIMDLHPG

SEQ ID NO: 257707 - protein, 9 aa, Dengue virus
KVIQLSRKT

SEQ ID NO: 257708 - protein, 9 aa, Dengue virus
ETLMLVALI

SEQ ID NO: 257709 - protein, 9 aa, Dengue virus
WLVHRQWFL

SEQ ID NO: 257710 - protein, 9 aa, Dengue virus
RSVALVPHV

SEQ ID NO: 257711 - protein, 9 aa, Dengue virus
DLRLAANAI

SEQ ID NO: 257712 - protein, 9 aa, Dengue virus
RLLTKPWDV

SEQ ID NO: 257713 - protein, 9 aa, Dengue virus
AIANQATVL

SEQ ID NO: 257714 - protein, 9 aa, Dengue virus
LLMRTTWAL

SEQ ID NO: 257715 - protein, 9 aa, Dengue virus
IFVTDNVHT

SEQ ID NO: 257716 - protein, 9 aa, Dengue virus
IYRIKQKGI

SEQ ID NO: 257717 - protein, 9 aa, Dengue virus
YVSAIAQTE

SEQ ID NO: 257718 - protein, 9 aa, Dengue virus
ITPMLRHTI

SEQ ID NO: 257719 - protein, 9 aa, Dengue virus
NRVSTGSQL

SEQ ID NO: 257720 - protein, 9 aa, Dengue virus
FKAERVIDP

SEQ ID NO: 257721 - protein, 9 aa, Dengue virus
RVILAGPMP

SEQ ID NO: 257722 - protein, 9 aa, Dengue virus
LTPMLRHSI

SEQ ID NO: 257723 - protein, 9 aa, Dengue virus
FVELMRRGD

SEQ ID NO: 257724 - protein, 9 aa, Dengue virus
IEAGRTLRV

SEQ ID NO: 257725 - protein, 9 aa, Dengue virus
VVLAGPMPV

SEQ ID NO: 257726 - protein, 9 aa, Dengue virus
DMLKVWNRV

SEQ ID NO: 257727 - protein, 9 aa, Dengue virus
FVEGVSGGT

SEQ ID NO: 257728 - protein, 9 aa, Dengue virus
ANIFRGSYL

SEQ ID NO: 257729 - protein, 9 aa, Dengue virus
VILAGPMPV

SEQ ID NO: 257730 - protein, 9 aa, Dengue virus
VMAFIAFLR

SEQ ID NO: 257731 - protein, 9 aa, Dengue virus
IVSSVNTIS

SEQ ID NO: 257732 - protein, 9 aa, Dengue virus
VTRSGAYVS

SEQ ID NO: 257733 - protein, 9 aa, Dengue virus
VWFVPSIKA

SEQ ID NO: 257734 - protein, 9 aa, Dengue virus
EEALRGLPI

SEQ ID NO: 257735 - protein, 9 aa, Dengue virus
IRYQTPAIR

SEQ ID NO: 257736 - protein, 9 aa, Dengue virus
DARIYADPM

SEQ ID NO: 257737 - protein, 9 aa, Dengue virus
WLDARVYSD

SEQ ID NO: 257738 - protein, 9 aa, Dengue virus
LYAVATTII

SEQ ID NO: 257739 - protein, 9 aa, Dengue virus
TTRLENLMW

SEQ ID NO: 257740 - protein, 9 aa, Dengue virus
GKTQVGVGV

SEQ ID NO: 257741 - protein, 9 aa, Dengue virus
ATFTMRLLS

SEQ ID NO: 257742 - protein, 9 aa, Dengue virus
LMAMDLGEM

SEQ ID NO: 257743 - protein, 9 aa, Dengue virus
FKNAHAKRQ

SEQ ID NO: 257744 - protein, 9 aa, Dengue virus
YFHRRDLRL

SEQ ID NO: 257745 - protein, 9 aa, Dengue virus
LKRVRNRVS

SEQ ID NO: 257746 - protein, 9 aa, Dengue virus
GLFGKGSLI

SEQ ID NO: 257747 - protein, 9 aa, Dengue virus
DVPMAGPLV

SEQ ID NO: 257748 - protein, 9 aa, Dengue virus
VYRIKQQGI

SEQ ID NO: 257749 - protein, 9 aa, Dengue virus
FEKQLGQVM

SEQ ID NO: 257750 - protein, 9 aa, Dengue virus
CYVITGTSA

SEQ ID NO: 257751 - protein, 9 aa, Dengue virus
YVSSIAQTE

SEQ ID NO: 257752 - protein, 9 aa, Dengue virus
FTNMEAQLI

SEQ ID NO: 257753 - protein, 9 aa, Dengue virus
LVLEHGGCV

SEQ ID NO: 257754 - protein, 9 aa, Dengue virus
FSGQGPMKL

SEQ ID NO: 257755 - protein, 9 aa, Dengue virus
IVSSVNMVS

SEQ ID NO: 257756 - protein, 9 aa, Dengue virus
LVLEHGGCV

SEQ ID NO: 257757 - protein, 9 aa, Dengue virus
ITPMLRHTI

SEQ ID NO: 257758 - protein, 9 aa, Dengue virus
IRQMEGEGV

SEQ ID NO: 257759 - protein, 9 aa, Dengue virus
PMSTYGWNI

SEQ ID NO: 257760 - protein, 9 aa, Dengue virus
SVNMVSRML

SEQ ID NO: 257761 - protein, 9 aa, Dengue virus
PLLAIGCYS

SEQ ID NO: 257762 - protein, 9 aa, Dengue virus
PQGLVKRFS

SEQ ID NO: 257763 - protein, 9 aa, Dengue virus
LVHKQWFLN

SEQ ID NO: 257764 - protein, 9 aa, Dengue virus
LVALLATVT

SEQ ID NO: 257765 - protein, 9 aa, Dengue virus
IRSVTRLEN

SEQ ID NO: 257766 - protein, 9 aa, Dengue virus
VVSILASSF

SEQ ID NO: 257767 - protein, 9 aa, Dengue virus
GIMAIGIVS

SEQ ID NO: 257768 - protein, 9 aa, Dengue virus
HKMDLGVPL

SEQ ID NO: 257769 - protein, 9 aa, Dengue virus
IFITNNVHT

SEQ ID NO: 257770 - protein, 9 aa, Dengue virus
PKRLATAIA

SEQ ID NO: 257771 - protein, 9 aa, Dengue virus
ITLATGPLS

SEQ ID NO: 257772 - protein, 9 aa, Dengue virus
IVLLIPEPD

SEQ ID NO: 257773 - protein, 9 aa, Dengue virus
ISYGGGWRF

SEQ ID NO: 257774 - protein, 9 aa, Dengue virus
LTLATGPVM

SEQ ID NO: 257775 - protein, 9 aa, Dengue virus
KKKLKPRWL

SEQ ID NO: 257776 - protein, 9 aa, Dengue virus
VVLEHGSCV

SEQ ID NO: 257777 - protein, 9 aa, Dengue virus
LSPVRVPNY

SEQ ID NO: 257778 - protein, 9 aa, Dengue virus
FVDLMRRGD

SEQ ID NO: 257779 - protein, 9 aa, Dengue virus
FCSHHFHEL

SEQ ID NO: 257780 - protein, 9 aa, Dengue virus
CYVITGTSA

SEQ ID NO: 257781 - protein, 9 aa, Dengue virus
YYCAGLKKV

SEQ ID NO: 257782 - protein, 9 aa, Dengue virus
FRKRRLTIM

SEQ ID NO: 257783 - protein, 9 aa, Dengue virus
FEKQLGQVM

SEQ ID NO: 257784 - protein, 9 aa, Dengue virus
MGLGKGWPI

SEQ ID NO: 257785 - protein, 9 aa, Dengue virus
WMTTEDMLK

SEQ ID NO: 257786 - protein, 9 aa, Dengue virus
CYVITGTSA

SEQ ID NO: 257787 - protein, 9 aa, Dengue virus
FEKQLGQIM

SEQ ID NO: 257788 - protein, 9 aa, Dengue virus
LLLMRTSWA

SEQ ID NO: 257789 - protein, 9 aa, Dengue virus
SYYCAGLKK

SEQ ID NO: 257790 - protein, 9 aa, Dengue virus
LRPASAWTL

SEQ ID NO: 257791 - protein, 9 aa, Dengue virus
FGRAKGSRA

SEQ ID NO: 257792 - protein, 9 aa, Dengue virus
IENTSANLS

SEQ ID NO: 257793 - protein, 9 aa, Dengue virus
CGVRSTTRL

SEQ ID NO: 257794 - protein, 9 aa, Dengue virus
AYKVAAEGI

SEQ ID NO: 257795 - protein, 9 aa, Dengue virus
AIANQATVL

SEQ ID NO: 257796 - protein, 9 aa, Dengue virus
IRYQTTAVK

SEQ ID NO: 257797 - protein, 9 aa, Dengue virus
GGMLIACYV

SEQ ID NO: 257798 - protein, 9 aa, Dengue virus
LRTTTASGK

SEQ ID NO: 257799 - protein, 9 aa, Dengue virus
TFVELMKRG

SEQ ID NO: 257800 - protein, 9 aa, Dengue virus
LLTLLATVT

SEQ ID NO: 257801 - protein, 9 aa, Dengue virus
LVSILLSSL

SEQ ID NO: 257802 - protein, 9 aa, Dengue virus
LTLATGPIT

SEQ ID NO: 257803 - protein, 9 aa, Dengue virus
WKLARASFI

SEQ ID NO: 257804 - protein, 9 aa, Dengue virus
MVNGVVRLL

SEQ ID NO: 257805 - protein, 9 aa, Dengue virus
IVSSVNTIS

SEQ ID NO: 257806 - protein, 9 aa, Dengue virus
MGLGKGWPI

SEQ ID NO: 257807 - protein, 9 aa, Dengue virus
IFITNNVHT

SEQ ID NO: 257808 - protein, 9 aa, Dengue virus
MAKNKPTLD

SEQ ID NO: 257809 - protein, 9 aa, Dengue virus
ATTVLTPML

SEQ ID NO: 257810 - protein, 9 aa, Dengue virus
PRWLDARVY

SEQ ID NO: 257811 - protein, 9 aa, Dengue virus
FTNMEVQLI

SEQ ID NO: 257812 - protein, 9 aa, Dengue virus
IRYQTTAIK

SEQ ID NO: 257813 - protein, 9 aa, Dengue virus
VFHTMWHVT

SEQ ID NO: 257814 - protein, 9 aa, Dengue virus
KLMSAAVKD

SEQ ID NO: 257815 - protein, 9 aa, Dengue virus
LMVLLVPEP

SEQ ID NO: 257816 - protein, 9 aa, Dengue virus
LIRCPLSRN

SEQ ID NO: 257817 - protein, 9 aa, Dengue virus
ATTIVTPML

SEQ ID NO: 257818 - protein, 9 aa, Dengue virus
IGKMLEATA

SEQ ID NO: 257819 - protein, 9 aa, Dengue virus
FTTRLLSST

SEQ ID NO: 257820 - protein, 9 aa, Dengue virus
LNGKGPLRM

SEQ ID NO: 257821 - protein, 9 aa, Dengue virus
LAMTDTTPF

SEQ ID NO: 257822 - protein, 9 aa, Dengue virus
LNTFTNMEA

SEQ ID NO: 257823 - protein, 9 aa, Dengue virus
VTHASAAQR

SEQ ID NO: 257824 - protein, 9 aa, Dengue virus
FVEGVSGGA

SEQ ID NO: 257825 - protein, 9 aa, Dengue virus
FITFLRVLS

SEQ ID NO: 257826 - protein, 9 aa, Dengue virus
EEALRGLPI

SEQ ID NO: 257827 - protein, 9 aa, Dengue virus
FVEGVSGGA

SEQ ID NO: 257828 - protein, 9 aa, Dengue virus
ILLMRTTWA

SEQ ID NO: 257829 - protein, 9 aa, Dengue virus
FCEVLTLAT

SEQ ID NO: 257830 - protein, 9 aa, Dengue virus
VWIQDNPNM

SEQ ID NO: 257831 - protein, 9 aa, Dengue virus
KAYAQMWSL

SEQ ID NO: 257832 - protein, 9 aa, Dengue virus
WCNATSTWV

SEQ ID NO: 257833 - protein, 9 aa, Dengue virus
GKTQVGVGI

SEQ ID NO: 257834 - protein, 9 aa, Dengue virus
HRVDLGVPL

SEQ ID NO: 257835 - protein, 9 aa, Dengue virus
VVVLGSQEG

SEQ ID NO: 257836 - protein, 9 aa, Dengue virus
CGSLIGLTS

SEQ ID NO: 257837 - protein, 9 aa, Dengue virus
WYGMEIRPI

SEQ ID NO: 257838 - protein, 9 aa, Dengue virus
FCSHHFHEL

SEQ ID NO: 257839 - protein, 9 aa, Dengue virus
TTTVTGKII

SEQ ID NO: 257840 - protein, 9 aa, Dengue virus
IRSVTRLEN

SEQ ID NO: 257841 - protein, 9 aa, Dengue virus
LIAMDLGEL

SEQ ID NO: 257842 - protein, 9 aa, Dengue virus
LMRTSWALC

SEQ ID NO: 257843 - protein, 9 aa, Dengue virus
VGMGLETRA

SEQ ID NO: 257844 - protein, 9 aa, Dengue virus
VILAGPMPV

SEQ ID NO: 257845 - protein, 9 aa, Dengue virus
INGVVKLLT

SEQ ID NO: 257846 - protein, 9 aa, Dengue virus
FVDLMKRGD

SEQ ID NO: 257847 - protein, 9 aa, Dengue virus
WKLARASFI

SEQ ID NO: 257848 - protein, 9 aa, Dengue virus
DVPLAGPMV

SEQ ID NO: 257849 - protein, 9 aa, Dengue virus
SCTLPPLRY

SEQ ID NO: 257850 - protein, 9 aa, Dengue virus
FIKKVRTNA

SEQ ID NO: 257851 - protein, 9 aa, Dengue virus
QTWMSSEGA

SEQ ID NO: 257852 - protein, 9 aa, Dengue virus
IFVVDNVHT

SEQ ID NO: 257853 - protein, 9 aa, Dengue virus
WNIVKLHSG

SEQ ID NO: 257854 - protein, 9 aa, Dengue virus
FQPESPARV

SEQ ID NO: 257855 - protein, 9 aa, Dengue virus
LKCGSGIFI

SEQ ID NO: 257856 - protein, 9 aa, Dengue virus
IVGLYGNGV

SEQ ID NO: 257857 - protein, 9 aa, Dengue virus
FEATARGAR

SEQ ID NO: 257858 - protein, 9 aa, Dengue virus
FEKQLGQVM

SEQ ID NO: 257859 - protein, 9 aa, Dengue virus
PMKMVMAFI

SEQ ID NO: 257860 - protein, 9 aa, Dengue virus
RSVALVPHV

SEQ ID NO: 257861 - protein, 9 aa, Dengue virus
TTTVSGKLI

SEQ ID NO: 257862 - protein, 9 aa, Dengue virus
VYRIKQRGI

SEQ ID NO: 257863 - protein, 9 aa, Dengue virus
TWSIHAHHQ

SEQ ID NO: 257864 - protein, 9 aa, Dengue virus
MAVGLVSLL

SEQ ID NO: 257865 - protein, 9 aa, Dengue virus
WSIHATHEW

SEQ ID NO: 257866 - protein, 9 aa, Dengue virus
TACLGKSYA

SEQ ID NO: 257867 - protein, 9 aa, Dengue virus
RMAILGETA

SEQ ID NO: 257868 - protein, 9 aa, Dengue virus
TFVELMKRG

SEQ ID NO: 257869 - protein, 9 aa, Dengue virus
DVPLAGPLI

SEQ ID NO: 257870 - protein, 9 aa, Dengue virus
CKKVRSNAA

SEQ ID NO: 257871 - protein, 9 aa, Dengue virus
ATTIITPML

SEQ ID NO: 257872 - protein, 9 aa, Dengue virus
IRWIVERGM

SEQ ID NO: 257873 - protein, 9 aa, Dengue virus
LLSSTRVPN

SEQ ID NO: 257874 - protein, 9 aa, Dengue virus
WYGMEIRPV

SEQ ID NO: 257875 - protein, 9 aa, Dengue virus
TACLGKAYA

SEQ ID NO: 257876 - protein, 9 aa, Dengue virus
FSGQGPMKL

SEQ ID NO: 257877 - protein, 9 aa, Dengue virus
LRMVLAFIT

SEQ ID NO: 257878 - protein, 9 aa, Dengue virus
NRVSTVQQL

SEQ ID NO: 257879 - protein, 9 aa, Dengue virus
VILAGPMPV

SEQ ID NO: 257880 - protein, 9 aa, Dengue virus
KVIQLSRKT

SEQ ID NO: 257881 - protein, 9 aa, Dengue virus
LIGLTSRAT

SEQ ID NO: 257882 - protein, 9 aa, Dengue virus
KKKLRPKWL

SEQ ID NO: 257883 - protein, 9 aa, Dengue virus
SVNTISKML

SEQ ID NO: 257884 - protein, 9 aa, Dengue virus
PLKLFMAFV

SEQ ID NO: 257885 - protein, 9 aa, Dengue virus
CTLMAIDLG

SEQ ID NO: 257886 - protein, 9 aa, Dengue virus
FVEGLSGAT

SEQ ID NO: 257887 - protein, 9 aa, Dengue virus
LTPMLRHSI

SEQ ID NO: 257888 - protein, 9 aa, Dengue virus
WSGVEGEGL

SEQ ID NO: 257889 - protein, 9 aa, Dengue virus
LLVLCVTQV

SEQ ID NO: 257890 - protein, 9 aa, Dengue virus
SRMLLNRFT

SEQ ID NO: 257891 - protein, 9 aa, Dengue virus
CYVLSGSSA

SEQ ID NO: 257892 - protein, 9 aa, Dengue virus
YLAGAGLAF

SEQ ID NO: 257893 - protein, 9 aa, Dengue virus
LWEGNPGRF

SEQ ID NO: 257894 - protein, 9 aa, Dengue virus
ENSSVNVSL

SEQ ID NO: 257895 - protein, 9 aa, Dengue virus
YYCAGLKKV

SEQ ID NO: 257896 - protein, 9 aa, Dengue virus
KSYAQMWQL

SEQ ID NO: 257897 - protein, 9 aa, Dengue virus
IMKNPTVDG

SEQ ID NO: 257898 - protein, 9 aa, Dengue virus
LTIMDLHPG

SEQ ID NO: 257899 - protein, 9 aa, Dengue virus
TTWSIHATH

SEQ ID NO: 257900 - protein, 9 aa, Dengue virus
TWSIHAKHQ

SEQ ID NO: 257901 - protein, 9 aa, Dengue virus
KRFSKGLFS

SEQ ID NO: 257902 - protein, 9 aa, Dengue virus
IYRIKQKGI

SEQ ID NO: 257903 - protein, 9 aa, Dengue virus
TMAKNKPTL

SEQ ID NO: 257904 - protein, 9 aa, Dengue virus
VRSNAAIGA

SEQ ID NO: 257905 - protein, 9 aa, Dengue virus
FCEVLTLAT

SEQ ID NO: 257906 - protein, 9 aa, Dengue virus
FMKDGREIV

SEQ ID NO: 257907 - protein, 9 aa, Dengue virus
PVRVPNYNM

SEQ ID NO: 257908 - protein, 9 aa, Dengue virus
IRYQTPAVK

SEQ ID NO: 257909 - protein, 9 aa, Dengue virus
LTLATGPVL

SEQ ID NO: 257910 - protein, 9 aa, Dengue virus
MMRTTWALC

SEQ ID NO: 257911 - protein, 9 aa, Dengue virus
FIAFLRFLT

SEQ ID NO: 257912 - protein, 9 aa, Dengue virus
TACLGKSYA

SEQ ID NO: 257913 - protein, 9 aa, Dengue virus
LTIMDLHPG

SEQ ID NO: 257914 - protein, 9 aa, Dengue virus
AIANQAAVL

SEQ ID NO: 257915 - protein, 9 aa, Dengue virus
IVREAIKRG

SEQ ID NO: 257916 - protein, 9 aa, Dengue virus
WQIEKASLI

SEQ ID NO: 257917 - protein, 9 aa, Dengue virus
GIMAVGMVS

SEQ ID NO: 257918 - protein, 9 aa, Dengue virus
FLEFEALGF

SEQ ID NO: 257919 - protein, 9 aa, Dengue virus
DIPMTGPLV

SEQ ID NO: 257920 - protein, 9 aa, Dengue virus
VQLLLMRTS

SEQ ID NO: 257921 - protein, 9 aa, Dengue virus
NIVSSVNTI

SEQ ID NO: 257922 - protein, 9 aa, Dengue virus
LVPHVGMGL

SEQ ID NO: 257923 - protein, 9 aa, Dengue virus
CGIRSVTRL

SEQ ID NO: 257924 - protein, 9 aa, Dengue virus
LGSQEGAMH

SEQ ID NO: 257925 - protein, 9 aa, Dengue virus
WIASAIILE

SEQ ID NO: 257926 - protein, 9 aa, Dengue virus
FQPESPARL

SEQ ID NO: 257927 - protein, 9 aa, Dengue virus
CYSQVNPTT

SEQ ID NO: 257928 - protein, 9 aa, Dengue virus
LKCGSGIFV

SEQ ID NO: 257929 - protein, 9 aa, Dengue virus
IKRKLRTLV

SEQ ID NO: 257930 - protein, 9 aa, Dengue virus
MINGVVKLL

SEQ ID NO: 257931 - protein, 9 aa, Dengue virus
QDNQLAYVV

SEQ ID NO: 257932 - protein, 9 aa, Dengue virus
MVLLIPEPE

SEQ ID NO: 257933 - protein, 9 aa, Dengue virus
LTIMDLHPG

SEQ ID NO: 257934 - protein, 9 aa, Dengue virus
VKEVRGFTK

SEQ ID NO: 257935 - protein, 9 aa, Dengue virus
FRKRRLTIM

SEQ ID NO: 257936 - protein, 9 aa, Dengue virus
WSLRETACL

SEQ ID NO: 257937 - protein, 9 aa, Dengue virus
IENTTANIS

SEQ ID NO: 257938 - protein, 9 aa, Dengue virus
VVLAGPMPV

SEQ ID NO: 257939 - protein, 9 aa, Dengue virus
VTRSGAYVS

SEQ ID NO: 257940 - protein, 9 aa, Dengue virus
LRHSIENSS

SEQ ID NO: 257941 - protein, 9 aa, Dengue virus
YTPEGIIPT

SEQ ID NO: 257942 - protein, 9 aa, Dengue virus
PLLAMGCYS

SEQ ID NO: 257943 - protein, 9 aa, Dengue virus
WALMYFHRR

SEQ ID NO: 257944 - protein, 9 aa, Dengue virus
LRHTIENTS

SEQ ID NO: 257945 - protein, 9 aa, Dengue virus
SRLLLNRFT

SEQ ID NO: 257946 - protein, 9 aa, Dengue virus
ALTLATGPI

SEQ ID NO: 257947 - protein, 9 aa, Dengue virus
LQGQGPMKM

SEQ ID NO: 257948 - protein, 9 aa, Dengue virus
WQLMYFHRR

SEQ ID NO: 257949 - protein, 9 aa, Dengue virus
CVTTIAKSK

SEQ ID NO: 257950 - protein, 9 aa, Dengue virus
IVSAVNMTS

SEQ ID NO: 257951 - protein, 9 aa, Dengue virus
FITFLRVLS

SEQ ID NO: 257952 - protein, 9 aa, Dengue virus
TAGILKRWG

SEQ ID NO: 257953 - protein, 9 aa, Dengue virus
FSGQGPMKL

SEQ ID NO: 257954 - protein, 9 aa, Dengue virus
MVTFKVPHA

SEQ ID NO: 257955 - protein, 9 aa, Dengue virus
NEGIMAVGM

SEQ ID NO: 257956 - protein, 9 aa, Dengue virus
RVIQLSRKT

SEQ ID NO: 257957 - protein, 9 aa, Dengue virus
HRVDLGVPL

SEQ ID NO: 257958 - protein, 9 aa, Dengue virus
VKATGSASS

SEQ ID NO: 257959 - protein, 9 aa, Dengue virus
ILLMRTSWA

SEQ ID NO: 257960 - protein, 9 aa, Dengue virus
FWNTTIAVS

SEQ ID NO: 257961 - protein, 9 aa, Dengue virus
FVELMKRGD

SEQ ID NO: 257962 - protein, 9 aa, Dengue virus
IAKNKPTLD

SEQ ID NO: 257963 - protein, 9 aa, Dengue virus
STRVPNYNL

SEQ ID NO: 257964 - protein, 9 aa, Dengue virus
WALCEALTL

SEQ ID NO: 257965 - protein, 9 aa, Dengue virus
HRMDIGVPL

SEQ ID NO: 257966 - protein, 9 aa, Dengue virus
RIKQRGILG

SEQ ID NO: 257967 - protein, 9 aa, Dengue virus
ACLGKSYAQ

SEQ ID NO: 257968 - protein, 9 aa, Dengue virus
YAQMWALMY

SEQ ID NO: 257969 - protein, 9 aa, Dengue virus
KRFSKGLFS

SEQ ID NO: 257970 - protein, 9 aa, Dengue virus
FTNMEAQLI

SEQ ID NO: 257971 - protein, 9 aa, Dengue virus
MAKNKPTLD

SEQ ID NO: 257972 - protein, 9 aa, Dengue virus
VASEMAEAL

SEQ ID NO: 257973 - protein, 9 aa, Dengue virus
VRSNAALGA

SEQ ID NO: 257974 - protein, 9 aa, Dengue virus
YRLKGEARK

SEQ ID NO: 257975 - protein, 9 aa, Dengue virus
WQIEKASLI

SEQ ID NO: 257976 - protein, 9 aa, Dengue virus
VNVSLTAIA

SEQ ID NO: 257977 - protein, 9 aa, Dengue virus
YLAGAGLAF

SEQ ID NO: 257978 - protein, 9 aa, Dengue virus
KRRLRTLIL

SEQ ID NO: 257979 - protein, 9 aa, Dengue virus
LILAPTRVV

SEQ ID NO: 257980 - protein, 9 aa, Dengue virus
LLRNDVPMA

SEQ ID NO: 257981 - protein, 9 aa, Dengue virus
ISLAAIANQ

SEQ ID NO: 257982 - protein, 9 aa, Dengue virus
WKIEKASFI

SEQ ID NO: 257983 - protein, 9 aa, Dengue virus
YWIESALND

SEQ ID NO: 257984 - protein, 9 aa, Dengue virus
LILAPTRVV

SEQ ID NO: 257985 - protein, 9 aa, Dengue virus
CYVITGRSA

SEQ ID NO: 257986 - protein, 9 aa, Dengue virus
IENTSANLS

SEQ ID NO: 257987 - protein, 9 aa, Dengue virus
IYADPMALK

SEQ ID NO: 257988 - protein, 9 aa, Dengue virus
EYRLRGEAR

SEQ ID NO: 257989 - protein, 9 aa, Dengue virus
YCAGLKKVT

SEQ ID NO: 257990 - protein, 9 aa, Dengue virus
TYVSAITQA

SEQ ID NO: 257991 - protein, 9 aa, Dengue virus
QTWMSSEGA

SEQ ID NO: 257992 - protein, 9 aa, Dengue virus
VILAGPMPV

SEQ ID NO: 257993 - protein, 9 aa, Dengue virus
FVELMRRGD

SEQ ID NO: 257994 - protein, 9 aa, Dengue virus
LTLATGPVL

SEQ ID NO: 257995 - protein, 9 aa, Dengue virus
LGRGWPLHR

SEQ ID NO: 257996 - protein, 9 aa, Dengue virus
FGKGGIVTC

SEQ ID NO: 257997 - protein, 9 aa, Dengue virus
TVSQLAKRF

SEQ ID NO: 257998 - protein, 9 aa, Dengue virus
AIANQAAIL

SEQ ID NO: 257999 - protein, 9 aa, Dengue virus
LFSGVSWTM

SEQ ID NO: 258000 - protein, 9 aa, Dengue virus
LAAIANQAV

SEQ ID NO: 258001 - protein, 9 aa, Dengue virus
IALDFKPGT

SEQ ID NO: 258002 - protein, 9 aa, Dengue virus
FHTMWHVTR

SEQ ID NO: 258003 - protein, 9 aa, Dengue virus
FVELMRRGD

SEQ ID NO: 258004 - protein, 9 aa, Dengue virus
GSQLAKRFS

SEQ ID NO: 258005 - protein, 9 aa, Dengue virus
FQADSPKRL

SEQ ID NO: 258006 - protein, 9 aa, Dengue virus
IDLDPVVYD

SEQ ID NO: 258007 - protein, 9 aa, Dengue virus
YNLVIMDEA

SEQ ID NO: 258008 - protein, 9 aa, Dengue virus
NEAIMAVGL

SEQ ID NO: 258009 - protein, 9 aa, Dengue virus
KLLTKPWDV

SEQ ID NO: 258010 - protein, 9 aa, Dengue virus
PDTIETLML

SEQ ID NO: 258011 - protein, 9 aa, Dengue virus
VWIQDNPNM

SEQ ID NO: 258012 - protein, 9 aa, Dengue virus
WKLEKASFI

SEQ ID NO: 258013 - protein, 9 aa, Dengue virus
SKVDIGVPL

SEQ ID NO: 258014 - protein, 9 aa, Dengue virus
DVPLAGPLI

SEQ ID NO: 258015 - protein, 9 aa, Dengue virus
IWYMWLGAR

SEQ ID NO: 258016 - protein, 9 aa, Dengue virus
PMVAGGLLL

SEQ ID NO: 258017 - protein, 9 aa, Dengue virus
EVKATGSAS

SEQ ID NO: 258018 - protein, 9 aa, Dengue virus
LVTFKNPHA

SEQ ID NO: 258019 - protein, 9 aa, Dengue virus
LKRRLRTLI

SEQ ID NO: 258020 - protein, 9 aa, Dengue virus
LTPHSGTGL

SEQ ID NO: 258021 - protein, 9 aa, Dengue virus
FKAGRVIDP

SEQ ID NO: 258022 - protein, 9 aa, Dengue virus
FRLRGEQRK

SEQ ID NO: 258023 - protein, 9 aa, Dengue virus
LLKNDVPLA

SEQ ID NO: 258024 - protein, 9 aa, Dengue virus
FLTIPPTAG

SEQ ID NO: 258025 - protein, 9 aa, Dengue virus
LGSQEGAMH

SEQ ID NO: 258026 - protein, 9 aa, Dengue virus
YNLIIMDEA

SEQ ID NO: 258027 - protein, 9 aa, Dengue virus
DMLSVWNRV

SEQ ID NO: 258028 - protein, 9 aa, Dengue virus
WDFVVTTDI

SEQ ID NO: 258029 - protein, 9 aa, Dengue virus
FGRAKGSRA

SEQ ID NO: 258030 - protein, 9 aa, Dengue virus
AKGSRAIWY

SEQ ID NO: 258031 - protein, 9 aa, Dengue virus
KVIQLSRKT

SEQ ID NO: 258032 - protein, 9 aa, Dengue virus
YMATLKNVR

SEQ ID NO: 258033 - protein, 9 aa, Dengue virus
IRYQTPAIR

SEQ ID NO: 258034 - protein, 9 aa, Dengue virus
IANQATVLM

SEQ ID NO: 258035 - protein, 9 aa, Dengue virus
DARIYSDPL

SEQ ID NO: 258036 - protein, 9 aa, Dengue virus
FEKQLGQVM

SEQ ID NO: 258037 - protein, 9 aa, Dengue virus
LVSILLSSL

SEQ ID NO: 258038 - protein, 9 aa, Dengue virus
LVSILLSSL

SEQ ID NO: 258039 - protein, 9 aa, Dengue virus
WYGMEIRPI

SEQ ID NO: 258040 - protein, 9 aa, Dengue virus
FGRAKGSRA

SEQ ID NO: 258041 - protein, 9 aa, Dengue virus
LWEGSPGRF

SEQ ID NO: 258042 - protein, 9 aa, Dengue virus
AIANQAVVL

SEQ ID NO: 258043 - protein, 9 aa, Dengue virus
FQADSPSKL

SEQ ID NO: 258044 - protein, 9 aa, Dengue virus
VIDLEPVIY

SEQ ID NO: 258045 - protein, 9 aa, Dengue virus
FQPESPKRL

SEQ ID NO: 258046 - protein, 9 aa, Dengue virus
FIKKVRTNA

SEQ ID NO: 258047 - protein, 9 aa, Dengue virus
WCNATSTWV

SEQ ID NO: 258048 - protein, 9 aa, Dengue virus
MVSRMLLNR

SEQ ID NO: 258049 - protein, 9 aa, Dengue virus
IFVIDNVHT

SEQ ID NO: 258050 - protein, 9 aa, Dengue virus
IANQATVLM

SEQ ID NO: 258051 - protein, 9 aa, Dengue virus
FTNMEVQLI

SEQ ID NO: 258052 - protein, 9 aa, Dengue virus
KRFSKGLFS

SEQ ID NO: 258053 - protein, 9 aa, Dengue virus
LKCGSGIFI

SEQ ID NO: 258054 - protein, 9 aa, Dengue virus
LFGGVSWMV

SEQ ID NO: 258055 - protein, 9 aa, Dengue virus
VVLEHGGCV

SEQ ID NO: 258056 - protein, 9 aa, Dengue virus
TTWSIHAHH

SEQ ID NO: 258057 - protein, 9 aa, Dengue virus
AKRFSRGML

SEQ ID NO: 258058 - protein, 9 aa, Dengue virus
LVSILLSSL

SEQ ID NO: 258059 - protein, 9 aa, Dengue virus
WDVVPTVTQ

SEQ ID NO: 258060 - protein, 9 aa, Dengue virus
FCESLTLAT

SEQ ID NO: 258061 - protein, 9 aa, Dengue virus
STRVPNYNL

SEQ ID NO: 258062 - protein, 9 aa, Dengue virus
VAIDLDPIS

SEQ ID NO: 258063 - protein, 9 aa, Dengue virus
IMKDGRVLV

SEQ ID NO: 258064 - protein, 9 aa, Dengue virus
IALDFSPGT

SEQ ID NO: 258065 - protein, 9 aa, Dengue virus
IAACLRKNG

SEQ ID NO: 258066 - protein, 9 aa, Dengue virus
FKLTYQNKV

SEQ ID NO: 258067 - protein, 9 aa, Dengue virus
FCEVLTLAT

SEQ ID NO: 258068 - protein, 9 aa, Dengue virus
KLMSAAVKD

SEQ ID NO: 258069 - protein, 9 aa, Dengue virus
LHPASAWTL

SEQ ID NO: 258070 - protein, 9 aa, Dengue virus
LNTFTNMEA

SEQ ID NO: 258071 - protein, 9 aa, Dengue virus
FGKGSLITC

SEQ ID NO: 258072 - protein, 9 aa, Dengue virus
LIRCPLSRN

SEQ ID NO: 258073 - protein, 9 aa, Dengue virus
WYGMEIRPL

SEQ ID NO: 258074 - protein, 9 aa, Dengue virus
PETLETLLL

SEQ ID NO: 258075 - protein, 9 aa, Dengue virus
VRTNAAIGA

SEQ ID NO: 258076 - protein, 9 aa, Dengue virus
LQWIASAIV

SEQ ID NO: 258077 - protein, 9 aa, Dengue virus
GGLLIACYV

SEQ ID NO: 258078 - protein, 9 aa, Dengue virus
HWIAASIIL

SEQ ID NO: 258079 - protein, 9 aa, Dengue virus
QTWMSAEGA

SEQ ID NO: 258080 - protein, 9 aa, Dengue virus
LKGLPIRYQ

SEQ ID NO: 258081 - protein, 9 aa, Dengue virus
IRYQTPAVK

SEQ ID NO: 258082 - protein, 9 aa, Dengue virus
VYNMMGKRE

SEQ ID NO: 258083 - protein, 9 aa, Dengue virus
YRLRGEQRK

SEQ ID NO: 258084 - protein, 9 aa, Dengue virus
TWSIHASHE

SEQ ID NO: 258085 - protein, 9 aa, Dengue virus
VLSIPPTAG

SEQ ID NO: 258086 - protein, 9 aa, Dengue virus
VYNMMGKRE

SEQ ID NO: 258087 - protein, 9 aa, Dengue virus
FINKVRSNA

SEQ ID NO: 258088 - protein, 9 aa, Dengue virus
FGVFTTNIW

SEQ ID NO: 258089 - protein, 9 aa, Dengue virus
ILARWGSFK

SEQ ID NO: 258090 - protein, 9 aa, Dengue virus
VRSNAALGA

SEQ ID NO: 258091 - protein, 9 aa, Dengue virus
PARLATAIA

SEQ ID NO: 258092 - protein, 9 aa, Dengue virus
LLMMRTTWA

SEQ ID NO: 258093 - protein, 9 aa, Dengue virus
RMAILGDTA

SEQ ID NO: 258094 - protein, 9 aa, Dengue virus
TTWSIHAKH

SEQ ID NO: 258095 - protein, 9 aa, Dengue virus
YSGVEGEGL

SEQ ID NO: 258096 - protein, 9 aa, Dengue virus
IALDFSPGT

SEQ ID NO: 258097 - protein, 9 aa, Dengue virus
IAACLRKNG

SEQ ID NO: 258098 - protein, 9 aa, Dengue virus
MWQLMYFHR

SEQ ID NO: 258099 - protein, 9 aa, Dengue virus
ISRMLLNRF

SEQ ID NO: 258100 - protein, 9 aa, Dengue virus
FMALVAFLR

SEQ ID NO: 258101 - protein, 9 aa, Dengue virus
IRSTTRLEN

SEQ ID NO: 258102 - protein, 9 aa, Dengue virus
FKAGRVIDP

SEQ ID NO: 258103 - protein, 9 aa, Dengue virus
GVVRLLTKP

SEQ ID NO: 258104 - protein, 9 aa, Dengue virus
AEALKGLPI

SEQ ID NO: 258105 - protein, 9 aa, Dengue virus
RSVALAPHV

SEQ ID NO: 258106 - protein, 9 aa, Dengue virus
IVSSVNMIS

SEQ ID NO: 258107 - protein, 9 aa, Dengue virus
WIQDNPNMI

SEQ ID NO: 258108 - protein, 9 aa, Dengue virus
VRSNAAIGA

SEQ ID NO: 258109 - protein, 9 aa, Dengue virus
YIYMGQPLN

SEQ ID NO: 258110 - protein, 9 aa, Dengue virus
FVTDEVHTW

SEQ ID NO: 258111 - protein, 9 aa, Dengue virus
MRTALTGAT

SEQ ID NO: 258112 - protein, 9 aa, Dengue virus
FEKQLGQIM

SEQ ID NO: 258113 - protein, 9 aa, Dengue virus
TKRYLPAIV

SEQ ID NO: 258114 - protein, 9 aa, Dengue virus
IANQAAVLM

SEQ ID NO: 258115 - protein, 9 aa, Dengue virus
STGLLNGKG

SEQ ID NO: 258116 - protein, 9 aa, Dengue virus
MYWVSGATG

SEQ ID NO: 258117 - protein, 9 aa, Dengue virus
ISEMGANFR

SEQ ID NO: 258118 - protein, 9 aa, Dengue virus
FGKGGVVTC

SEQ ID NO: 258119 - protein, 9 aa, Dengue virus
YNMMGKREK

SEQ ID NO: 258120 - protein, 9 aa, Dengue virus
YEVKPTGSA

SEQ ID NO: 258121 - protein, 9 aa, Dengue virus
DVPMAGPLV

SEQ ID NO: 258122 - protein, 9 aa, Dengue virus
VILAGPIPV

SEQ ID NO: 258123 - protein, 9 aa, Dengue virus
TLRVLKMVE

SEQ ID NO: 258124 - protein, 9 aa, Dengue virus
LYAVATTFI

SEQ ID NO: 258125 - protein, 9 aa, Dengue virus
FQEGTFHTM

SEQ ID NO: 258126 - protein, 9 aa, Dengue virus
RIKQQGILG

SEQ ID NO: 258127 - protein, 9 aa, Dengue virus
YMWLGARFL

SEQ ID NO: 258128 - protein, 9 aa, Dengue virus
IANQAAVLM

SEQ ID NO: 258129 - protein, 9 aa, Dengue virus
VYNMMGKRE

SEQ ID NO: 258130 - protein, 9 aa, Dengue virus
YRGAKRMAI

SEQ ID NO: 258131 - protein, 9 aa, Dengue virus
CYSQVNPLT

SEQ ID NO: 258132 - protein, 9 aa, Dengue virus
MSTYGWNIV

SEQ ID NO: 258133 - protein, 9 aa, Dengue virus
LLILCASQI

SEQ ID NO: 258134 - protein, 9 aa, Dengue virus
IKAGNDIAA

SEQ ID NO: 258135 - protein, 9 aa, Dengue virus
FCEALTLAT

SEQ ID NO: 258136 - protein, 9 aa, Dengue virus
ISRMLLNRF

SEQ ID NO: 258137 - protein, 9 aa, Dengue virus
YRIMQRGLF

SEQ ID NO: 258138 - protein, 9 aa, Dengue virus
PMSTYGWNI

SEQ ID NO: 258139 - protein, 9 aa, Dengue virus
LTPMLRHSI

SEQ ID NO: 258140 - protein, 9 aa, Dengue virus
IKRKLRTLI

SEQ ID NO: 258141 - protein, 9 aa, Dengue virus
LTLATGPIT

SEQ ID NO: 258142 - protein, 9 aa, Dengue virus
FVEGVSGGT

SEQ ID NO: 258143 - protein, 9 aa, Dengue virus
FHQLIMKDG

SEQ ID NO: 258144 - protein, 9 aa, Dengue virus
TKRYLPAIV

SEQ ID NO: 258145 - protein, 9 aa, Dengue virus
DLRLAANAI

SEQ ID NO: 258146 - protein, 9 aa, Dengue virus
TTAIKAEHT

SEQ ID NO: 258147 - protein, 9 aa, Dengue virus
LFGGVSWMV

SEQ ID NO: 258148 - protein, 9 aa, Dengue virus
VSQGAGWSL

SEQ ID NO: 258149 - protein, 9 aa, Dengue virus
RVIQLSRKT

SEQ ID NO: 258150 - protein, 9 aa, Dengue virus
VYADPMALK

SEQ ID NO: 258151 - protein, 9 aa, Dengue virus
INGVVRLLT

SEQ ID NO: 258152 - protein, 9 aa, Dengue virus
CLGKSYAQM

SEQ ID NO: 258153 - protein, 9 aa, Dengue virus
NQLIYVILT

SEQ ID NO: 258154 - protein, 9 aa, Dengue virus
FLRFLAIPP

SEQ ID NO: 258155 - protein, 9 aa, Dengue virus
DVPLAGPMV

SEQ ID NO: 258156 - protein, 9 aa, Dengue virus
GGMLIACYV

SEQ ID NO: 258157 - protein, 9 aa, Dengue virus
KLMSAAVKD

SEQ ID NO: 258158 - protein, 9 aa, Dengue virus
ILLMRTSWA

SEQ ID NO: 258159 - protein, 9 aa, Dengue virus
YWIESALND

SEQ ID NO: 258160 - protein, 9 aa, Dengue virus
FCSHHFHEL

SEQ ID NO: 258161 - protein, 9 aa, Dengue virus
MYADDTAGW

SEQ ID NO: 258162 - protein, 9 aa, Dengue virus
TTWSIHAHH

SEQ ID NO: 258163 - protein, 9 aa, Dengue virus
WYGMEIRPV

SEQ ID NO: 258164 - protein, 9 aa, Dengue virus
SCTLPPLRF

SEQ ID NO: 258165 - protein, 9 aa, Dengue virus
IGKMLEATA

SEQ ID NO: 258166 - protein, 9 aa, Dengue virus
MGLGRGWPL

SEQ ID NO: 258167 - protein, 9 aa, Dengue virus
WAYHGSYET

SEQ ID NO: 258168 - protein, 9 aa, Dengue virus
YRLRGESRK

SEQ ID NO: 258169 - protein, 9 aa, Dengue virus
FTTRLLSST

SEQ ID NO: 258170 - protein, 9 aa, Dengue virus
ENSSVNVSL

SEQ ID NO: 258171 - protein, 9 aa, Dengue virus
LVSLLGSSL

SEQ ID NO: 258172 - protein, 9 aa, Dengue virus
VSLDFSPGT

SEQ ID NO: 258173 - protein, 9 aa, Dengue virus
TLWSNGVLE

SEQ ID NO: 258174 - protein, 9 aa, Dengue virus
LLSGRGPLK

SEQ ID NO: 258175 - protein, 9 aa, Dengue virus
NGVLESQML

SEQ ID NO: 258176 - protein, 9 aa, Dengue virus
ALKGMPIRY

SEQ ID NO: 258177 - protein, 9 aa, Dengue virus
LTIMDLHPG

SEQ ID NO: 258178 - protein, 9 aa, Dengue virus
VEGEGLHRL

SEQ ID NO: 258179 - protein, 9 aa, Dengue virus
FVELMKRGD

SEQ ID NO: 258180 - protein, 9 aa, Dengue virus
IFGKTQVGV

SEQ ID NO: 258181 - protein, 9 aa, Dengue virus
FVEGVSGGA

SEQ ID NO: 258182 - protein, 9 aa, Dengue virus
IALDFSPGT

SEQ ID NO: 258183 - protein, 9 aa, Dengue virus
SRLLLNRFT

SEQ ID NO: 258184 - protein, 9 aa, Dengue virus
LIGLTSRAT

SEQ ID NO: 258185 - protein, 9 aa, Dengue virus
LILAPTRVV

SEQ ID NO: 258186 - protein, 9 aa, Dengue virus
WLVHRQWFL

SEQ ID NO: 258187 - protein, 9 aa, Dengue virus
LYAVATTVL

SEQ ID NO: 258188 - protein, 9 aa, Dengue virus
LTPHSGTGL

SEQ ID NO: 258189 - protein, 9 aa, Dengue virus
TYVSAIAQT

SEQ ID NO: 258190 - protein, 9 aa, Dengue virus
SCTLPPLRY

SEQ ID NO: 258191 - protein, 9 aa, Dengue virus
FQADSPKKL

SEQ ID NO: 258192 - protein, 9 aa, Dengue virus
FCSHHFHKI

SEQ ID NO: 258193 - protein, 9 aa, Dengue virus
LLSGRGPLK

SEQ ID NO: 258194 - protein, 9 aa, Dengue virus
VVTKSGTYV

SEQ ID NO: 258195 - protein, 9 aa, Dengue virus
FSLGLLSGR

SEQ ID NO: 258196 - protein, 9 aa, Dengue virus
VWLSYKVAS

SEQ ID NO: 258197 - protein, 9 aa, Dengue virus
CLRKNGKKV

SEQ ID NO: 258198 - protein, 9 aa, Dengue virus
VRSNAALGA

SEQ ID NO: 258199 - protein, 9 aa, Dengue virus
GVVKLLTKP

SEQ ID NO: 258200 - protein, 9 aa, Dengue virus
FINKVRSNA

SEQ ID NO: 258201 - protein, 9 aa, Dengue virus
IVSSVNMIS

SEQ ID NO: 258202 - protein, 9 aa, Dengue virus
YGNGVVTRS

SEQ ID NO: 258203 - protein, 9 aa, Dengue virus
INMLKRVRN

SEQ ID NO: 258204 - protein, 9 aa, Dengue virus
IYRIKQKGI

SEQ ID NO: 258205 - protein, 9 aa, Dengue virus
PETLETLLL

SEQ ID NO: 258206 - protein, 9 aa, Dengue virus
HRVDLGVPL

SEQ ID NO: 258207 - protein, 9 aa, Dengue virus
PETLETLLL

SEQ ID NO: 258208 - protein, 9 aa, Dengue virus
YGNGVVTTS

SEQ ID NO: 258209 - protein, 9 aa, Dengue virus
ARGYISTRV

SEQ ID NO: 258210 - protein, 9 aa, Dengue virus
MYWVSGVSG

SEQ ID NO: 258211 - protein, 9 aa, Dengue virus
CGIRSATRM

SEQ ID NO: 258212 - protein, 9 aa, Dengue virus
YAVSRGTSK

SEQ ID NO: 258213 - protein, 9 aa, Dengue virus
LRTTTASGK

SEQ ID NO: 258214 - protein, 9 aa, Dengue virus
FMALVAFLR

SEQ ID NO: 258215 - protein, 9 aa, Dengue virus
IRWFVERNL

SEQ ID NO: 258216 - protein, 9 aa, Dengue virus
LMVLLVPEP

SEQ ID NO: 258217 - protein, 9 aa, Dengue virus
VVLEHGSCV

SEQ ID NO: 258218 - protein, 9 aa, Dengue virus
VYADPMALK

SEQ ID NO: 258219 - protein, 9 aa, Dengue virus
FLEFEALGF

SEQ ID NO: 258220 - protein, 9 aa, Dengue virus
YDQENPYKT

SEQ ID NO: 258221 - protein, 9 aa, Dengue virus
LVRLQSGVD

SEQ ID NO: 258222 - protein, 9 aa, Dengue virus
AVMAVGVVS

SEQ ID NO: 258223 - protein, 9 aa, Dengue virus
LRTTTVSGK

SEQ ID NO: 258224 - protein, 9 aa, Dengue virus
NEAIMAVGL

SEQ ID NO: 258225 - protein, 9 aa, Dengue virus
LIGLSSRAT

SEQ ID NO: 258226 - protein, 9 aa, Dengue virus
VEMGEAAGI

SEQ ID NO: 258227 - protein, 9 aa, Dengue virus
HWFSRGNSF

SEQ ID NO: 258228 - protein, 9 aa, Dengue virus
FQPESPARL

SEQ ID NO: 258229 - protein, 9 aa, Dengue virus
FQPESPKRL

SEQ ID NO: 258230 - protein, 9 aa, Dengue virus
KLLTKPWDV

SEQ ID NO: 258231 - protein, 9 aa, Dengue virus
RVSTVSQLA

SEQ ID NO: 258232 - protein, 9 aa, Dengue virus
MLLDNIYTP

SEQ ID NO: 258233 - protein, 9 aa, Dengue virus
FVDLMRRGD

SEQ ID NO: 258234 - protein, 9 aa, Dengue virus
MVSILASAL

SEQ ID NO: 258235 - protein, 9 aa, Dengue virus
LQWIASAIV

SEQ ID NO: 258236 - protein, 9 aa, Dengue virus
LHPASAWTL

SEQ ID NO: 258237 - protein, 9 aa, Dengue virus
FVDLMRRGD

SEQ ID NO: 258238 - protein, 9 aa, Dengue virus
WALCESITL

SEQ ID NO: 258239 - protein, 9 aa, Dengue virus
PLVAGGLLI

SEQ ID NO: 258240 - protein, 9 aa, Dengue virus
HWFSRGNSL

SEQ ID NO: 258241 - protein, 9 aa, Dengue virus
WLDARIYAD

SEQ ID NO: 258242 - protein, 9 aa, Dengue virus
LGKGWPIHK

SEQ ID NO: 258243 - protein, 9 aa, Dengue virus
CYVITGTSA

SEQ ID NO: 258244 - protein, 9 aa, Dengue virus
IRYQTPAIR

SEQ ID NO: 258245 - protein, 9 aa, Dengue virus
LTAIANQAA

SEQ ID NO: 258246 - protein, 9 aa, Dengue virus
VILAGPMPV

SEQ ID NO: 258247 - protein, 9 aa, Dengue virus
FCEVLTLAT

SEQ ID NO: 258248 - protein, 9 aa, Dengue virus
FIAFLRFLT

SEQ ID NO: 258249 - protein, 9 aa, Dengue virus
LVLEHGGCV

SEQ ID NO: 258250 - protein, 9 aa, Dengue virus
PLLAMGCYS

SEQ ID NO: 258251 - protein, 9 aa, Dengue virus
GQLLLMRTS

SEQ ID NO: 258252 - protein, 9 aa, Dengue virus
VEAGRTLRV

SEQ ID NO: 258253 - protein, 9 aa, Dengue virus
IVLGSQEGA

SEQ ID NO: 258254 - protein, 9 aa, Dengue virus
FVIDNVHTR

SEQ ID NO: 258255 - protein, 9 aa, Dengue virus
IYADPMALK

SEQ ID NO: 258256 - protein, 9 aa, Dengue virus
ILASSLLRN

SEQ ID NO: 258257 - protein, 9 aa, Dengue virus
SRTTWSIHA

SEQ ID NO: 258258 - protein, 9 aa, Dengue virus
RSVALAPHV

SEQ ID NO: 258259 - protein, 9 aa, Dengue virus
ILLMRTTWA

SEQ ID NO: 258260 - protein, 9 aa, Dengue virus
VEMGEAAAI

SEQ ID NO: 258261 - protein, 9 aa, Dengue virus
LVRCPLSRN

SEQ ID NO: 258262 - protein, 9 aa, Dengue virus
FHTMWHVTR

SEQ ID NO: 258263 - protein, 9 aa, Dengue virus
IANQATVLM

SEQ ID NO: 258264 - protein, 9 aa, Dengue virus
MWQLMYFHR

SEQ ID NO: 258265 - protein, 9 aa, Dengue virus
MYWVSGVSG

SEQ ID NO: 258266 - protein, 9 aa, Dengue virus
WDFVVTTDI

SEQ ID NO: 258267 - protein, 9 aa, Dengue virus
FGKTQVGVG

SEQ ID NO: 258268 - protein, 9 aa, Dengue virus
FSLGLLSGR

SEQ ID NO: 258269 - protein, 9 aa, Dengue virus
CLRKSGKRV

SEQ ID NO: 258270 - protein, 9 aa, Dengue virus
IRYQTTATK

SEQ ID NO: 258271 - protein, 9 aa, Dengue virus
VKDQRAVHA

SEQ ID NO: 258272 - protein, 9 aa, Dengue virus
TTMAQGKPT

SEQ ID NO: 258273 - protein, 9 aa, Dengue virus
RKKLRPRWL

SEQ ID NO: 258274 - protein, 9 aa, Dengue virus
FVEGVSGGT

SEQ ID NO: 258275 - protein, 9 aa, Dengue virus
AWTLYAVAT

SEQ ID NO: 258276 - protein, 9 aa, Dengue virus
FVEGVSGGA

SEQ ID NO: 258277 - protein, 9 aa, Dengue virus
VSQGAGWSL

SEQ ID NO: 258278 - protein, 9 aa, Dengue virus
VMTGRSADL

SEQ ID NO: 258279 - protein, 9 aa, Dengue virus
YRGAKRMAI

SEQ ID NO: 258280 - protein, 9 aa, Dengue virus
WDVLPMVTQ

SEQ ID NO: 258281 - protein, 9 aa, Dengue virus
FQADSPKKL

SEQ ID NO: 258282 - protein, 9 aa, Dengue virus
MAMTDTTPF

SEQ ID NO: 258283 - protein, 9 aa, Dengue virus
CVTTMAKNK

SEQ ID NO: 258284 - protein, 9 aa, Dengue virus
MRGAKRMAI

SEQ ID NO: 258285 - protein, 9 aa, Dengue virus
INGVVRLLT

SEQ ID NO: 258286 - protein, 9 aa, Dengue virus
MMRTTWALC

SEQ ID NO: 258287 - protein, 9 aa, Dengue virus
SYAQMWTLM

SEQ ID NO: 258288 - protein, 9 aa, Dengue virus
GRTLRVLKM

SEQ ID NO: 258289 - protein, 9 aa, Dengue virus
HRVDLGVPL

SEQ ID NO: 258290 - protein, 9 aa, Dengue virus
IKRKLRTLV

SEQ ID NO: 258291 - protein, 9 aa, Dengue virus
HQWMTTEDM

SEQ ID NO: 258292 - protein, 9 aa, Dengue virus
GLHKLGYIL

SEQ ID NO: 258293 - protein, 9 aa, Dengue virus
FQPESPARL

SEQ ID NO: 258294 - protein, 9 aa, Dengue virus
FEKQLGQVM

SEQ ID NO: 258295 - protein, 9 aa, Dengue virus
CVTTMAQGK

SEQ ID NO: 258296 - protein, 9 aa, Dengue virus
FCESLTLAT

SEQ ID NO: 258297 - protein, 9 aa, Dengue virus
YNMVIMDEA

SEQ ID NO: 258298 - protein, 9 aa, Dengue virus
FQADSPKKL

SEQ ID NO: 258299 - protein, 9 aa, Dengue virus
LILAPTRVV

SEQ ID NO: 258300 - protein, 9 aa, Dengue virus
EEALKGMPI

SEQ ID NO: 258301 - protein, 9 aa, Dengue virus
ENTTANISL

SEQ ID NO: 258302 - protein, 9 aa, Dengue virus
FCSHHFHQL

SEQ ID NO: 258303 - protein, 9 aa, Dengue virus
CGIRSVTRL

SEQ ID NO: 258304 - protein, 9 aa, Dengue virus
GLHRLGYIL

SEQ ID NO: 258305 - protein, 9 aa, Dengue virus
CVTTMAKNK

SEQ ID NO: 258306 - protein, 9 aa, Dengue virus
MRLLSPVRV

SEQ ID NO: 258307 - protein, 9 aa, Dengue virus
DMLAVWNRV

SEQ ID NO: 258308 - protein, 9 aa, Dengue virus
LLMMRTTWA

SEQ ID NO: 258309 - protein, 9 aa, Dengue virus
VREAIKRKL

SEQ ID NO: 258310 - protein, 9 aa, Dengue virus
LIGLTSRAT

SEQ ID NO: 258311 - protein, 9 aa, Dengue virus
MRGAKRMAI

SEQ ID NO: 258312 - protein, 9 aa, Dengue virus
LLRNDVPLA

SEQ ID NO: 258313 - protein, 9 aa, Dengue virus
THTLWSNGV

SEQ ID NO: 258314 - protein, 9 aa, Dengue virus
WALCEVLTL

SEQ ID NO: 258315 - protein, 9 aa, Dengue virus
IRVLKMVEP

SEQ ID NO: 258316 - protein, 9 aa, Dengue virus
MVNGVVRLL

SEQ ID NO: 258317 - protein, 9 aa, Dengue virus
PVRVPNYNL

SEQ ID NO: 258318 - protein, 9 aa, Dengue virus
ANIFRGSYL

SEQ ID NO: 258319 - protein, 9 aa, Dengue virus
CGIRSTTRL

SEQ ID NO: 258320 - protein, 9 aa, Dengue virus
IVREALKRR

SEQ ID NO: 258321 - protein, 9 aa, Dengue virus
YFHRRDLRL

SEQ ID NO: 258322 - protein, 9 aa, Dengue virus
YLEFEALGF

SEQ ID NO: 258323 - protein, 9 aa, Dengue virus
KLMSAAVKD

SEQ ID NO: 258324 - protein, 9 aa, Dengue virus
VSLLGSSLL

SEQ ID NO: 258325 - protein, 9 aa, Dengue virus
LAAIANQAA

SEQ ID NO: 258326 - protein, 9 aa, Dengue virus
IHMENVFHT

SEQ ID NO: 258327 - protein, 9 aa, Dengue virus
LCESITLAT

SEQ ID NO: 258328 - protein, 9 aa, Dengue virus
AVSRGSSKL

SEQ ID NO: 258329 - protein, 9 aa, Dengue virus
LYAVATTVL

SEQ ID NO: 258330 - protein, 9 aa, Dengue virus
CYSQVNPTT

SEQ ID NO: 258331 - protein, 9 aa, Dengue virus
CYSQVNPLT

SEQ ID NO: 258332 - protein, 9 aa, Dengue virus
LILCASQIL

SEQ ID NO: 258333 - protein, 9 aa, Dengue virus
FLRFLAIPP

SEQ ID NO: 258334 - protein, 9 aa, Dengue virus
LYAVATTII

SEQ ID NO: 258335 - protein, 9 aa, Dengue virus
LLMMRTTWA

SEQ ID NO: 258336 - protein, 9 aa, Dengue virus
LGKGWPLHR

SEQ ID NO: 258337 - protein, 9 aa, Dengue virus
IAACLRKNG

SEQ ID NO: 258338 - protein, 9 aa, Dengue virus
LTAIANQAV

SEQ ID NO: 258339 - protein, 9 aa, Dengue virus
RVIQLSRKT

SEQ ID NO: 258340 - protein, 9 aa, Dengue virus
IKQQGILGK

SEQ ID NO: 258341 - protein, 9 aa, Dengue virus
LTIMDLHPG

SEQ ID NO: 258342 - protein, 9 aa, Dengue virus
IYSDPLALR

SEQ ID NO: 258343 - protein, 9 aa, Dengue virus
PLLALGCYS

SEQ ID NO: 258344 - protein, 9 aa, Dengue virus
IRWIVERGM

SEQ ID NO: 258345 - protein, 9 aa, Dengue virus
WAYHGSYEV

SEQ ID NO: 258346 - protein, 9 aa, Dengue virus
GLLLAAYVM

SEQ ID NO: 258347 - protein, 9 aa, Dengue virus
EEALKGLPI

SEQ ID NO: 258348 - protein, 9 aa, Dengue virus
ISYGGGWKL

SEQ ID NO: 258349 - protein, 9 aa, Dengue virus
LTAIANQAA

SEQ ID NO: 258350 - protein, 9 aa, Dengue virus
LDKGWPLSK

SEQ ID NO: 258351 - protein, 9 aa, Dengue virus
PESLETLML

SEQ ID NO: 258352 - protein, 9 aa, Dengue virus
LASMAICSA

SEQ ID NO: 258353 - protein, 9 aa, Dengue virus
RSVALAPHV

SEQ ID NO: 258354 - protein, 9 aa, Dengue virus
IWYMWLGAR

SEQ ID NO: 258355 - protein, 9 aa, Dengue virus
YMWLGARYL

SEQ ID NO: 258356 - protein, 9 aa, Dengue virus
LLVLCAVQL

SEQ ID NO: 258357 - protein, 9 aa, Dengue virus
VRSNAAMGA

SEQ ID NO: 258358 - protein, 9 aa, Dengue virus
PETMETLLL

SEQ ID NO: 258359 - protein, 9 aa, Dengue virus
FLAIPPTAG

SEQ ID NO: 258360 - protein, 9 aa, Dengue virus
CGIRSTTRL

SEQ ID NO: 258361 - protein, 9 aa, Dengue virus
IKRKLRTLV

SEQ ID NO: 258362 - protein, 9 aa, Dengue virus
QTWMSAEGA

SEQ ID NO: 258363 - protein, 9 aa, Dengue virus
QTWMSSEGA

SEQ ID NO: 258364 - protein, 9 aa, Dengue virus
FVELMKRGD

SEQ ID NO: 258365 - protein, 9 aa, Dengue virus
FTNMEAQLI

SEQ ID NO: 258366 - protein, 9 aa, Dengue virus
FQPESPARL

SEQ ID NO: 258367 - protein, 9 aa, Dengue virus
VVSILASSF

SEQ ID NO: 258368 - protein, 9 aa, Dengue virus
GRTLRVLKM

SEQ ID NO: 258369 - protein, 9 aa, Dengue virus
VKRFSTGLL

SEQ ID NO: 258370 - protein, 9 aa, Dengue virus
AMHSALTGA

SEQ ID NO: 258371 - protein, 9 aa, Dengue virus
IRYQTTAVK

SEQ ID NO: 258372 - protein, 9 aa, Dengue virus
KCRLRMDKL

SEQ ID NO: 258373 - protein, 9 aa, Dengue virus
HRVDLGVPL

SEQ ID NO: 258374 - protein, 9 aa, Dengue virus
ANIFRGSYL

SEQ ID NO: 258375 - protein, 9 aa, Dengue virus
IFVVDNVHT

SEQ ID NO: 258376 - protein, 9 aa, Dengue virus
YLPAMVREA

SEQ ID NO: 258377 - protein, 9 aa, Dengue virus
FQADSPKRL

SEQ ID NO: 258378 - protein, 9 aa, Dengue virus
IVMDEAHFT

SEQ ID NO: 258379 - protein, 9 aa, Dengue virus
IANQAAVLM

SEQ ID NO: 258380 - protein, 9 aa, Dengue virus
MYADDTAGW

SEQ ID NO: 258381 - protein, 9 aa, Dengue virus
FQPESPARV

SEQ ID NO: 258382 - protein, 9 aa, Dengue virus
MRLLSPVRV

SEQ ID NO: 258383 - protein, 9 aa, Dengue virus
ETTMRGAKR

SEQ ID NO: 258384 - protein, 9 aa, Dengue virus
VSILLSSLL

SEQ ID NO: 258385 - protein, 9 aa, Dengue virus
LRLAANAIC

SEQ ID NO: 258386 - protein, 9 aa, Dengue virus
LHRLGYILR

SEQ ID NO: 258387 - protein, 9 aa, Dengue virus
VRSNAAIGA

SEQ ID NO: 258388 - protein, 9 aa, Dengue virus
FQADSPKRL

SEQ ID NO: 258389 - protein, 9 aa, Dengue virus
DLRLASNAI

SEQ ID NO: 258390 - protein, 9 aa, Dengue virus
FEATARGAR

SEQ ID NO: 258391 - protein, 9 aa, Dengue virus
CLRKSGKKV

SEQ ID NO: 258392 - protein, 9 aa, Dengue virus
LVRCPLSRN

SEQ ID NO: 258393 - protein, 9 aa, Dengue virus
MGLGKGWPL

SEQ ID NO: 258394 - protein, 9 aa, Dengue virus
RMAILGDTA

SEQ ID NO: 258395 - protein, 9 aa, Dengue virus
YRGAKRMAI

SEQ ID NO: 258396 - protein, 9 aa, Dengue virus
LAIEPGKNP

SEQ ID NO: 258397 - protein, 9 aa, Dengue virus
LLLMRTSWA

SEQ ID NO: 258398 - protein, 9 aa, Dengue virus
HVGMGLETR

SEQ ID NO: 258399 - protein, 9 aa, Dengue virus
ILKRWGQLK

SEQ ID NO: 258400 - protein, 9 aa, Dengue virus
DIPMTGPLV

SEQ ID NO: 258401 - protein, 9 aa, Dengue virus
ISYGGGWRL

SEQ ID NO: 258402 - protein, 9 aa, Dengue virus
YWVSCGTGN

SEQ ID NO: 258403 - protein, 9 aa, Dengue virus
FTNMEVQLI

SEQ ID NO: 258404 - protein, 9 aa, Dengue virus
ARGYISTRV

SEQ ID NO: 258405 - protein, 9 aa, Dengue virus
ELIGRARIS

SEQ ID NO: 258406 - protein, 9 aa, Dengue virus
MWTLMYFHR

SEQ ID NO: 258407 - protein, 9 aa, Dengue virus
VYKEGVFHT

SEQ ID NO: 258408 - protein, 9 aa, Dengue virus
IANQAAVLM

SEQ ID NO: 258409 - protein, 9 aa, Dengue virus
FLEFEALGF

SEQ ID NO: 258410 - protein, 9 aa, Dengue virus
CYVITGRSA

SEQ ID NO: 258411 - protein, 9 aa, Dengue virus
PLLALGCYS

SEQ ID NO: 258412 - protein, 9 aa, Dengue virus
LVLEHGGCV

SEQ ID NO: 258413 - protein, 9 aa, Dengue virus
HKMDLGVPL

SEQ ID NO: 258414 - protein, 9 aa, Dengue virus
SCTMPPLRF

SEQ ID NO: 258415 - protein, 9 aa, Dengue virus
DLRLASNAI

SEQ ID NO: 258416 - protein, 9 aa, Dengue virus
LTLATGPIL

SEQ ID NO: 258417 - protein, 9 aa, Dengue virus
GCYSQVNPL

SEQ ID NO: 258418 - protein, 9 aa, Dengue virus
FCEALTLAT

SEQ ID NO: 258419 - protein, 9 aa, Dengue virus
SKMDLGVPL

SEQ ID NO: 258420 - protein, 9 aa, Dengue virus
IKRGLRTLI

SEQ ID NO: 258421 - protein, 9 aa, Dengue virus
NEGIMAVGM

SEQ ID NO: 258422 - protein, 9 aa, Dengue virus
LIRCPLSRN

SEQ ID NO: 258423 - protein, 9 aa, Dengue virus
TYQNKVVKV

SEQ ID NO: 258424 - protein, 9 aa, Dengue virus
FQPESPARV

SEQ ID NO: 258425 - protein, 9 aa, Dengue virus
SKMDIGVPL

SEQ ID NO: 258426 - protein, 9 aa, Dengue virus
LQGQGPMKM

SEQ ID NO: 258427 - protein, 9 aa, Dengue virus
LETLLLLAL

SEQ ID NO: 258428 - protein, 9 aa, Dengue virus
NEAIMAVGL

SEQ ID NO: 258429 - protein, 9 aa, Dengue virus
YISTRVEMG

SEQ ID NO: 258430 - protein, 9 aa, Dengue virus
HWFSRGNSF

SEQ ID NO: 258431 - protein, 9 aa, Dengue virus
FVVDNVHTR

SEQ ID NO: 258432 - protein, 9 aa, Dengue virus
SLRTTTVSG

SEQ ID NO: 258433 - protein, 9 aa, Dengue virus
LAPHVGLGL

SEQ ID NO: 258434 - protein, 9 aa, Dengue virus
FSRENSLSG

SEQ ID NO: 258435 - protein, 9 aa, Dengue virus
WSLMYFHRR

SEQ ID NO: 258436 - protein, 9 aa, Dengue virus
IRYQTPAIR

SEQ ID NO: 258437 - protein, 9 aa, Dengue virus
FWNTTIAVS

SEQ ID NO: 258438 - protein, 9 aa, Dengue virus
NTTIAVSMA

SEQ ID NO: 258439 - protein, 9 aa, Dengue virus
RKKLRPRWL

SEQ ID NO: 258440 - protein, 9 aa, Dengue virus
YCGGLKNVT

SEQ ID NO: 258441 - protein, 9 aa, Dengue virus
WNIVKLMSG

SEQ ID NO: 258442 - protein, 9 aa, Dengue virus
IAVSTANIF

SEQ ID NO: 258443 - protein, 9 aa, Dengue virus
SILASSFLR

SEQ ID NO: 258444 - protein, 9 aa, Dengue virus
LLTLIAVLT

SEQ ID NO: 258445 - protein, 9 aa, Dengue virus
VLPMVTQIA

SEQ ID NO: 258446 - protein, 9 aa, Dengue virus
NISLAAIAN

SEQ ID NO: 258447 - protein, 9 aa, Dengue virus
IEESRTIRV

SEQ ID NO: 258448 - protein, 9 aa, Dengue virus
LAAIANQAA

SEQ ID NO: 258449 - protein, 9 aa, Dengue virus
MMRTTWALC

SEQ ID NO: 258450 - protein, 9 aa, Dengue virus
FVADNVHTR

SEQ ID NO: 258451 - protein, 9 aa, Dengue virus
IRQMEAEGV

SEQ ID NO: 258452 - protein, 9 aa, Dengue virus
VVTRSGAYV

SEQ ID NO: 258453 - protein, 9 aa, Dengue virus
LTLATGPVS

SEQ ID NO: 258454 - protein, 9 aa, Dengue virus
CGIRSATRM

SEQ ID NO: 258455 - protein, 9 aa, Dengue virus
FMALVAFLR

SEQ ID NO: 258456 - protein, 9 aa, Dengue virus
MGLDKGWPL

SEQ ID NO: 258457 - protein, 9 aa, Dengue virus
AVSRGSSKI

SEQ ID NO: 258458 - protein, 9 aa, Dengue virus
PQWIASSII

SEQ ID NO: 258459 - protein, 9 aa, Dengue virus
AGRTLRVLS

SEQ ID NO: 258460 - protein, 9 aa, Dengue virus
DVPLAGPLI

SEQ ID NO: 258461 - protein, 9 aa, Dengue virus
VVPMVTQLA

SEQ ID NO: 258462 - protein, 9 aa, Dengue virus
LPVWLAYKV

SEQ ID NO: 258463 - protein, 9 aa, Dengue virus
AKRFSRGML

SEQ ID NO: 258464 - protein, 9 aa, Dengue virus
LKPRWLDAR

SEQ ID NO: 258465 - protein, 9 aa, Dengue virus
IHAHHQWMT

SEQ ID NO: 258466 - protein, 9 aa, Dengue virus
VIPMVTQMA

SEQ ID NO: 258467 - protein, 9 aa, Dengue virus
WALCEVLTL

SEQ ID NO: 258468 - protein, 9 aa, Dengue virus
LLKNDVPLA

SEQ ID NO: 258469 - protein, 9 aa, Dengue virus
IRRGLRTLI

SEQ ID NO: 258470 - protein, 9 aa, Dengue virus
IVSILASSL

SEQ ID NO: 258471 - protein, 9 aa, Dengue virus
AGIMKNPTV

SEQ ID NO: 258472 - protein, 9 aa, Dengue virus
RMAILGDTA

SEQ ID NO: 258473 - protein, 9 aa, Dengue virus
IVSILASSL

SEQ ID NO: 258474 - protein, 9 aa, Dengue virus
LSPVRVPNY

SEQ ID NO: 258475 - protein, 9 aa, Dengue virus
WVSCGTGNI

SEQ ID NO: 258476 - protein, 9 aa, Dengue virus
IANQAAILM

SEQ ID NO: 258477 - protein, 9 aa, Dengue virus
FVPSIKTGN

SEQ ID NO: 258478 - protein, 9 aa, Dengue virus
VEMGEAAAI

SEQ ID NO: 258479 - protein, 9 aa, Dengue virus
YNLIVMDEA

SEQ ID NO: 258480 - protein, 9 aa, Dengue virus
YCGGLKNVK

SEQ ID NO: 258481 - protein, 9 aa, Dengue virus
GRTLRVLSL

SEQ ID NO: 258482 - protein, 9 aa, Dengue virus
WSLRETACL

SEQ ID NO: 258483 - protein, 9 aa, Dengue virus
MHSALTGAT

SEQ ID NO: 258484 - protein, 9 aa, Dengue virus
AGIMKNPTV

SEQ ID NO: 258485 - protein, 9 aa, Dengue virus
GHLKCKVRM

SEQ ID NO: 258486 - protein, 9 aa, Dengue virus
FQADSPKRL

SEQ ID NO: 258487 - protein, 9 aa, Dengue virus
DLRLASMAI

SEQ ID NO: 258488 - protein, 9 aa, Dengue virus
IVSSVNMIS

SEQ ID NO: 258489 - protein, 9 aa, Dengue virus
PLLAIGCYS

SEQ ID NO: 258490 - protein, 9 aa, Dengue virus
PKRLSAAIG

SEQ ID NO: 258491 - protein, 9 aa, Dengue virus
IKRGLRTLI

SEQ ID NO: 258492 - protein, 9 aa, Dengue virus
YRLRGEQRK

SEQ ID NO: 258493 - protein, 9 aa, Dengue virus
CGIRSTTRL

SEQ ID NO: 258494 - protein, 9 aa, Dengue virus
LRVLNLVEN

SEQ ID NO: 258495 - protein, 9 aa, Dengue virus
VTQVLLMRT

SEQ ID NO: 258496 - protein, 9 aa, Dengue virus
GSQLAKRFS

SEQ ID NO: 258497 - protein, 9 aa, Dengue virus
ILLMRTTWA

SEQ ID NO: 258498 - protein, 9 aa, Dengue virus
IVSSVNMVS

SEQ ID NO: 258499 - protein, 9 aa, Dengue virus
LLSGRGPLK

SEQ ID NO: 258500 - protein, 9 aa, Dengue virus
EEALKGLPI

SEQ ID NO: 258501 - protein, 9 aa, Dengue virus
YVFMGEPLE

SEQ ID NO: 258502 - protein, 9 aa, Dengue virus
LIGLTSRAT

SEQ ID NO: 258503 - protein, 9 aa, Dengue virus
IRWFVERNL

SEQ ID NO: 258504 - protein, 9 aa, Dengue virus
LLILCASQI

SEQ ID NO: 258505 - protein, 9 aa, Dengue virus
LVTFKNPHA

SEQ ID NO: 258506 - protein, 9 aa, Dengue virus
VSQGAGWSL

SEQ ID NO: 258507 - protein, 9 aa, Dengue virus
IVSAVNMTS

SEQ ID NO: 258508 - protein, 9 aa, Dengue virus
LKCGSGIFV

SEQ ID NO: 258509 - protein, 9 aa, Dengue virus
LIALNDMGK

SEQ ID NO: 258510 - protein, 9 aa, Dengue virus
FVDLMKRGD

SEQ ID NO: 258511 - protein, 9 aa, Dengue virus
YNLIIMDEA

SEQ ID NO: 258512 - protein, 9 aa, Dengue virus
LMKRGDLPV

SEQ ID NO: 258513 - protein, 9 aa, Dengue virus
IKDSKAVHA

SEQ ID NO: 258514 - protein, 9 aa, Dengue virus
SRTIRVLKM

SEQ ID NO: 258515 - protein, 9 aa, Dengue virus
PMSTYGWNL

SEQ ID NO: 258516 - protein, 9 aa, Dengue virus
LVRCPLSRN

SEQ ID NO: 258517 - protein, 9 aa, Dengue virus
FCEVLTLAT

SEQ ID NO: 258518 - protein, 9 aa, Dengue virus
VDGIVAIDL

SEQ ID NO: 258519 - protein, 9 aa, Dengue virus
ILTDGPERV

SEQ ID NO: 258520 - protein, 9 aa, Dengue virus
VVLAGPMPV

SEQ ID NO: 258521 - protein, 9 aa, Dengue virus
LLKNDIPMT

SEQ ID NO: 258522 - protein, 9 aa, Dengue virus
SVALAPHVG

SEQ ID NO: 258523 - protein, 9 aa, Dengue virus
FVEGVSGGS

SEQ ID NO: 258524 - protein, 9 aa, Dengue virus
AILMGLDKG

SEQ ID NO: 258525 - protein, 9 aa, Dengue virus
VTYSLNTFT

SEQ ID NO: 258526 - protein, 9 aa, Dengue virus
IIMDEAHFT

SEQ ID NO: 258527 - protein, 9 aa, Dengue virus
WKIEKASFI

SEQ ID NO: 258528 - protein, 9 aa, Dengue virus
GGLLLAAYV

SEQ ID NO: 258529 - protein, 9 aa, Dengue virus
DIPMTGPLV

SEQ ID NO: 258530 - protein, 9 aa, Dengue virus
VREVKGLTK

SEQ ID NO: 258531 - protein, 9 aa, Dengue virus
CYSQVNPLT

SEQ ID NO: 258532 - protein, 9 aa, Dengue virus
YRGAKRMAI

SEQ ID NO: 258533 - protein, 9 aa, Dengue virus
VKLHSGVDV

SEQ ID NO: 258534 - protein, 9 aa, Dengue virus
YMATLKNVR

SEQ ID NO: 258535 - protein, 9 aa, Dengue virus
CIKVLNPYM

SEQ ID NO: 258536 - protein, 9 aa, Dengue virus
LMGLGKGWP

SEQ ID NO: 258537 - protein, 9 aa, Dengue virus
SMVNGVVKL

SEQ ID NO: 258538 - protein, 9 aa, Dengue virus
VWIQDNPNM

SEQ ID NO: 258539 - protein, 9 aa, Dengue virus
FCESLTLAT

SEQ ID NO: 258540 - protein, 9 aa, Dengue virus
MWHVTRGSV

SEQ ID NO: 258541 - protein, 9 aa, Dengue virus
ISEMGANFR

SEQ ID NO: 258542 - protein, 9 aa, Dengue virus
LPVWLAYKV

SEQ ID NO: 258543 - protein, 9 aa, Dengue virus
IANCLRKNG

SEQ ID NO: 258544 - protein, 9 aa, Dengue virus
FLRVLSIPP

SEQ ID NO: 258545 - protein, 9 aa, Dengue virus
TRRYLPAMV

SEQ ID NO: 258546 - protein, 9 aa, Dengue virus
LGKGWPLHR

SEQ ID NO: 258547 - protein, 9 aa, Dengue virus
SVALAPHVG

SEQ ID NO: 258548 - protein, 9 aa, Dengue virus
ISYGGGWRL

SEQ ID NO: 258549 - protein, 9 aa, Dengue virus
FHTMWHVTR

SEQ ID NO: 258550 - protein, 9 aa, Dengue virus
PRWLDARIY

SEQ ID NO: 258551 - protein, 9 aa, Dengue virus
FVELMKRGD

SEQ ID NO: 258552 - protein, 9 aa, Dengue virus
PLIAGGMLI

SEQ ID NO: 258553 - protein, 9 aa, Dengue virus
FLNDMGKVR

SEQ ID NO: 258554 - protein, 9 aa, Dengue virus
AIANQAAVL

SEQ ID NO: 258555 - protein, 9 aa, Dengue virus
LLILCTGQL

SEQ ID NO: 258556 - protein, 9 aa, Dengue virus
LAAIANQAT

SEQ ID NO: 258557 - protein, 9 aa, Dengue virus
HWIAASIIL

SEQ ID NO: 258558 - protein, 9 aa, Dengue virus
MYWVSNASG

SEQ ID NO: 258559 - protein, 9 aa, Dengue virus
VTAASAAQR

SEQ ID NO: 258560 - protein, 9 aa, Dengue virus
VKRFSTGLL

SEQ ID NO: 258561 - protein, 9 aa, Dengue virus
MVREAIRRG

SEQ ID NO: 258562 - protein, 9 aa, Dengue virus
QTWMSSEGA

SEQ ID NO: 258563 - protein, 9 aa, Dengue virus
DARVYADPM

SEQ ID NO: 258564 - protein, 9 aa, Dengue virus
WYGMEIRPL

SEQ ID NO: 258565 - protein, 9 aa, Dengue virus
VKPTGSASS

SEQ ID NO: 258566 - protein, 9 aa, Dengue virus
AVGMVSILA

SEQ ID NO: 258567 - protein, 9 aa, Dengue virus
SVALTPHSG

SEQ ID NO: 258568 - protein, 9 aa, Dengue virus
CLRKSGKRV

SEQ ID NO: 258569 - protein, 9 aa, Dengue virus
TLMLVALLA

SEQ ID NO: 258570 - protein, 9 aa, Dengue virus
IYADPMALK

SEQ ID NO: 258571 - protein, 9 aa, Dengue virus
GLFGKGSLI

SEQ ID NO: 258572 - protein, 9 aa, Dengue virus
IWYMWLGAR

SEQ ID NO: 258573 - protein, 9 aa, Dengue virus
LLALNDMGK

SEQ ID NO: 258574 - protein, 9 aa, Dengue virus
WNLVKLHSG

SEQ ID NO: 258575 - protein, 9 aa, Dengue virus
FWNTTIAVS

SEQ ID NO: 258576 - protein, 9 aa, Dengue virus
TKRILPSIV

SEQ ID NO: 258577 - protein, 9 aa, Dengue virus
VIPMVTQMA

SEQ ID NO: 258578 - protein, 9 aa, Dengue virus
YCGGLKNVT

SEQ ID NO: 258579 - protein, 9 aa, Dengue virus
IEESRTIRV

SEQ ID NO: 258580 - protein, 9 aa, Dengue virus
IENTTANIS

SEQ ID NO: 258581 - protein, 9 aa, Dengue virus
FQPESPKRL

SEQ ID NO: 258582 - protein, 9 aa, Dengue virus
LVRCPLSRN

SEQ ID NO: 258583 - protein, 9 aa, Dengue virus
CKKVRSNAA

SEQ ID NO: 258584 - protein, 9 aa, Dengue virus
FEKQLGQVM

SEQ ID NO: 258585 - protein, 9 aa, Dengue virus
YVSGIAQTN

SEQ ID NO: 258586 - protein, 9 aa, Dengue virus
KVIQLSRKT

SEQ ID NO: 258587 - protein, 9 aa, Dengue virus
WCNATSAWV

SEQ ID NO: 258588 - protein, 9 aa, Dengue virus
VLTLATGPV

SEQ ID NO: 258589 - protein, 9 aa, Dengue virus
YRIMQRGLF

SEQ ID NO: 258590 - protein, 9 aa, Dengue virus
GFGVFTTNI

SEQ ID NO: 258591 - protein, 9 aa, Dengue virus
VKDQRAVHA

SEQ ID NO: 258592 - protein, 9 aa, Dengue virus
VVLMGLDKG

SEQ ID NO: 258593 - protein, 9 aa, Dengue virus
HQWMTTEDM

SEQ ID NO: 258594 - protein, 9 aa, Dengue virus
YWIESSKNQ

SEQ ID NO: 258595 - protein, 9 aa, Dengue virus
FVELMKRGD

SEQ ID NO: 258596 - protein, 9 aa, Dengue virus
YAVSRGTSK

SEQ ID NO: 258597 - protein, 9 aa, Dengue virus
FMTATPPGS

SEQ ID NO: 258598 - protein, 9 aa, Dengue virus
LGSQEGAMH

SEQ ID NO: 258599 - protein, 9 aa, Dengue virus
FQADSPSKL

SEQ ID NO: 258600 - protein, 9 aa, Dengue virus
VKDNRAVHA

SEQ ID NO: 258601 - protein, 9 aa, Dengue virus
FCSHHFHQL

SEQ ID NO: 258602 - protein, 9 aa, Dengue virus
FGKGSLITC

SEQ ID NO: 258603 - protein, 9 aa, Dengue virus
FITNEVHTW

SEQ ID NO: 258604 - protein, 9 aa, Dengue virus
WSIHATHQW

SEQ ID NO: 258605 - protein, 9 aa, Dengue virus
WALCESITL

SEQ ID NO: 258606 - protein, 9 aa, Dengue virus
GLHRLGYIL

SEQ ID NO: 258607 - protein, 9 aa, Dengue virus
KYLPAIVRE

SEQ ID NO: 258608 - protein, 9 aa, Dengue virus
EEALRGLPI

SEQ ID NO: 258609 - protein, 9 aa, Dengue virus
FITPMLRHS

SEQ ID NO: 258610 - protein, 9 aa, Dengue virus
ILLSSLLRN

SEQ ID NO: 258611 - protein, 9 aa, Dengue virus
YEVKATGSA

SEQ ID NO: 258612 - protein, 9 aa, Dengue virus
TYQNKVVRV

SEQ ID NO: 258613 - protein, 9 aa, Dengue virus
CYVITGRSA

SEQ ID NO: 258614 - protein, 9 aa, Dengue virus
LHPASAWTL

SEQ ID NO: 258615 - protein, 9 aa, Dengue virus
EEALKGMPI

SEQ ID NO: 258616 - protein, 9 aa, Dengue virus
FVELMKRGD

SEQ ID NO: 258617 - protein, 9 aa, Dengue virus
CYVITGRSA

SEQ ID NO: 258618 - protein, 9 aa, Dengue virus
VKLHSGKDV

SEQ ID NO: 258619 - protein, 9 aa, Dengue virus
FSGVSWIMK

SEQ ID NO: 258620 - protein, 9 aa, Dengue virus
FAGHLKCRL

SEQ ID NO: 258621 - protein, 9 aa, Dengue virus
YTPEGIIPT

SEQ ID NO: 258622 - protein, 9 aa, Dengue virus
FLEFEALGF

SEQ ID NO: 258623 - protein, 9 aa, Dengue virus
LVKLALITV

SEQ ID NO: 258624 - protein, 9 aa, Dengue virus
ITLATGPLS

SEQ ID NO: 258625 - protein, 9 aa, Dengue virus
VLAIEPGKN

SEQ ID NO: 258626 - protein, 9 aa, Dengue virus
IRYQTTAVK

SEQ ID NO: 258627 - protein, 9 aa, Dengue virus
SYAQMWALM

SEQ ID NO: 258628 - protein, 9 aa, Dengue virus
LKRERNRVS

SEQ ID NO: 258629 - protein, 9 aa, Dengue virus
YIYMGQPLN

SEQ ID NO: 258630 - protein, 9 aa, Dengue virus
IMKNPTVDG

SEQ ID NO: 258631 - protein, 9 aa, Dengue virus
LGKGWPLHR

SEQ ID NO: 258632 - protein, 9 aa, Dengue virus
HVGMGLETR

SEQ ID NO: 258633 - protein, 9 aa, Dengue virus
VEMGEAAGI

SEQ ID NO: 258634 - protein, 9 aa, Dengue virus
YNLIIMDEA

SEQ ID NO: 258635 - protein, 9 aa, Dengue virus
LVALLATVT

SEQ ID NO: 258636 - protein, 9 aa, Dengue virus
IALDFSPGT

SEQ ID NO: 258637 - protein, 9 aa, Dengue virus
GFGVFSTNI

SEQ ID NO: 258638 - protein, 9 aa, Dengue virus
LLMMRTTWA

SEQ ID NO: 258639 - protein, 9 aa, Dengue virus
LAAIANQAV

SEQ ID NO: 258640 - protein, 9 aa, Dengue virus
IVREAIKRK

SEQ ID NO: 258641 - protein, 9 aa, Dengue virus
VTHASAAQR

SEQ ID NO: 258642 - protein, 9 aa, Dengue virus
TTIVTPMLR

SEQ ID NO: 258643 - protein, 9 aa, Dengue virus
MGLGKGWPI

SEQ ID NO: 258644 - protein, 9 aa, Dengue virus
ETTMRGAKR

SEQ ID NO: 258645 - protein, 9 aa, Dengue virus
IIMDEAHFT

SEQ ID NO: 258646 - protein, 9 aa, Dengue virus
TKRILPSIV

SEQ ID NO: 258647 - protein, 9 aa, Dengue virus
RSVALVPHV

SEQ ID NO: 258648 - protein, 9 aa, Dengue virus
ANIFRGSYL

SEQ ID NO: 258649 - protein, 9 aa, Dengue virus
LRTTTVTGK

SEQ ID NO: 258650 - protein, 9 aa, Dengue virus
IFITDNVHT

SEQ ID NO: 258651 - protein, 9 aa, Dengue virus
VVGLYGNGV

SEQ ID NO: 258652 - protein, 9 aa, Dengue virus
RHTIENSTA

SEQ ID NO: 258653 - protein, 9 aa, Dengue virus
YTPEGIIPT

SEQ ID NO: 258654 - protein, 9 aa, Dengue virus
SRTTWSIHA

SEQ ID NO: 258655 - protein, 9 aa, Dengue virus
INGVVKLLT

SEQ ID NO: 258656 - protein, 9 aa, Dengue virus
FTNMEVQLI

SEQ ID NO: 258657 - protein, 9 aa, Dengue virus
YAQMWTLMY

SEQ ID NO: 258658 - protein, 9 aa, Dengue virus
VIVLGSQEG

SEQ ID NO: 258659 - protein, 9 aa, Dengue virus
LWEGSPGRF

SEQ ID NO: 258660 - protein, 9 aa, Dengue virus
VYNMMGKRE

SEQ ID NO: 258661 - protein, 9 aa, Dengue virus
FLRFLTIPP

SEQ ID NO: 258662 - protein, 9 aa, Dengue virus
WVSGVSGNI

SEQ ID NO: 258663 - protein, 9 aa, Dengue virus
VTRSGTYVS

SEQ ID NO: 258664 - protein, 9 aa, Dengue virus
ITLATGPLS

SEQ ID NO: 258665 - protein, 9 aa, Dengue virus
DVPLAGPLI

SEQ ID NO: 258666 - protein, 9 aa, Dengue virus
FQADSPKRL

SEQ ID NO: 258667 - protein, 9 aa, Dengue virus
VIDLEPVIY

SEQ ID NO: 258668 - protein, 9 aa, Dengue virus
IRYQTPAIR

SEQ ID NO: 258669 - protein, 9 aa, Dengue virus
FHRRDLRLA

SEQ ID NO: 258670 - protein, 9 aa, Dengue virus
IRYQTTAVK

SEQ ID NO: 258671 - protein, 9 aa, Dengue virus
LYAVATTIV

SEQ ID NO: 258672 - protein, 9 aa, Dengue virus
LVKLMSGKD

SEQ ID NO: 258673 - protein, 9 aa, Dengue virus
LKCGSGIFI

SEQ ID NO: 258674 - protein, 9 aa, Dengue virus
WMSSEGAWK

SEQ ID NO: 258675 - protein, 9 aa, Dengue virus
LVTFKTAHA

SEQ ID NO: 258676 - protein, 9 aa, Dengue virus
LLAMGCYSQ

SEQ ID NO: 258677 - protein, 9 aa, Dengue virus
TTWSIHAKH

SEQ ID NO: 258678 - protein, 9 aa, Dengue virus
YTPEGIIPT

SEQ ID NO: 258679 - protein, 9 aa, Dengue virus
IVSSVNMIS

SEQ ID NO: 258680 - protein, 9 aa, Dengue virus
WLDARTYSD

SEQ ID NO: 258681 - protein, 9 aa, Dengue virus
WADVRNDLI

SEQ ID NO: 258682 - protein, 9 aa, Dengue virus
VYRIKQQGI

SEQ ID NO: 258683 - protein, 9 aa, Dengue virus
MVTFKVPHA

SEQ ID NO: 258684 - protein, 9 aa, Dengue virus
FWNTTIAVS

SEQ ID NO: 258685 - protein, 9 aa, Dengue virus
LVTFKNPHA

SEQ ID NO: 258686 - protein, 9 aa, Dengue virus
LLTLIAVLT

SEQ ID NO: 258687 - protein, 9 aa, Dengue virus
YRGAKRMAI

SEQ ID NO: 258688 - protein, 9 aa, Dengue virus
FWNTTIAVS

SEQ ID NO: 258689 - protein, 9 aa, Dengue virus
FHTMWHVTR

SEQ ID NO: 258690 - protein, 9 aa, Dengue virus
CGSLIGLSS

SEQ ID NO: 258691 - protein, 9 aa, Dengue virus
VVVLGSQEG

SEQ ID NO: 258692 - protein, 9 aa, Dengue virus
MSTYGWNLV

SEQ ID NO: 258693 - protein, 9 aa, Dengue virus
PLLALGCYS

SEQ ID NO: 258694 - protein, 9 aa, Dengue virus
ETWMSSEGA

SEQ ID NO: 258695 - protein, 9 aa, Dengue virus
FKNAHAKRQ

SEQ ID NO: 258696 - protein, 9 aa, Dengue virus
IVSSVNTIS

SEQ ID NO: 258697 - protein, 9 aa, Dengue virus
KRGDLPVWL

SEQ ID NO: 258698 - protein, 9 aa, Dengue virus
FKLTYQNKV

SEQ ID NO: 258699 - protein, 9 aa, Dengue virus
NEGIMAIGI

SEQ ID NO: 258700 - protein, 9 aa, Dengue virus
CVTTIAKSK

SEQ ID NO: 258701 - protein, 9 aa, Dengue virus
AKRFSRGML

SEQ ID NO: 258702 - protein, 9 aa, Dengue virus
FSGVSWIMK

SEQ ID NO: 258703 - protein, 9 aa, Dengue virus
LLILCASQI

SEQ ID NO: 258704 - protein, 9 aa, Dengue virus
FSRENSYSG

SEQ ID NO: 258705 - protein, 9 aa, Dengue virus
VRSNAAIGA

SEQ ID NO: 258706 - protein, 9 aa, Dengue virus
LVSLLGSSL

SEQ ID NO: 258707 - protein, 9 aa, Dengue virus
YLPAIVREA

SEQ ID NO: 258708 - protein, 9 aa, Dengue virus
FMGHLKCRL

SEQ ID NO: 258709 - protein, 9 aa, Dengue virus
FEKQLGQVM

SEQ ID NO: 258710 - protein, 9 aa, Dengue virus
FGKGSLVTC

SEQ ID NO: 258711 - protein, 9 aa, Dengue virus
FMTATPPGA

SEQ ID NO: 258712 - protein, 9 aa, Dengue virus
VEAGRTLRV

SEQ ID NO: 258713 - protein, 9 aa, Dengue virus
IFMTATPPG

SEQ ID NO: 258714 - protein, 9 aa, Dengue virus
MAVGLVSIL

SEQ ID NO: 258715 - protein, 9 aa, Dengue virus
IVSSVNMIS

SEQ ID NO: 258716 - protein, 9 aa, Dengue virus
INGVVRLLT

SEQ ID NO: 258717 - protein, 9 aa, Dengue virus
AGRTLRVLS

SEQ ID NO: 258718 - protein, 9 aa, Dengue virus
LIGLTARAT

SEQ ID NO: 258719 - protein, 9 aa, Dengue virus
WVSGATGNI

SEQ ID NO: 258720 - protein, 9 aa, Dengue virus
IIREAIKRK

SEQ ID NO: 258721 - protein, 9 aa, Dengue virus
LVSLLGSSL

SEQ ID NO: 258722 - protein, 9 aa, Dengue virus
FQPESPARL

SEQ ID NO: 258723 - protein, 9 aa, Dengue virus
WYGMEIRPI

SEQ ID NO: 258724 - protein, 9 aa, Dengue virus
LLKNDVPLA

SEQ ID NO: 258725 - protein, 9 aa, Dengue virus
ITLATGPLS

SEQ ID NO: 258726 - protein, 9 aa, Dengue virus
FEKQLGQVM

SEQ ID NO: 258727 - protein, 9 aa, Dengue virus
FVEGVSGGA

SEQ ID NO: 258728 - protein, 9 aa, Dengue virus
TWSIHATHQ

SEQ ID NO: 258729 - protein, 9 aa, Dengue virus
IRYQTPAIR

SEQ ID NO: 258730 - protein, 9 aa, Dengue virus
TRKYLPAII

SEQ ID NO: 258731 - protein, 9 aa, Dengue virus
WCNATSAWV

SEQ ID NO: 258732 - protein, 9 aa, Dengue virus
FQADSPKKL

SEQ ID NO: 258733 - protein, 9 aa, Dengue virus
VIPMVTQMA

SEQ ID NO: 258734 - protein, 9 aa, Dengue virus
LALEPGKNP

SEQ ID NO: 258735 - protein, 9 aa, Dengue virus
MLRHSIENS

SEQ ID NO: 258736 - protein, 9 aa, Dengue virus
IVSILASSL

SEQ ID NO: 258737 - protein, 9 aa, Dengue virus
ITLATGPLS

SEQ ID NO: 258738 - protein, 9 aa, Dengue virus
IRYQTTAVK

SEQ ID NO: 258739 - protein, 9 aa, Dengue virus
VKRFSTGLL

SEQ ID NO: 258740 - protein, 9 aa, Dengue virus
IWYMWLGAR

SEQ ID NO: 258741 - protein, 9 aa, Dengue virus
IVSAVNMTS

SEQ ID NO: 258742 - protein, 9 aa, Dengue virus
MYADDTAGW

SEQ ID NO: 258743 - protein, 9 aa, Dengue virus
IRYQTTAVK

SEQ ID NO: 258744 - protein, 9 aa, Dengue virus
FLAIPPTAG

SEQ ID NO: 258745 - protein, 9 aa, Dengue virus
PMSTYGWNL

SEQ ID NO: 258746 - protein, 9 aa, Dengue virus
YRGAKRMAI

SEQ ID NO: 258747 - protein, 9 aa, Dengue virus
ISRMLINRF

SEQ ID NO: 258748 - protein, 9 aa, Dengue virus
AVSRGSAKL

SEQ ID NO: 258749 - protein, 9 aa, Dengue virus
YETKQTGSA

SEQ ID NO: 258750 - protein, 9 aa, Dengue virus
FGKGSLLTC

SEQ ID NO: 258751 - protein, 9 aa, Dengue virus
FKTAHAKKQ

SEQ ID NO: 258752 - protein, 9 aa, Dengue virus
ARGYISTRV

SEQ ID NO: 258753 - protein, 9 aa, Dengue virus
MEAQLIRQM

SEQ ID NO: 258754 - protein, 9 aa, Dengue virus
HRLMSAAVK

SEQ ID NO: 258755 - protein, 9 aa, Dengue virus
YRHAMEELP

SEQ ID NO: 258756 - protein, 9 aa, Dengue virus
YYCGGLKNV

SEQ ID NO: 258757 - protein, 9 aa, Dengue virus
RVIQLSRKT

SEQ ID NO: 258758 - protein, 9 aa, Dengue virus
LLRNDVPMA

SEQ ID NO: 258759 - protein, 9 aa, Dengue virus
LGKGWPIHK

SEQ ID NO: 258760 - protein, 9 aa, Dengue virus
WKLARASFI

SEQ ID NO: 258761 - protein, 9 aa, Dengue virus
ISEMGANFR

SEQ ID NO: 258762 - protein, 9 aa, Dengue virus
FTTRLLSST

SEQ ID NO: 258763 - protein, 9 aa, Dengue virus
TACLGKSYA

SEQ ID NO: 258764 - protein, 9 aa, Dengue virus
WISNGTGNI

SEQ ID NO: 258765 - protein, 9 aa, Dengue virus
FSRENSYSG

SEQ ID NO: 258766 - protein, 9 aa, Dengue virus
VILAGPMPV

SEQ ID NO: 258767 - protein, 9 aa, Dengue virus
CVTTIAKNK

SEQ ID NO: 258768 - protein, 9 aa, Dengue virus
FQADSPKRL

SEQ ID NO: 258769 - protein, 9 aa, Dengue virus
GGLLLAAYV

SEQ ID NO: 258770 - protein, 9 aa, Dengue virus
ISKMLLNRF

SEQ ID NO: 258771 - protein, 9 aa, Dengue virus
ISQGAGWSL

SEQ ID NO: 258772 - protein, 9 aa, Dengue virus
WVSCGTGNI

SEQ ID NO: 258773 - protein, 9 aa, Dengue virus
NISLTAIAN

SEQ ID NO: 258774 - protein, 9 aa, Dengue virus
YNMVIMDEA

SEQ ID NO: 258775 - protein, 9 aa, Dengue virus
LMGLGKGWP

SEQ ID NO: 258776 - protein, 9 aa, Dengue virus
CVKILNPYM

SEQ ID NO: 258777 - protein, 9 aa, Dengue virus
HEWMTTEDM

SEQ ID NO: 258778 - protein, 9 aa, Dengue virus
IMAIGIVSI

SEQ ID NO: 258779 - protein, 9 aa, Dengue virus
EGAMRTALT

SEQ ID NO: 258780 - protein, 9 aa, Dengue virus
QQLTKRFSL

SEQ ID NO: 258781 - protein, 9 aa, Dengue virus
EGAMHSALA

SEQ ID NO: 258782 - protein, 9 aa, Dengue virus
FVELMRRGD

SEQ ID NO: 258783 - protein, 9 aa, Dengue virus
MVLLIPEPE

SEQ ID NO: 258784 - protein, 9 aa, Dengue virus
FTNMEAQLI

SEQ ID NO: 258785 - protein, 9 aa, Dengue virus
LRLASNAIC

SEQ ID NO: 258786 - protein, 9 aa, Dengue virus
VYRIKQQGI

SEQ ID NO: 258787 - protein, 9 aa, Dengue virus
MLLDNIYTP

SEQ ID NO: 258788 - protein, 9 aa, Dengue virus
ITPMLRHTI

SEQ ID NO: 258789 - protein, 9 aa, Dengue virus
VTQVLLMRT

SEQ ID NO: 258790 - protein, 9 aa, Dengue virus
WAYHGSYEV

SEQ ID NO: 258791 - protein, 9 aa, Dengue virus
FIAFLRFLA

SEQ ID NO: 258792 - protein, 9 aa, Dengue virus
NEGIMAIGI

SEQ ID NO: 258793 - protein, 9 aa, Dengue virus
MWHVTRGAV

SEQ ID NO: 258794 - protein, 9 aa, Dengue virus
FETTMRGAK

SEQ ID NO: 258795 - protein, 9 aa, Dengue virus
VIGLYGNGV

SEQ ID NO: 258796 - protein, 9 aa, Dengue virus
FVVDNVHTR

SEQ ID NO: 258797 - protein, 9 aa, Dengue virus
FQPESPARV

SEQ ID NO: 258798 - protein, 9 aa, Dengue virus
NIVSSVNMV

SEQ ID NO: 258799 - protein, 9 aa, Dengue virus
WMSAEGAWR

SEQ ID NO: 258800 - protein, 9 aa, Dengue virus
LWEGSPGKF

SEQ ID NO: 258801 - protein, 9 aa, Dengue virus
PIRVPNYNL

SEQ ID NO: 258802 - protein, 9 aa, Dengue virus
LAAIANQAV

SEQ ID NO: 258803 - protein, 9 aa, Dengue virus
FLAIPPTAG

SEQ ID NO: 258804 - protein, 9 aa, Dengue virus
IRYQTTATK

SEQ ID NO: 258805 - protein, 9 aa, Dengue virus
IVLLIPEPD

SEQ ID NO: 258806 - protein, 9 aa, Dengue virus
YRIMQRGLF

SEQ ID NO: 258807 - protein, 9 aa, Dengue virus
VVGLYGNGV

SEQ ID NO: 258808 - protein, 9 aa, Dengue virus
IFITNNVHT

SEQ ID NO: 258809 - protein, 9 aa, Dengue virus
LAMTDTTPF

SEQ ID NO: 258810 - protein, 9 aa, Dengue virus
LYAVATTFI

SEQ ID NO: 258811 - protein, 9 aa, Dengue virus
HRVDLGVPL

SEQ ID NO: 258812 - protein, 9 aa, Dengue virus
FQEEQGWTS

SEQ ID NO: 258813 - protein, 9 aa, Dengue virus
LRVLSLVEN

SEQ ID NO: 258814 - protein, 9 aa, Dengue virus
PRWLDARVY

SEQ ID NO: 258815 - protein, 9 aa, Dengue virus
IFVIDNVHT

SEQ ID NO: 258816 - protein, 9 aa, Dengue virus
WNIVKLHSG

SEQ ID NO: 258817 - protein, 9 aa, Dengue virus
AVSRGSAKL

SEQ ID NO: 258818 - protein, 9 aa, Dengue virus
LLKATLLAI

SEQ ID NO: 258819 - protein, 9 aa, Dengue virus
KVIQLSRKT

SEQ ID NO: 258820 - protein, 9 aa, Dengue virus
ATTVLTPML

SEQ ID NO: 258821 - protein, 9 aa, Dengue virus
VILAGPIPV

SEQ ID NO: 258822 - protein, 9 aa, Dengue virus
TTMAQGKPT

SEQ ID NO: 258823 - protein, 9 aa, Dengue virus
IKRKLRTLI

SEQ ID NO: 258824 - protein, 9 aa, Dengue virus
ILLMRTTWA

SEQ ID NO: 258825 - protein, 9 aa, Dengue virus
HRLMSAAVK

SEQ ID NO: 258826 - protein, 9 aa, Dengue virus
IANCLRKSG

SEQ ID NO: 258827 - protein, 9 aa, Dengue virus
VRSTTRMEN

SEQ ID NO: 258828 - protein, 9 aa, Dengue virus
CSHHFHQLI

SEQ ID NO: 258829 - protein, 9 aa, Dengue virus
MWSLMYFHR

SEQ ID NO: 258830 - protein, 9 aa, Dengue virus
IRSTTRLEN

SEQ ID NO: 258831 - protein, 9 aa, Dengue virus
LLILCTGQL

SEQ ID NO: 258832 - protein, 9 aa, Dengue virus
FVEGVSGGT

SEQ ID NO: 258833 - protein, 9 aa, Dengue virus
GLHRLGYIL

SEQ ID NO: 258834 - protein, 9 aa, Dengue virus
LAIEPGKNP

SEQ ID NO: 258835 - protein, 9 aa, Dengue virus
WCNATSAWV

SEQ ID NO: 258836 - protein, 9 aa, Dengue virus
FHTMWHVTR

SEQ ID NO: 258837 - protein, 9 aa, Dengue virus
FTNMEVQLI

SEQ ID NO: 258838 - protein, 9 aa, Dengue virus
KKKLRPKWL

SEQ ID NO: 258839 - protein, 9 aa, Dengue virus
PLVAGGLLT

SEQ ID NO: 258840 - protein, 9 aa, Dengue virus
VKATGSASS

SEQ ID NO: 258841 - protein, 9 aa, Dengue virus
LIGLSSRAT

SEQ ID NO: 258842 - protein, 9 aa, Dengue virus
LLLMRTSWA

SEQ ID NO: 258843 - protein, 9 aa, Dengue virus
YISTRVEMG

SEQ ID NO: 258844 - protein, 9 aa, Dengue virus
DVPMAGPLV

SEQ ID NO: 258845 - protein, 9 aa, Dengue virus
SKVDIGVPL

SEQ ID NO: 258846 - protein, 9 aa, Dengue virus
LHKLGKCGS

SEQ ID NO: 258847 - protein, 9 aa, Dengue virus
WVSGVSGNI

SEQ ID NO: 258848 - protein, 9 aa, Dengue virus
ENTTANISL

SEQ ID NO: 258849 - protein, 9 aa, Dengue virus
YLEFEALGF

SEQ ID NO: 258850 - protein, 9 aa, Dengue virus
FQADSPSKL

SEQ ID NO: 258851 - protein, 9 aa, Dengue virus
FTNMEVQLI

SEQ ID NO: 258852 - protein, 9 aa, Dengue virus
LLAMGCYSQ

SEQ ID NO: 258853 - protein, 9 aa, Dengue virus
ENTTANISL

SEQ ID NO: 258854 - protein, 9 aa, Dengue virus
NEAVMAVGV

SEQ ID NO: 258855 - protein, 9 aa, Dengue virus
YYCAGLKKV

SEQ ID NO: 258856 - protein, 9 aa, Dengue virus
LRMVLAFIT

SEQ ID NO: 258857 - protein, 9 aa, Dengue virus
TTAIKAEHT

SEQ ID NO: 258858 - protein, 9 aa, Dengue virus
VLTLATGPI

SEQ ID NO: 258859 - protein, 9 aa, Dengue virus
RMAILGETA

SEQ ID NO: 258860 - protein, 9 aa, Dengue virus
CLRKNGKKV

SEQ ID NO: 258861 - protein, 9 aa, Dengue virus
VTYSLNTFT

SEQ ID NO: 258862 - protein, 9 aa, Dengue virus
LMGLDKGWP

SEQ ID NO: 258863 - protein, 9 aa, Dengue virus
WMTTEDMLS

SEQ ID NO: 258864 - protein, 9 aa, Dengue virus
ARGYISTRV

SEQ ID NO: 258865 - protein, 9 aa, Dengue virus
LTLATGPVL

SEQ ID NO: 258866 - protein, 9 aa, Dengue virus
LVRLQSGVD

SEQ ID NO: 258867 - protein, 9 aa, Dengue virus
LRTLILAPT

SEQ ID NO: 258868 - protein, 9 aa, Dengue virus
FCSHHFHQL

SEQ ID NO: 258869 - protein, 9 aa, Dengue virus
AEALKGMPI

SEQ ID NO: 258870 - protein, 9 aa, Dengue virus
LGSQEGAMR

SEQ ID NO: 258871 - protein, 9 aa, Dengue virus
VTKSGTYVS

SEQ ID NO: 258872 - protein, 9 aa, Dengue virus
TVASAAQRR

SEQ ID NO: 258873 - protein, 9 aa, Dengue virus
GYSQIGAGV

SEQ ID NO: 258874 - protein, 9 aa, Dengue virus
LDKGWPISK

SEQ ID NO: 258875 - protein, 9 aa, Dengue virus
FCSHHFHQL

SEQ ID NO: 258876 - protein, 9 aa, Dengue virus
FVELMKRGD

SEQ ID NO: 258877 - protein, 9 aa, Dengue virus
TYSLNTFTN

SEQ ID NO: 258878 - protein, 9 aa, Dengue virus
MLLDNIYTP

SEQ ID NO: 258879 - protein, 9 aa, Dengue virus
IKQRGILGR

SEQ ID NO: 258880 - protein, 9 aa, Dengue virus
YIYMGQPLN

SEQ ID NO: 258881 - protein, 9 aa, Dengue virus
VRTNAAIGA

SEQ ID NO: 258882 - protein, 9 aa, Dengue virus
LKRVRNRVS

SEQ ID NO: 258883 - protein, 9 aa, Dengue virus
LVPHVGMGL

SEQ ID NO: 258884 - protein, 9 aa, Dengue virus
HTIENTTAN

SEQ ID NO: 258885 - protein, 9 aa, Dengue virus
NGVLESQML

SEQ ID NO: 258886 - protein, 9 aa, Dengue virus
MVTQLAMTD

SEQ ID NO: 258887 - protein, 9 aa, Dengue virus
RKKLRPRWL

SEQ ID NO: 258888 - protein, 9 aa, Dengue virus
CHATFTMRL

SEQ ID NO: 258889 - protein, 9 aa, Dengue virus
FIAFLRFLA

SEQ ID NO: 258890 - protein, 9 aa, Dengue virus
IFVIDNVHT

SEQ ID NO: 258891 - protein, 9 aa, Dengue virus
AVSMANIFR

SEQ ID NO: 258892 - protein, 9 aa, Dengue virus
IWYMWLGAR

SEQ ID NO: 258893 - protein, 9 aa, Dengue virus
VTYGLNTFT

SEQ ID NO: 258894 - protein, 9 aa, Dengue virus
RSVALAPHV

SEQ ID NO: 258895 - protein, 9 aa, Dengue virus
TTTASGKLI

SEQ ID NO: 258896 - protein, 9 aa, Dengue virus
IHMENVFHT

SEQ ID NO: 258897 - protein, 9 aa, Dengue virus
WEGNPGRFW

SEQ ID NO: 258898 - protein, 9 aa, Dengue virus
VQAIDGEFR

SEQ ID NO: 258899 - protein, 9 aa, Dengue virus
LLLMRTSWA

SEQ ID NO: 258900 - protein, 9 aa, Dengue virus
MCTLMAMDL

SEQ ID NO: 258901 - protein, 9 aa, Dengue virus
VWLAHKVAS

SEQ ID NO: 258902 - protein, 9 aa, Dengue virus
CLRKSGKKV

SEQ ID NO: 258903 - protein, 9 aa, Dengue virus
CVGIGSRDF

SEQ ID NO: 258904 - protein, 9 aa, Dengue virus
GRTLRVLNL

SEQ ID NO: 258905 - protein, 9 aa, Dengue virus
LAPHVGMGL

SEQ ID NO: 258906 - protein, 9 aa, Dengue virus
FKEFAAGRR

SEQ ID NO: 258907 - protein, 9 aa, Dengue virus
FITNEVHTW

SEQ ID NO: 258908 - protein, 9 aa, Dengue virus
FNMLKRARN

SEQ ID NO: 258909 - protein, 9 aa, Dengue virus
KLLTKPWDV

SEQ ID NO: 258910 - protein, 9 aa, Dengue virus
WDYVVTTDI

SEQ ID NO: 258911 - protein, 9 aa, Dengue virus
VAIDLDPIS

SEQ ID NO: 258912 - protein, 9 aa, Dengue virus
WAYHGSYEV

SEQ ID NO: 258913 - protein, 9 aa, Dengue virus
WCNLTSTWV

SEQ ID NO: 258914 - protein, 9 aa, Dengue virus
FGKGGVVTC

SEQ ID NO: 258915 - protein, 9 aa, Dengue virus
PARVASAIL

SEQ ID NO: 258916 - protein, 9 aa, Dengue virus
FGRAKGSRA

SEQ ID NO: 258917 - protein, 9 aa, Dengue virus
LGSQEGAMH

SEQ ID NO: 258918 - protein, 9 aa, Dengue virus
YRILQRGLL

SEQ ID NO: 258919 - protein, 9 aa, Dengue virus
YISTRVGMG

SEQ ID NO: 258920 - protein, 9 aa, Dengue virus
VYSDPLALK

SEQ ID NO: 258921 - protein, 9 aa, Dengue virus
NISLTAIAN

SEQ ID NO: 258922 - protein, 9 aa, Dengue virus
PRWLDARVY

SEQ ID NO: 258923 - protein, 9 aa, Dengue virus
GRSQVGVGI

SEQ ID NO: 258924 - protein, 9 aa, Dengue virus
MYADDTAGW

SEQ ID NO: 258925 - protein, 9 aa, Dengue virus
LKGMPIRYQ

SEQ ID NO: 258926 - protein, 9 aa, Dengue virus
LLSGRGPLK

SEQ ID NO: 258927 - protein, 9 aa, Dengue virus
FQADSPKRL

SEQ ID NO: 258928 - protein, 9 aa, Dengue virus
CLRKNGKKV

SEQ ID NO: 258929 - protein, 9 aa, Dengue virus
PMKLVMAFI

SEQ ID NO: 258930 - protein, 9 aa, Dengue virus
FKLTYQNKV

SEQ ID NO: 258931 - protein, 9 aa, Dengue virus
LLKNDVPLA

SEQ ID NO: 258932 - protein, 9 aa, Dengue virus
SALAGATEI

SEQ ID NO: 258933 - protein, 9 aa, Dengue virus
VASEMAEAL

SEQ ID NO: 258934 - protein, 9 aa, Dengue virus
VKLMSGKDV

SEQ ID NO: 258935 - protein, 9 aa, Dengue virus
FGKGGIVTC

SEQ ID NO: 258936 - protein, 9 aa, Dengue virus
DLRLASNAI

SEQ ID NO: 258937 - protein, 9 aa, Dengue virus
MHTALTGAT

SEQ ID NO: 258938 - protein, 9 aa, Dengue virus
CYSQVNPTT

SEQ ID NO: 258939 - protein, 9 aa, Dengue virus
LTLATGPVS

SEQ ID NO: 258940 - protein, 9 aa, Dengue virus
GTAKLRWIV

SEQ ID NO: 258941 - protein, 9 aa, Dengue virus
LKCGSGIFV

SEQ ID NO: 258942 - protein, 9 aa, Dengue virus
CGIRSTTRL

SEQ ID NO: 258943 - protein, 9 aa, Dengue virus
SMVNGVVRL

SEQ ID NO: 258944 - protein, 9 aa, Dengue virus
LRTTTASGK

SEQ ID NO: 258945 - protein, 9 aa, Dengue virus
VWLAHKVAS

SEQ ID NO: 258946 - protein, 9 aa, Dengue virus
QWFLDLPLP

SEQ ID NO: 258947 - protein, 9 aa, Dengue virus
FCSHHFHEL

SEQ ID NO: 258948 - protein, 9 aa, Dengue virus
TRKYLPAIV

SEQ ID NO: 258949 - protein, 9 aa, Dengue virus
FHRRDLRLA

SEQ ID NO: 258950 - protein, 9 aa, Dengue virus
AVSRGTAKL

SEQ ID NO: 258951 - protein, 9 aa, Dengue virus
TFKVPHAKK

SEQ ID NO: 258952 - protein, 9 aa, Dengue virus
VKLHSGVDV

SEQ ID NO: 258953 - protein, 9 aa, Dengue virus
FCSHHFHQL

SEQ ID NO: 258954 - protein, 9 aa, Dengue virus
FVELMKRGD

SEQ ID NO: 258955 - protein, 9 aa, Dengue virus
AVSRGTAKL

SEQ ID NO: 258956 - protein, 9 aa, Dengue virus
WQLMYFHRR

SEQ ID NO: 258957 - protein, 9 aa, Dengue virus
YTPEGIIPT

SEQ ID NO: 258958 - protein, 9 aa, Dengue virus
PMVAGGLLL

SEQ ID NO: 258959 - protein, 9 aa, Dengue virus
LVSLLGSSL

SEQ ID NO: 258960 - protein, 9 aa, Dengue virus
PRWLDARIY

SEQ ID NO: 258961 - protein, 9 aa, Dengue virus
IEAGRTLRV

SEQ ID NO: 258962 - protein, 9 aa, Dengue virus
FITPMLRHS

SEQ ID NO: 258963 - protein, 9 aa, Dengue virus
CYSQVNPIT

SEQ ID NO: 258964 - protein, 9 aa, Dengue virus
CYVITGRSA

SEQ ID NO: 258965 - protein, 9 aa, Dengue virus
LLRNDVPLA

SEQ ID NO: 258966 - protein, 9 aa, Dengue virus
SRTTWSIHA

SEQ ID NO: 258967 - protein, 9 aa, Dengue virus
MVSRLLLNR

SEQ ID NO: 258968 - protein, 9 aa, Dengue virus
FKTAHAKKQ

SEQ ID NO: 258969 - protein, 9 aa, Dengue virus
IVSAVNMTS

SEQ ID NO: 258970 - protein, 9 aa, Dengue virus
FGIFTTNIW

SEQ ID NO: 258971 - protein, 9 aa, Dengue virus
DLRLAANAI

SEQ ID NO: 258972 - protein, 9 aa, Dengue virus
FITFLRVLS

SEQ ID NO: 258973 - protein, 9 aa, Dengue virus
LRTTTASGK

SEQ ID NO: 258974 - protein, 9 aa, Dengue virus
WDFVVTTDI

SEQ ID NO: 258975 - protein, 9 aa, Dengue virus
PMSTYGWNL

SEQ ID NO: 258976 - protein, 9 aa, Dengue virus
VRSNAALGA

SEQ ID NO: 258977 - protein, 9 aa, Dengue virus
AYVMTGRSA

SEQ ID NO: 258978 - protein, 9 aa, Dengue virus
FTNMEAQLI

SEQ ID NO: 258979 - protein, 9 aa, Dengue virus
LKCGNGIFV

SEQ ID NO: 258980 - protein, 9 aa, Dengue virus
WYGMEIRPV

SEQ ID NO: 258981 - protein, 9 aa, Dengue virus
AGIMKNPTV

SEQ ID NO: 258982 - protein, 9 aa, Dengue virus
FQADSPKRL

SEQ ID NO: 258983 - protein, 9 aa, Dengue virus
FTMRLLSPV

SEQ ID NO: 258984 - protein, 9 aa, Dengue virus
YRILQRGLL

SEQ ID NO: 258985 - protein, 9 aa, Dengue virus
LRKNGKRVI

SEQ ID NO: 258986 - protein, 9 aa, Dengue virus
KLLTKPWDV

SEQ ID NO: 258987 - protein, 9 aa, Dengue virus
WSIHATHEW

SEQ ID NO: 258988 - protein, 9 aa, Dengue virus
TIETLMLLT

SEQ ID NO: 258989 - protein, 9 aa, Dengue virus
ACLGKAYAQ

SEQ ID NO: 258990 - protein, 9 aa, Dengue virus
LKCGSGIFV

SEQ ID NO: 258991 - protein, 9 aa, Dengue virus
FITPMMRHT

SEQ ID NO: 258992 - protein, 9 aa, Dengue virus
VIPMVTQMA

SEQ ID NO: 258993 - protein, 9 aa, Dengue virus
TLYAVATTI

SEQ ID NO: 258994 - protein, 9 aa, Dengue virus
LRHSIENSS

SEQ ID NO: 258995 - protein, 9 aa, Dengue virus
MVSILASAL

SEQ ID NO: 258996 - protein, 9 aa, Dengue virus
LRTTTASGK

SEQ ID NO: 258997 - protein, 9 aa, Dengue virus
TLMLLTLLA

SEQ ID NO: 258998 - protein, 9 aa, Dengue virus
QWFLDLPLP

SEQ ID NO: 258999 - protein, 9 aa, Dengue virus
PLVAGGLLI

SEQ ID NO: 259000 - protein, 9 aa, Dengue virus
FQPESPARL

SEQ ID NO: 259001 - protein, 9 aa, Dengue virus
FCSHHFHEL

SEQ ID NO: 259002 - protein, 9 aa, Dengue virus
ISLTAIANQ

SEQ ID NO: 259003 - protein, 9 aa, Dengue virus
FTNMEAQLI

SEQ ID NO: 259004 - protein, 9 aa, Dengue virus
WLDARVYSD

SEQ ID NO: 259005 - protein, 9 aa, Dengue virus
DMLSVWNRV

SEQ ID NO: 259006 - protein, 9 aa, Dengue virus
YWIESRLND

SEQ ID NO: 259007 - protein, 9 aa, Dengue virus
INGVVRLLT

SEQ ID NO: 259008 - protein, 9 aa, Dengue virus
SVALTPHSG

SEQ ID NO: 259009 - protein, 9 aa, Dengue virus
FQADSPKRL

SEQ ID NO: 259010 - protein, 9 aa, Dengue virus
ISLAAIANQ

SEQ ID NO: 259011 - protein, 9 aa, Dengue virus
YRLKGEARK

SEQ ID NO: 259012 - protein, 9 aa, Dengue virus
LTIMDLHPG

SEQ ID NO: 259013 - protein, 9 aa, Dengue virus
SKMLLNRFT

SEQ ID NO: 259014 - protein, 9 aa, Dengue virus
MAQGKPTLD

SEQ ID NO: 259015 - protein, 9 aa, Dengue virus
WAFCEALTL

SEQ ID NO: 259016 - protein, 9 aa, Dengue virus
YWIESALND

SEQ ID NO: 259017 - protein, 9 aa, Dengue virus
VLLMRTTWA

SEQ ID NO: 259018 - protein, 9 aa, Dengue virus
EEALRGLPI

SEQ ID NO: 259019 - protein, 9 aa, Dengue virus
AVSRGSAKL

SEQ ID NO: 259020 - protein, 9 aa, Dengue virus
LRPASAWTL

SEQ ID NO: 259021 - protein, 9 aa, Dengue virus
WVSCGTGNI

SEQ ID NO: 259022 - protein, 9 aa, Dengue virus
HRVDLGVPL

SEQ ID NO: 259023 - protein, 9 aa, Dengue virus
FTRKVRSNA

SEQ ID NO: 259024 - protein, 9 aa, Dengue virus
FTDPSSIAA

SEQ ID NO: 259025 - protein, 9 aa, Dengue virus
CGVRSTTRL

SEQ ID NO: 259026 - protein, 9 aa, Dengue virus
WKLARASFI

SEQ ID NO: 259027 - protein, 9 aa, Dengue virus
LGRGWPLHR

SEQ ID NO: 259028 - protein, 9 aa, Dengue virus
YAIIGPGLQ

SEQ ID NO: 259029 - protein, 9 aa, Dengue virus
IIMDEAHFT

SEQ ID NO: 259030 - protein, 9 aa, Dengue virus
SRTTWSIHA

SEQ ID NO: 259031 - protein, 9 aa, Dengue virus
FQADSPKRL

SEQ ID NO: 259032 - protein, 9 aa, Dengue virus
ILLSSLLRN

SEQ ID NO: 259033 - protein, 9 aa, Dengue virus
FCSHHFHKI

SEQ ID NO: 259034 - protein, 9 aa, Dengue virus
ENSSVNVSL

SEQ ID NO: 259035 - protein, 9 aa, Dengue virus
FVVDNVHTR

SEQ ID NO: 259036 - protein, 9 aa, Dengue virus
CYSQVNPLT

SEQ ID NO: 259037 - protein, 9 aa, Dengue virus
TFVELMKRG

SEQ ID NO: 259038 - protein, 9 aa, Dengue virus
IHATHQWMT

SEQ ID NO: 259039 - protein, 9 aa, Dengue virus
WASVKKDLI

SEQ ID NO: 259040 - protein, 9 aa, Dengue virus
LRWFVERNL

SEQ ID NO: 259041 - protein, 9 aa, Dengue virus
KVIQLSRKT

SEQ ID NO: 259042 - protein, 9 aa, Dengue virus
IVASVNTTS

SEQ ID NO: 259043 - protein, 9 aa, Dengue virus
IFMKDGREI

SEQ ID NO: 259044 - protein, 9 aa, Dengue virus
MAQGKPTLD

SEQ ID NO: 259045 - protein, 9 aa, Dengue virus
CYVITGTSA

SEQ ID NO: 259046 - protein, 9 aa, Dengue virus
IFVTDNVHT

SEQ ID NO: 259047 - protein, 9 aa, Dengue virus
YGNGVVTKS

SEQ ID NO: 259048 - protein, 9 aa, Dengue virus
VKRFSTGLL

SEQ ID NO: 259049 - protein, 9 aa, Dengue virus
MYWISNGTG

SEQ ID NO: 259050 - protein, 9 aa, Dengue virus
AEALKGLPI

SEQ ID NO: 259051 - protein, 9 aa, Dengue virus
VIPMVTQMA

SEQ ID NO: 259052 - protein, 9 aa, Dengue virus
ALRGLPIRY

SEQ ID NO: 259053 - protein, 9 aa, Dengue virus
YRILQRGLL

SEQ ID NO: 259054 - protein, 9 aa, Dengue virus
PRWLDARIY

SEQ ID NO: 259055 - protein, 9 aa, Dengue virus
IKQKGIFGK

SEQ ID NO: 259056 - protein, 9 aa, Dengue virus
LRWIVERGM

SEQ ID NO: 259057 - protein, 9 aa, Dengue virus
ILLMRTSWA

SEQ ID NO: 259058 - protein, 9 aa, Dengue virus
IANCLRKSG

SEQ ID NO: 259059 - protein, 9 aa, Dengue virus
DTIETLMLL

SEQ ID NO: 259060 - protein, 9 aa, Dengue virus
FVELMKRGD

SEQ ID NO: 259061 - protein, 9 aa, Dengue virus
PLLAIGCYS

SEQ ID NO: 259062 - protein, 9 aa, Dengue virus
IHMENVFHT

SEQ ID NO: 259063 - protein, 9 aa, Dengue virus
FQPESPARV

SEQ ID NO: 259064 - protein, 9 aa, Dengue virus
FHRRDLRLA

SEQ ID NO: 259065 - protein, 9 aa, Dengue virus
MATLKNVRE

SEQ ID NO: 259066 - protein, 9 aa, Dengue virus
YCAGLKKVT

SEQ ID NO: 259067 - protein, 9 aa, Dengue virus
GGLLLAAYV

SEQ ID NO: 259068 - protein, 9 aa, Dengue virus
AEALKGMPI

SEQ ID NO: 259069 - protein, 9 aa, Dengue virus
VVVLGSQEG

SEQ ID NO: 259070 - protein, 9 aa, Dengue virus
FKLTYQNKV

SEQ ID NO: 259071 - protein, 9 aa, Dengue virus
FVPSIKTGN

SEQ ID NO: 259072 - protein, 9 aa, Dengue virus
FQPESPSRL

SEQ ID NO: 259073 - protein, 9 aa, Dengue virus
WTLMYFHRR

SEQ ID NO: 259074 - protein, 9 aa, Dengue virus
FHELIMKDG

SEQ ID NO: 259075 - protein, 9 aa, Dengue virus
LVLEHGGCV

SEQ ID NO: 259076 - protein, 9 aa, Dengue virus
FCSHHFHEL

SEQ ID NO: 259077 - protein, 9 aa, Dengue virus
YWIESALND

SEQ ID NO: 259078 - protein, 9 aa, Dengue virus
FKAERVIDP

SEQ ID NO: 259079 - protein, 9 aa, Dengue virus
YTALFGGVS

SEQ ID NO: 259080 - protein, 9 aa, Dengue virus
VVLMGLGRG

SEQ ID NO: 259081 - protein, 9 aa, Dengue virus
YNMVIMDEA

SEQ ID NO: 259082 - protein, 9 aa, Dengue virus
LLKATLLAV

SEQ ID NO: 259083 - protein, 9 aa, Dengue virus
SMVNGVVRL

SEQ ID NO: 259084 - protein, 9 aa, Dengue virus
FLEFEALGF

SEQ ID NO: 259085 - protein, 9 aa, Dengue virus
LTIMDLHPG

SEQ ID NO: 259086 - protein, 9 aa, Dengue virus
DMLKVWNRV

SEQ ID NO: 259087 - protein, 9 aa, Dengue virus
LIGLTSRAT

SEQ ID NO: 259088 - protein, 9 aa, Dengue virus
YRLKGESRK

SEQ ID NO: 259089 - protein, 9 aa, Dengue virus
ENSTANVSL

SEQ ID NO: 259090 - protein, 9 aa, Dengue virus
LYGNGVVTT

SEQ ID NO: 259091 - protein, 9 aa, Dengue virus
ISRMLINRF

SEQ ID NO: 259092 - protein, 9 aa, Dengue virus
SVALTPHSG

SEQ ID NO: 259093 - protein, 9 aa, Dengue virus
FLAIPPTAG

SEQ ID NO: 259094 - protein, 9 aa, Dengue virus
VWLAHKVAA

SEQ ID NO: 259095 - protein, 9 aa, Dengue virus
RSVALAPHV

SEQ ID NO: 259096 - protein, 9 aa, Dengue virus
AVNMTSKML

SEQ ID NO: 259097 - protein, 9 aa, Dengue virus
RYQTTAVKS

SEQ ID NO: 259098 - protein, 9 aa, Dengue virus
THTLWSNGV

SEQ ID NO: 259099 - protein, 9 aa, Dengue virus
WDYVVTTDI

SEQ ID NO: 259100 - protein, 9 aa, Dengue virus
PMSTYGWNL

SEQ ID NO: 259101 - protein, 9 aa, Dengue virus
LKCGSGIFI

SEQ ID NO: 259102 - protein, 9 aa, Dengue virus
LLAMGCYSQ

SEQ ID NO: 259103 - protein, 9 aa, Dengue virus
HRMDLGVPL

SEQ ID NO: 259104 - protein, 9 aa, Dengue virus
IVREALKRR

SEQ ID NO: 259105 - protein, 9 aa, Dengue virus
IAMDLGELC

SEQ ID NO: 259106 - protein, 9 aa, Dengue virus
MLKVWNRVW

SEQ ID NO: 259107 - protein, 9 aa, Dengue virus
FCEVLTLAT

SEQ ID NO: 259108 - protein, 9 aa, Dengue virus
LVPHVGMGL

SEQ ID NO: 259109 - protein, 9 aa, Dengue virus
TYVSAIAQA

SEQ ID NO: 259110 - protein, 9 aa, Dengue virus
FVELMRRGD

SEQ ID NO: 259111 - protein, 9 aa, Dengue virus
LVVMDEAHF

SEQ ID NO: 259112 - protein, 9 aa, Dengue virus
FHTMWHVTR

SEQ ID NO: 259113 - protein, 9 aa, Dengue virus
IEEGRTLRV

SEQ ID NO: 259114 - protein, 9 aa, Dengue virus
RMAILGDTA

SEQ ID NO: 259115 - protein, 9 aa, Dengue virus
FSLGLLSGR

SEQ ID NO: 259116 - protein, 9 aa, Dengue virus
FSTGLLNGK

SEQ ID NO: 259117 - protein, 9 aa, Dengue virus
FVADNVHTR

SEQ ID NO: 259118 - protein, 9 aa, Dengue virus
SIENSSVNV

SEQ ID NO: 259119 - protein, 9 aa, Dengue virus
VVGLYGNGV

SEQ ID NO: 259120 - protein, 9 aa, Dengue virus
KRRLRTLIL

SEQ ID NO: 259121 - protein, 9 aa, Dengue virus
WASVKKDLI

SEQ ID NO: 259122 - protein, 9 aa, Dengue virus
IAACLRKNG

SEQ ID NO: 259123 - protein, 9 aa, Dengue virus
YLPAIIREA

SEQ ID NO: 259124 - protein, 9 aa, Dengue virus
VITGTSADL

SEQ ID NO: 259125 - protein, 9 aa, Dengue virus
WCNATSAWV

SEQ ID NO: 259126 - protein, 9 aa, Dengue virus
YNLIVMDEA

SEQ ID NO: 259127 - protein, 9 aa, Dengue virus
FCSHHFHEL

SEQ ID NO: 259128 - protein, 9 aa, Dengue virus
IKDQRAVHA

SEQ ID NO: 259129 - protein, 9 aa, Dengue virus
LHPASAWTL

SEQ ID NO: 259130 - protein, 9 aa, Dengue virus
RVYADPMAL

SEQ ID NO: 259131 - protein, 9 aa, Dengue virus
CLRKSGKKV

SEQ ID NO: 259132 - protein, 9 aa, Dengue virus
WMTTEDMLA

SEQ ID NO: 259133 - protein, 9 aa, Dengue virus
ILGDTAWDF

SEQ ID NO: 259134 - protein, 9 aa, Dengue virus
FVDLMKRGD

SEQ ID NO: 259135 - protein, 9 aa, Dengue virus
MGLGKGWPL

SEQ ID NO: 259136 - protein, 9 aa, Dengue virus
LMAMDLGEM

SEQ ID NO: 259137 - protein, 9 aa, Dengue virus
YCAGLKKVT

SEQ ID NO: 259138 - protein, 9 aa, Dengue virus
AGIMKNPTV

SEQ ID NO: 259139 - protein, 9 aa, Dengue virus
FVEGVSGGA

SEQ ID NO: 259140 - protein, 9 aa, Dengue virus
AVSRGSAKL

SEQ ID NO: 259141 - protein, 9 aa, Dengue virus
ARGYISTRV

SEQ ID NO: 259142 - protein, 9 aa, Dengue virus
HRMDIGVPL

SEQ ID NO: 259143 - protein, 9 aa, Dengue virus
GMLVRNPLS

SEQ ID NO: 259144 - protein, 9 aa, Dengue virus
FRGSYLAGA

SEQ ID NO: 259145 - protein, 9 aa, Dengue virus
AVNMTSKML

SEQ ID NO: 259146 - protein, 9 aa, Dengue virus
IKAGNDIAA

SEQ ID NO: 259147 - protein, 9 aa, Dengue virus
CVYNMMGKR

SEQ ID NO: 259148 - protein, 9 aa, Dengue virus
MGLGKGWPI

SEQ ID NO: 259149 - protein, 9 aa, Dengue virus
ARGYISTRV

SEQ ID NO: 259150 - protein, 9 aa, Dengue virus
RSGTYVSSI

SEQ ID NO: 259151 - protein, 9 aa, Dengue virus
LRPKWLDAR

SEQ ID NO: 259152 - protein, 9 aa, Dengue virus
LKCGSGIFV

SEQ ID NO: 259153 - protein, 9 aa, Dengue virus
FVEGLSGAT

SEQ ID NO: 259154 - protein, 9 aa, Dengue virus
LGSQEGAMR

SEQ ID NO: 259155 - protein, 9 aa, Dengue virus
IKRKLRTLV

SEQ ID NO: 259156 - protein, 9 aa, Dengue virus
VILAGPMPV

SEQ ID NO: 259157 - protein, 9 aa, Dengue virus
WCNATSAWV

SEQ ID NO: 259158 - protein, 9 aa, Dengue virus
ISEMGANFR

SEQ ID NO: 259159 - protein, 9 aa, Dengue virus
FCSHHFHKI

SEQ ID NO: 259160 - protein, 9 aa, Dengue virus
IVMDEAHFT

SEQ ID NO: 259161 - protein, 9 aa, Dengue virus
LQGQGPMKM

SEQ ID NO: 259162 - protein, 9 aa, Dengue virus
AVNMTSKML

SEQ ID NO: 259163 - protein, 9 aa, Dengue virus
YVSAIAQTE

SEQ ID NO: 259164 - protein, 9 aa, Dengue virus
WALCESITL

SEQ ID NO: 259165 - protein, 9 aa, Dengue virus
DARVYSDPL

SEQ ID NO: 259166 - protein, 9 aa, Dengue virus
FVDLMRRGD

SEQ ID NO: 259167 - protein, 9 aa, Dengue virus
FQPESPSRL

SEQ ID NO: 259168 - protein, 9 aa, Dengue virus
YRIKQRGIL

SEQ ID NO: 259169 - protein, 9 aa, Dengue virus
LKRVRNRVS

SEQ ID NO: 259170 - protein, 9 aa, Dengue virus
ISLTAIANQ

SEQ ID NO: 259171 - protein, 9 aa, Dengue virus
GVVKLLTKP

SEQ ID NO: 259172 - protein, 9 aa, Dengue virus
TAGILKRWG

SEQ ID NO: 259173 - protein, 9 aa, Dengue virus
FLRFLAIPP

SEQ ID NO: 259174 - protein, 9 aa, Dengue virus
YRIMQRGLF

SEQ ID NO: 259175 - protein, 9 aa, Dengue virus
FHKIFMKDG

SEQ ID NO: 259176 - protein, 9 aa, Dengue virus
TWSIHAKHQ

SEQ ID NO: 259177 - protein, 9 aa, Dengue virus
IFITNNVHT

SEQ ID NO: 259178 - protein, 9 aa, Dengue virus
LILAPTRVV

SEQ ID NO: 259179 - protein, 9 aa, Dengue virus
WAYHGSYET

SEQ ID NO: 259180 - protein, 9 aa, Dengue virus
YNLVVMDEA

SEQ ID NO: 259181 - protein, 9 aa, Dengue virus
YRLKGESRK

SEQ ID NO: 259182 - protein, 9 aa, Dengue virus
ANIFRGSYL

SEQ ID NO: 259183 - protein, 9 aa, Dengue virus
WLVHKQWFL

SEQ ID NO: 259184 - protein, 9 aa, Dengue virus
VIQLSRKTF

SEQ ID NO: 259185 - protein, 9 aa, Dengue virus
HRMDLGVPL

SEQ ID NO: 259186 - protein, 9 aa, Dengue virus
MYWVSGATG

SEQ ID NO: 259187 - protein, 9 aa, Dengue virus
FGKAKGSRA

SEQ ID NO: 259188 - protein, 9 aa, Dengue virus
IAACLRKSG

SEQ ID NO: 259189 - protein, 9 aa, Dengue virus
NRVSTGSQL

SEQ ID NO: 259190 - protein, 9 aa, Dengue virus
VTHSSAAQR

SEQ ID NO: 259191 - protein, 9 aa, Dengue virus
LQWIVERGM

SEQ ID NO: 259192 - protein, 9 aa, Dengue virus
VREVKGLTK

SEQ ID NO: 259193 - protein, 9 aa, Dengue virus
RVYSDPLAL

SEQ ID NO: 259194 - protein, 9 aa, Dengue virus
WNIVKLHSG

SEQ ID NO: 259195 - protein, 9 aa, Dengue virus
FCSHHFHEL

SEQ ID NO: 259196 - protein, 9 aa, Dengue virus
IEESRTIRV

SEQ ID NO: 259197 - protein, 9 aa, Dengue virus
FTSKVRSNA

SEQ ID NO: 259198 - protein, 9 aa, Dengue virus
MYWISNGTG

SEQ ID NO: 259199 - protein, 9 aa, Dengue virus
SRTTWSIHA

SEQ ID NO: 259200 - protein, 9 aa, Dengue virus
LLNGKGPLR

SEQ ID NO: 259201 - protein, 9 aa, Dengue virus
FQPESPSRL

SEQ ID NO: 259202 - protein, 9 aa, Dengue virus
FGIFTTNIW

SEQ ID NO: 259203 - protein, 9 aa, Dengue virus
FCEVLTLAT

SEQ ID NO: 259204 - protein, 9 aa, Dengue virus
ALKGMPIRY

SEQ ID NO: 259205 - protein, 9 aa, Dengue virus
YQFQPESPA

SEQ ID NO: 259206 - protein, 9 aa, Dengue virus
VWFVPSIKA

SEQ ID NO: 259207 - protein, 9 aa, Dengue virus
VVLMGLGRG

SEQ ID NO: 259208 - protein, 9 aa, Dengue virus
FTNMEVQLI

SEQ ID NO: 259209 - protein, 9 aa, Dengue virus
FVPSIKSGN

SEQ ID NO: 259210 - protein, 9 aa, Dengue virus
LFSGVSWMI

SEQ ID NO: 259211 - protein, 9 aa, Dengue virus
LMYFHRRDL

SEQ ID NO: 259212 - protein, 9 aa, Dengue virus
DVPLAGPLI

SEQ ID NO: 259213 - protein, 9 aa, Dengue virus
LTAIANQAA

SEQ ID NO: 259214 - protein, 9 aa, Dengue virus
MATYGWNLV

SEQ ID NO: 259215 - protein, 9 aa, Dengue virus
IALDFSPGT

SEQ ID NO: 259216 - protein, 9 aa, Dengue virus
WKIEKASFI

SEQ ID NO: 259217 - protein, 9 aa, Dengue virus
IVREALKRR

SEQ ID NO: 259218 - protein, 9 aa, Dengue virus
VILAGPMPV

SEQ ID NO: 259219 - protein, 9 aa, Dengue virus
FQPESPKRL

SEQ ID NO: 259220 - protein, 9 aa, Dengue virus
KLMSAAIKD

SEQ ID NO: 259221 - protein, 9 aa, Dengue virus
LVMKDGRKL

SEQ ID NO: 259222 - protein, 9 aa, Dengue virus
VEMGEAAAI

SEQ ID NO: 259223 - protein, 9 aa, Dengue virus
FRGSYLAGA

SEQ ID NO: 259224 - protein, 9 aa, Dengue virus
MRTALTGAT

SEQ ID NO: 259225 - protein, 9 aa, Dengue virus
FGKGGVVTC

SEQ ID NO: 259226 - protein, 9 aa, Dengue virus
VYSDPLALK

SEQ ID NO: 259227 - protein, 9 aa, Dengue virus
VWIRDNPNM

SEQ ID NO: 259228 - protein, 9 aa, Dengue virus
MGEAAAIFM

SEQ ID NO: 259229 - protein, 9 aa, Dengue virus
IVLEHGGCV

SEQ ID NO: 259230 - protein, 9 aa, Dengue virus
LAMTDTTPF

SEQ ID NO: 259231 - protein, 9 aa, Dengue virus
YAQMWSLMY

SEQ ID NO: 259232 - protein, 9 aa, Dengue virus
IGKMFEATA

SEQ ID NO: 259233 - protein, 9 aa, Dengue virus
ACLGKSYAQ

SEQ ID NO: 259234 - protein, 9 aa, Dengue virus
IYADDTAGW

SEQ ID NO: 259235 - protein, 9 aa, Dengue virus
IRYQTPAIR

SEQ ID NO: 259236 - protein, 9 aa, Dengue virus
IYSDPLALR

SEQ ID NO: 259237 - protein, 9 aa, Dengue virus
WYGMEIRPL

SEQ ID NO: 259238 - protein, 9 aa, Dengue virus
WKLEKASFI

SEQ ID NO: 259239 - protein, 9 aa, Dengue virus
FEKQLGQIM

SEQ ID NO: 259240 - protein, 9 aa, Dengue virus
FGMFTTNIW

SEQ ID NO: 259241 - protein, 9 aa, Dengue virus
FVEGVSGGS

SEQ ID NO: 259242 - protein, 9 aa, Dengue virus
THTLWSNGV

SEQ ID NO: 259243 - protein, 9 aa, Dengue virus
HRMDIGVPL

SEQ ID NO: 259244 - protein, 9 aa, Dengue virus
VGMGEAAAI

SEQ ID NO: 259245 - protein, 9 aa, Dengue virus
HWFSRGNSL

SEQ ID NO: 259246 - protein, 9 aa, Dengue virus
CGIRSTTRL

SEQ ID NO: 259247 - protein, 9 aa, Dengue virus
DVPLAGPLI

SEQ ID NO: 259248 - protein, 9 aa, Dengue virus
LIGRARISQ

SEQ ID NO: 259249 - protein, 9 aa, Dengue virus
LRGLPIRYQ

SEQ ID NO: 259250 - protein, 9 aa, Dengue virus
FRAERVIDP

SEQ ID NO: 259251 - protein, 9 aa, Dengue virus
SVALTPHSG

SEQ ID NO: 259252 - protein, 9 aa, Dengue virus
YWIESSKNQ

SEQ ID NO: 259253 - protein, 9 aa, Dengue virus
VLALEPGKN

SEQ ID NO: 259254 - protein, 9 aa, Dengue virus
WLDARVYAD

SEQ ID NO: 259255 - protein, 9 aa, Dengue virus
WSYYCGGLK

SEQ ID NO: 259256 - protein, 9 aa, Dengue virus
TKRYLPAIV

SEQ ID NO: 259257 - protein, 9 aa, Dengue virus
YRLRGEARK

SEQ ID NO: 259258 - protein, 9 aa, Dengue virus
YFHRRDLRL

SEQ ID NO: 259259 - protein, 9 aa, Dengue virus
LYAVATTIV

SEQ ID NO: 259260 - protein, 9 aa, Dengue virus
IKRGLRTLI

SEQ ID NO: 259261 - protein, 9 aa, Dengue virus
IALDFSPGT

SEQ ID NO: 259262 - protein, 9 aa, Dengue virus
FQADSPKRL

SEQ ID NO: 259263 - protein, 9 aa, Dengue virus
IFITNNVHT

SEQ ID NO: 259264 - protein, 9 aa, Dengue virus
AIANQAVVL

SEQ ID NO: 259265 - protein, 9 aa, Dengue virus
IAACLRKNG

SEQ ID NO: 259266 - protein, 9 aa, Dengue virus
IVMDEAHFT

SEQ ID NO: 259267 - protein, 9 aa, Dengue virus
GCYSQVNPI

SEQ ID NO: 259268 - protein, 9 aa, Dengue virus
IREAIKRKL

SEQ ID NO: 259269 - protein, 9 aa, Dengue virus
VVTTSGTYV

SEQ ID NO: 259270 - protein, 9 aa, Dengue virus
IEAGRTLRV

SEQ ID NO: 259271 - protein, 9 aa, Dengue virus
ISLTAIANQ

SEQ ID NO: 259272 - protein, 9 aa, Dengue virus
MVNGVVKLL

SEQ ID NO: 259273 - protein, 9 aa, Dengue virus
AVSRGSSKL

SEQ ID NO: 259274 - protein, 9 aa, Dengue virus
LIGLSSRAT

SEQ ID NO: 259275 - protein, 9 aa, Dengue virus
LRKNGKRVI

SEQ ID NO: 259276 - protein, 9 aa, Dengue virus
CYSQVNPIT

SEQ ID NO: 259277 - protein, 9 aa, Dengue virus
LQWIASAIV

SEQ ID NO: 259278 - protein, 9 aa, Dengue virus
YFHRRDLRL

SEQ ID NO: 259279 - protein, 9 aa, Dengue virus
FWNTTIAVS

SEQ ID NO: 259280 - protein, 9 aa, Dengue virus
WIASAIVLE

SEQ ID NO: 259281 - protein, 9 aa, Dengue virus
IENSTANVS

SEQ ID NO: 259282 - protein, 9 aa, Dengue virus
VMTGRSADL

SEQ ID NO: 259283 - protein, 9 aa, Dengue virus
KLLTKPWDV

SEQ ID NO: 259284 - protein, 9 aa, Dengue virus
PLKLFMAFV

SEQ ID NO: 259285 - protein, 9 aa, Dengue virus
VNVSLTAIA

SEQ ID NO: 259286 - protein, 9 aa, Dengue virus
LRMVLAFIT

SEQ ID NO: 259287 - protein, 9 aa, Dengue virus
WDYVVTTDI

SEQ ID NO: 259288 - protein, 9 aa, Dengue virus
VVLEHGSCV

SEQ ID NO: 259289 - protein, 9 aa, Dengue virus
CKKVRSNAA

SEQ ID NO: 259290 - protein, 9 aa, Dengue virus
INGVVKLLT

SEQ ID NO: 259291 - protein, 9 aa, Dengue virus
LTLATGPIL

SEQ ID NO: 259292 - protein, 9 aa, Dengue virus
LAFITFLRV

SEQ ID NO: 259293 - protein, 9 aa, Dengue virus
HRMDLGVPL

SEQ ID NO: 259294 - protein, 9 aa, Dengue virus
ISLTAIANQ

SEQ ID NO: 259295 - protein, 9 aa, Dengue virus
VSQGAGWSL

SEQ ID NO: 259296 - protein, 9 aa, Dengue virus
IKRGLRTLI

SEQ ID NO: 259297 - protein, 9 aa, Dengue virus
YISTRVEMG

SEQ ID NO: 259298 - protein, 9 aa, Dengue virus
LLSGRGPLK

SEQ ID NO: 259299 - protein, 9 aa, Dengue virus
FITPMMRHT

SEQ ID NO: 259300 - protein, 9 aa, Dengue virus
AIANQAAIL

SEQ ID NO: 259301 - protein, 9 aa, Dengue virus
GSYLAGAGL

SEQ ID NO: 259302 - protein, 9 aa, Dengue virus
YCGGLKNVK

SEQ ID NO: 259303 - protein, 9 aa, Dengue virus
MVSRMLLNR

SEQ ID NO: 259304 - protein, 9 aa, Dengue virus
LTAIANQAA

SEQ ID NO: 259305 - protein, 9 aa, Dengue virus
CVTTMAKNK

SEQ ID NO: 259306 - protein, 9 aa, Dengue virus
LTLWEGNPG

SEQ ID NO: 259307 - protein, 9 aa, Dengue virus
WMTTEDMLA

SEQ ID NO: 259308 - protein, 9 aa, Dengue virus
IVREAIKRK

SEQ ID NO: 259309 - protein, 9 aa, Dengue virus
DARIYSDPL

SEQ ID NO: 259310 - protein, 9 aa, Dengue virus
GCYSQVNPL

SEQ ID NO: 259311 - protein, 9 aa, Dengue virus
FTNMEAQLI

SEQ ID NO: 259312 - protein, 9 aa, Dengue virus
KRRLRTLIL

SEQ ID NO: 259313 - protein, 9 aa, Dengue virus
FLEFEALGF

SEQ ID NO: 259314 - protein, 9 aa, Dengue virus
LAAIANQAA

SEQ ID NO: 259315 - protein, 9 aa, Dengue virus
IANQAVVLM

SEQ ID NO: 259316 - protein, 9 aa, Dengue virus
YSQIGAGVY

SEQ ID NO: 259317 - protein, 9 aa, Dengue virus
FQPESPARL

SEQ ID NO: 259318 - protein, 9 aa, Dengue virus
GRTLRVLKM

SEQ ID NO: 259319 - protein, 9 aa, Dengue virus
YRIMQRGLF

SEQ ID NO: 259320 - protein, 9 aa, Dengue virus
ANIFRGSYL

SEQ ID NO: 259321 - protein, 9 aa, Dengue virus
IKRKLRTLI

SEQ ID NO: 259322 - protein, 9 aa, Dengue virus
FCSHHFHKI

SEQ ID NO: 259323 - protein, 9 aa, Dengue virus
SVALAPHVG

SEQ ID NO: 259324 - protein, 9 aa, Dengue virus
IANQAAILM

SEQ ID NO: 259325 - protein, 9 aa, Dengue virus
ISQGAGWSL

SEQ ID NO: 259326 - protein, 9 aa, Dengue virus
IRYQTPAVK

SEQ ID NO: 259327 - protein, 9 aa, Dengue virus
VKDQRAVHA

SEQ ID NO: 259328 - protein, 9 aa, Dengue virus
FSSELLSGR

SEQ ID NO: 259329 - protein, 9 aa, Dengue virus
IEESRTIRV

SEQ ID NO: 259330 - protein, 9 aa, Dengue virus
FIAFLRFLT

SEQ ID NO: 259331 - protein, 9 aa, Dengue virus
LGRGWPLHR

SEQ ID NO: 259332 - protein, 9 aa, Dengue virus
MAVGVVSIL

SEQ ID NO: 259333 - protein, 9 aa, Dengue virus
VTAASAAQR

SEQ ID NO: 259334 - protein, 9 aa, Dengue virus
RMAILGETA

SEQ ID NO: 259335 - protein, 9 aa, Dengue virus
LVTFKNPHA

SEQ ID NO: 259336 - protein, 9 aa, Dengue virus
GGLLIACYV

SEQ ID NO: 259337 - protein, 9 aa, Dengue virus
CHATFTTRL

SEQ ID NO: 259338 - protein, 9 aa, Dengue virus
WDYVVTTDI

SEQ ID NO: 259339 - protein, 9 aa, Dengue virus
CKKVRSNAA

SEQ ID NO: 259340 - protein, 9 aa, Dengue virus
VWFVPSIKA

SEQ ID NO: 259341 - protein, 9 aa, Dengue virus
KRGDLPVWL

SEQ ID NO: 259342 - protein, 9 aa, Dengue virus
AVSRGSAKL

SEQ ID NO: 259343 - protein, 9 aa, Dengue virus
DIPMTGPLV

SEQ ID NO: 259344 - protein, 9 aa, Dengue virus
AKRFSRGML

SEQ ID NO: 259345 - protein, 9 aa, Dengue virus
IVASVNTTS

SEQ ID NO: 259346 - protein, 9 aa, Dengue virus
YISTRVGMG

SEQ ID NO: 259347 - protein, 9 aa, Dengue virus
IRYQTPAVK

SEQ ID NO: 259348 - protein, 9 aa, Dengue virus
CVYNMMGKR

SEQ ID NO: 259349 - protein, 9 aa, Dengue virus
LILAPTRVV

SEQ ID NO: 259350 - protein, 9 aa, Dengue virus
WKIEKASFI

SEQ ID NO: 259351 - protein, 9 aa, Dengue virus
KCTLMAMDL

SEQ ID NO: 259352 - protein, 9 aa, Dengue virus
TRVVASEMA

SEQ ID NO: 259353 - protein, 9 aa, Dengue virus
IVSSVNMIS

SEQ ID NO: 259354 - protein, 9 aa, Dengue virus
YKFQPESPA

SEQ ID NO: 259355 - protein, 9 aa, Dengue virus
FVDLMKRGD

SEQ ID NO: 259356 - protein, 9 aa, Dengue virus
ARGYISTRV

SEQ ID NO: 259357 - protein, 9 aa, Dengue virus
LFSGVSWMI

SEQ ID NO: 259358 - protein, 9 aa, Dengue virus
FGKGSLITC

SEQ ID NO: 259359 - protein, 9 aa, Dengue virus
RVILAGPMP

SEQ ID NO: 259360 - protein, 9 aa, Dengue virus
ILTDGPERV

SEQ ID NO: 259361 - protein, 9 aa, Dengue virus
MGLGKGWPL

SEQ ID NO: 259362 - protein, 9 aa, Dengue virus
LTLATGPIT

SEQ ID NO: 259363 - protein, 9 aa, Dengue virus
AVSRGSAKL

SEQ ID NO: 259364 - protein, 9 aa, Dengue virus
CKKVRSNAA

SEQ ID NO: 259365 - protein, 9 aa, Dengue virus
CLRKSGKKV

SEQ ID NO: 259366 - protein, 9 aa, Dengue virus
WAYHGSYEV

SEQ ID NO: 259367 - protein, 9 aa, Dengue virus
YAIIGPGLQ

SEQ ID NO: 259368 - protein, 9 aa, Dengue virus
DVPLAGPMV

SEQ ID NO: 259369 - protein, 9 aa, Dengue virus
GHLKCRLKM

SEQ ID NO: 259370 - protein, 9 aa, Dengue virus
WFSRENSLS

SEQ ID NO: 259371 - protein, 9 aa, Dengue virus
VVGLYGNGV

SEQ ID NO: 259372 - protein, 9 aa, Dengue virus
NRVSTGSQL

SEQ ID NO: 259373 - protein, 9 aa, Dengue virus
AGRTLRVLS

SEQ ID NO: 259374 - protein, 9 aa, Dengue virus
LVKLMSGKD

SEQ ID NO: 259375 - protein, 9 aa, Dengue virus
LILAPTRVV

SEQ ID NO: 259376 - protein, 9 aa, Dengue virus
PSRLSAAIG

SEQ ID NO: 259377 - protein, 9 aa, Dengue virus
IFVVDNVHT

SEQ ID NO: 259378 - protein, 9 aa, Dengue virus
GRTLRVLNL

SEQ ID NO: 259379 - protein, 9 aa, Dengue virus
HRLMSAAIK

SEQ ID NO: 259380 - protein, 9 aa, Dengue virus
LMGLGRGWP

SEQ ID NO: 259381 - protein, 9 aa, Dengue virus
IFVTDNVHT

SEQ ID NO: 259382 - protein, 9 aa, Dengue virus
LLTLLATVT

SEQ ID NO: 259383 - protein, 9 aa, Dengue virus
IVSSVNTIS

SEQ ID NO: 259384 - protein, 9 aa, Dengue virus
LVHRQWFLN

SEQ ID NO: 259385 - protein, 9 aa, Dengue virus
FAGHLKCRL

SEQ ID NO: 259386 - protein, 9 aa, Dengue virus
GMGLETRAQ

SEQ ID NO: 259387 - protein, 9 aa, Dengue virus
SVALTPHSG

SEQ ID NO: 259388 - protein, 9 aa, Dengue virus
LRKSGKRVI

SEQ ID NO: 259389 - protein, 9 aa, Dengue virus
KLLTKPWDV

SEQ ID NO: 259390 - protein, 9 aa, Dengue virus
LVRCPLSRN

SEQ ID NO: 259391 - protein, 9 aa, Dengue virus
LAAIANQAV

SEQ ID NO: 259392 - protein, 9 aa, Dengue virus
LTIMDLHPG

SEQ ID NO: 259393 - protein, 9 aa, Dengue virus
ISYGGGWRF

SEQ ID NO: 259394 - protein, 9 aa, Dengue virus
CIKILNPYM

SEQ ID NO: 259395 - protein, 9 aa, Dengue virus
MWHVTRGAV

SEQ ID NO: 259396 - protein, 9 aa, Dengue virus
TACLGKAYA

SEQ ID NO: 259397 - protein, 9 aa, Dengue virus
WSIHASHEW

SEQ ID NO: 259398 - protein, 9 aa, Dengue virus
WVSNASGNI

SEQ ID NO: 259399 - protein, 9 aa, Dengue virus
WMTTEDMLT

SEQ ID NO: 259400 - protein, 9 aa, Dengue virus
RLLTKPWDV

SEQ ID NO: 259401 - protein, 9 aa, Dengue virus
PLVAGGLLI

SEQ ID NO: 259402 - protein, 9 aa, Dengue virus
VLTLATGPV

SEQ ID NO: 259403 - protein, 9 aa, Dengue virus
LTAIANQAA

SEQ ID NO: 259404 - protein, 9 aa, Dengue virus
CYSQVNPTT

SEQ ID NO: 259405 - protein, 9 aa, Dengue virus
FCESLTLAT

SEQ ID NO: 259406 - protein, 9 aa, Dengue virus
IVREAIKRK

SEQ ID NO: 259407 - protein, 9 aa, Dengue virus
CYSQVNPIT

SEQ ID NO: 259408 - protein, 9 aa, Dengue virus
FESTYRGAK

SEQ ID NO: 259409 - protein, 9 aa, Dengue virus
VEMGEAAAI

SEQ ID NO: 259410 - protein, 9 aa, Dengue virus
FKEFASGRK

SEQ ID NO: 259411 - protein, 9 aa, Dengue virus
LIGLTSRAT

SEQ ID NO: 259412 - protein, 9 aa, Dengue virus
SMVNGVVKL

SEQ ID NO: 259413 - protein, 9 aa, Dengue virus
WSIHATHEW

SEQ ID NO: 259414 - protein, 9 aa, Dengue virus
WPLNEAVMA

SEQ ID NO: 259415 - protein, 9 aa, Dengue virus
LTLATGPIT

SEQ ID NO: 259416 - protein, 9 aa, Dengue virus
FKTAHAKKQ

SEQ ID NO: 259417 - protein, 9 aa, Dengue virus
MDLGVPLLA

SEQ ID NO: 259418 - protein, 9 aa, Dengue virus
LLALLGAMT

SEQ ID NO: 259419 - protein, 9 aa, Dengue virus
IVLLIPEPD

SEQ ID NO: 259420 - protein, 9 aa, Dengue virus
VDIGVPLLA

SEQ ID NO: 259421 - protein, 9 aa, Dengue virus
ISKMLINRF

SEQ ID NO: 259422 - protein, 9 aa, Dengue virus
LVSLLGSSL

SEQ ID NO: 259423 - protein, 9 aa, Dengue virus
AILMGLGKG

SEQ ID NO: 259424 - protein, 9 aa, Dengue virus
VLPMVTQIA

SEQ ID NO: 259425 - protein, 9 aa, Dengue virus
FHTMWHVTR

SEQ ID NO: 259426 - protein, 9 aa, Dengue virus
LAAIANQAA

SEQ ID NO: 259427 - protein, 9 aa, Dengue virus
LTPHSGTGL

SEQ ID NO: 259428 - protein, 9 aa, Dengue virus
YNLVVMDEA

SEQ ID NO: 259429 - protein, 9 aa, Dengue virus
ANIFRGSYL

SEQ ID NO: 259430 - protein, 9 aa, Dengue virus
RVIQLSRKT

SEQ ID NO: 259431 - protein, 9 aa, Dengue virus
LVPHVGMGL

SEQ ID NO: 259432 - protein, 9 aa, Dengue virus
LLLMRTSWA

SEQ ID NO: 259433 - protein, 9 aa, Dengue virus
TRKYLPAII

SEQ ID NO: 259434 - protein, 9 aa, Dengue virus
IVGLYGNGV

SEQ ID NO: 259435 - protein, 9 aa, Dengue virus
WIASAIILE

SEQ ID NO: 259436 - protein, 9 aa, Dengue virus
FGKAKGSRA

SEQ ID NO: 259437 - protein, 9 aa, Dengue virus
FIKKVRTNA

SEQ ID NO: 259438 - protein, 9 aa, Dengue virus
VITGRSADL

SEQ ID NO: 259439 - protein, 9 aa, Dengue virus
FKNAHAKRQ

SEQ ID NO: 259440 - protein, 9 aa, Dengue virus
HRVDLGVPL

SEQ ID NO: 259441 - protein, 9 aa, Dengue virus
IRYQTPAIR

SEQ ID NO: 259442 - protein, 9 aa, Dengue virus
LLSGRGPLK

SEQ ID NO: 259443 - protein, 9 aa, Dengue virus
LTAIANQAV

SEQ ID NO: 259444 - protein, 9 aa, Dengue virus
MVLLVPEPE

SEQ ID NO: 259445 - protein, 9 aa, Dengue virus
WVSGVSGNI

SEQ ID NO: 259446 - protein, 9 aa, Dengue virus
FIAFLRFLA

SEQ ID NO: 259447 - protein, 9 aa, Dengue virus
LLKNDVPLA

SEQ ID NO: 259448 - protein, 9 aa, Dengue virus
VFQEGTFHT

SEQ ID NO: 259449 - protein, 9 aa, Dengue virus
YLEFEALGF

SEQ ID NO: 259450 - protein, 9 aa, Dengue virus
LIGLSSRAT

SEQ ID NO: 259451 - protein, 9 aa, Dengue virus
SLRTTTVSG

SEQ ID NO: 259452 - protein, 9 aa, Dengue virus
TRKYLPAIV

SEQ ID NO: 259453 - protein, 9 aa, Dengue virus
IKQKGIFGK

SEQ ID NO: 259454 - protein, 9 aa, Dengue virus
FGKAKGSRA

SEQ ID NO: 259455 - protein, 9 aa, Dengue virus
YKFQPESPS

SEQ ID NO: 259456 - protein, 9 aa, Dengue virus
VVLMGLGKG

SEQ ID NO: 259457 - protein, 9 aa, Dengue virus
MGLGKGWPI

SEQ ID NO: 259458 - protein, 9 aa, Dengue virus
WSGVEGEGL

SEQ ID NO: 259459 - protein, 9 aa, Dengue virus
LAYVVIGLL

SEQ ID NO: 259460 - protein, 9 aa, Dengue virus
VEAGRTLRV

SEQ ID NO: 259461 - protein, 9 aa, Dengue virus
FRGSYLAGA

SEQ ID NO: 259462 - protein, 9 aa, Dengue virus
FVIDNVHTR

SEQ ID NO: 259463 - protein, 9 aa, Dengue virus
IVSILASSL

SEQ ID NO: 259464 - protein, 9 aa, Dengue virus
AVSRGSSKI

SEQ ID NO: 259465 - protein, 9 aa, Dengue virus
WISNGTGNI

SEQ ID NO: 259466 - protein, 9 aa, Dengue virus
VFQEGTFHT

SEQ ID NO: 259467 - protein, 9 aa, Dengue virus
FRGSYLAGA

SEQ ID NO: 259468 - protein, 9 aa, Dengue virus
FLAIPPTAG

SEQ ID NO: 259469 - protein, 9 aa, Dengue virus
TTTASGKLV

SEQ ID NO: 259470 - protein, 9 aa, Dengue virus
VQLIRQMEA

SEQ ID NO: 259471 - protein, 9 aa, Dengue virus
KRFSLGLLS

SEQ ID NO: 259472 - protein, 9 aa, Dengue virus
EEALKGMPI

SEQ ID NO: 259473 - protein, 9 aa, Dengue virus
WYGMEIRPI

SEQ ID NO: 259474 - protein, 9 aa, Dengue virus
SSELLSGRG

SEQ ID NO: 259475 - protein, 9 aa, Dengue virus
FEKQLGQVM

SEQ ID NO: 259476 - protein, 9 aa, Dengue virus
ATTIVTPML

SEQ ID NO: 259477 - protein, 9 aa, Dengue virus
LTPMLRHSI

SEQ ID NO: 259478 - protein, 9 aa, Dengue virus
MVTQMAMTD

SEQ ID NO: 259479 - protein, 9 aa, Dengue virus
VVPMVTQLA

SEQ ID NO: 259480 - protein, 9 aa, Dengue virus
IVSSVNMVS

SEQ ID NO: 259481 - protein, 9 aa, Dengue virus
LLVLCAVQL

SEQ ID NO: 259482 - protein, 9 aa, Dengue virus
LKRRLRTLI

SEQ ID NO: 259483 - protein, 9 aa, Dengue virus
FHTMWHVTR

SEQ ID NO: 259484 - protein, 9 aa, Dengue virus
PSRLSAAIG

SEQ ID NO: 259485 - protein, 9 aa, Dengue virus
LQWIASAIV

SEQ ID NO: 259486 - protein, 9 aa, Dengue virus
RLLTKPWDV

SEQ ID NO: 259487 - protein, 9 aa, Dengue virus
FCEVLTLAT

SEQ ID NO: 259488 - protein, 9 aa, Dengue virus
VGMGEAAAI

SEQ ID NO: 259489 - protein, 9 aa, Dengue virus
PRWLDARIY

SEQ ID NO: 259490 - protein, 9 aa, Dengue virus
IVKLHSGKD

SEQ ID NO: 259491 - protein, 9 aa, Dengue virus
SRTTWSIHA

SEQ ID NO: 259492 - protein, 9 aa, Dengue virus
WVDLVLEHG

SEQ ID NO: 259493 - protein, 9 aa, Dengue virus
EGAMHSALA

SEQ ID NO: 259494 - protein, 9 aa, Dengue virus
LKGLPIRYQ

SEQ ID NO: 259495 - protein, 9 aa, Dengue virus
MYWISNGTG

SEQ ID NO: 259496 - protein, 9 aa, Dengue virus
WKLEKASFI

SEQ ID NO: 259497 - protein, 9 aa, Dengue virus
FHTMWHVTR

SEQ ID NO: 259498 - protein, 9 aa, Dengue virus
LIGLSSRAT

SEQ ID NO: 259499 - protein, 9 aa, Dengue virus
MHTALTGAT

SEQ ID NO: 259500 - protein, 9 aa, Dengue virus
CYVITGTSA

SEQ ID NO: 259501 - protein, 9 aa, Dengue virus
MYWISNGTG

SEQ ID NO: 259502 - protein, 9 aa, Dengue virus
WALCESITL

SEQ ID NO: 259503 - protein, 9 aa, Dengue virus
FQPESPKRL

SEQ ID NO: 259504 - protein, 9 aa, Dengue virus
WAFCEALTL

SEQ ID NO: 259505 - protein, 9 aa, Dengue virus
YAQMWSLMY

SEQ ID NO: 259506 - protein, 9 aa, Dengue virus
FMGHLKCRL

SEQ ID NO: 259507 - protein, 9 aa, Dengue virus
IYADPMALK

SEQ ID NO: 259508 - protein, 9 aa, Dengue virus
FCSHHFHEL

SEQ ID NO: 259509 - protein, 9 aa, Dengue virus
WAYHGSYEV

SEQ ID NO: 259510 - protein, 9 aa, Dengue virus
LKRVRNRVS

SEQ ID NO: 259511 - protein, 9 aa, Dengue virus
LRKNGKRVI

SEQ ID NO: 259512 - protein, 9 aa, Dengue virus
FLNDMGKVR

SEQ ID NO: 259513 - protein, 9 aa, Dengue virus
FVADNVHTR

SEQ ID NO: 259514 - protein, 9 aa, Dengue virus
ASSMVNGVV

SEQ ID NO: 259515 - protein, 9 aa, Dengue virus
WSIHATHEW

SEQ ID NO: 259516 - protein, 9 aa, Dengue virus
WNIVKLHSG

SEQ ID NO: 259517 - protein, 9 aa, Dengue virus
FSKGLFSGQ

SEQ ID NO: 259518 - protein, 9 aa, Dengue virus
YFHRRDLRL

SEQ ID NO: 259519 - protein, 9 aa, Dengue virus
LIMKDGRSL

SEQ ID NO: 259520 - protein, 9 aa, Dengue virus
FRKRRLTIM

SEQ ID NO: 259521 - protein, 9 aa, Dengue virus
SKMDLGVPL

SEQ ID NO: 259522 - protein, 9 aa, Dengue virus
ILLMRTTWA

SEQ ID NO: 259523 - protein, 9 aa, Dengue virus
LYAVATTFI

SEQ ID NO: 259524 - protein, 9 aa, Dengue virus
WKLEKASFI

SEQ ID NO: 259525 - protein, 9 aa, Dengue virus
TKRILPSIV

SEQ ID NO: 259526 - protein, 9 aa, Dengue virus
TTTASGKLI

SEQ ID NO: 259527 - protein, 9 aa, Dengue virus
FHTMWHVTR

SEQ ID NO: 259528 - protein, 9 aa, Dengue virus
ILLSSLLRN

SEQ ID NO: 259529 - protein, 9 aa, Dengue virus
LTLATGPVL

SEQ ID NO: 259530 - protein, 9 aa, Dengue virus
LLKNDVPLA

SEQ ID NO: 259531 - protein, 9 aa, Dengue virus
YWVSCGTGN

SEQ ID NO: 259532 - protein, 9 aa, Dengue virus
VEMGEAAAI

SEQ ID NO: 259533 - protein, 9 aa, Dengue virus
SQVGVGIHM

SEQ ID NO: 259534 - protein, 9 aa, Dengue virus
AVSMANIFR

SEQ ID NO: 259535 - protein, 9 aa, Dengue virus
FLTIPPTAG

SEQ ID NO: 259536 - protein, 9 aa, Dengue virus
CVTTIAKNK

SEQ ID NO: 259537 - protein, 9 aa, Dengue virus
LVKRFSTGL

SEQ ID NO: 259538 - protein, 9 aa, Dengue virus
LAPHVGMGL

SEQ ID NO: 259539 - protein, 9 aa, Dengue virus
FVPSIKAGN

SEQ ID NO: 259540 - protein, 9 aa, Dengue virus
FCSHHFHKI

SEQ ID NO: 259541 - protein, 9 aa, Dengue virus
TARGARRMA

SEQ ID NO: 259542 - protein, 9 aa, Dengue virus
YAVATTVLT

SEQ ID NO: 259543 - protein, 9 aa, Dengue virus
VVLEHGGCV

SEQ ID NO: 259544 - protein, 9 aa, Dengue virus
CYVITGTSA

SEQ ID NO: 259545 - protein, 9 aa, Dengue virus
WAFCEVLTL

SEQ ID NO: 259546 - protein, 9 aa, Dengue virus
TGPLVAGGL

SEQ ID NO: 259547 - protein, 9 aa, Dengue virus
LFSGVSWMI

SEQ ID NO: 259548 - protein, 9 aa, Dengue virus
MVREAIRRG

SEQ ID NO: 259549 - protein, 9 aa, Dengue virus
ISEMGANFR

SEQ ID NO: 259550 - protein, 9 aa, Dengue virus
TTTVSGKLI

SEQ ID NO: 259551 - protein, 9 aa, Dengue virus
IKDQRAVHA

SEQ ID NO: 259552 - protein, 9 aa, Dengue virus
TRKYLPAII

SEQ ID NO: 259553 - protein, 9 aa, Dengue virus
LRTTTVTGK

SEQ ID NO: 259554 - protein, 9 aa, Dengue virus
FGRAKGSRA

SEQ ID NO: 259555 - protein, 9 aa, Dengue virus
IVREAIKRG

SEQ ID NO: 259556 - protein, 9 aa, Dengue virus
PIRVPNYNL

SEQ ID NO: 259557 - protein, 9 aa, Dengue virus
AVSRGSAKL

SEQ ID NO: 259558 - protein, 9 aa, Dengue virus
MRGAKRMAI

SEQ ID NO: 259559 - protein, 9 aa, Dengue virus
AWTLYAVAT

SEQ ID NO: 259560 - protein, 9 aa, Dengue virus
VVTTSGTYV

SEQ ID NO: 259561 - protein, 9 aa, Dengue virus
LLMRTTWAL

SEQ ID NO: 259562 - protein, 9 aa, Dengue virus
MVTFKVPHA

SEQ ID NO: 259563 - protein, 9 aa, Dengue virus
AHKVAAEGI

SEQ ID NO: 259564 - protein, 9 aa, Dengue virus
FWNTTIAVS

SEQ ID NO: 259565 - protein, 9 aa, Dengue virus
FSRGNSLSG

SEQ ID NO: 259566 - protein, 9 aa, Dengue virus
CGIRSTTRL

SEQ ID NO: 259567 - protein, 9 aa, Dengue virus
FVIDNVHTR

SEQ ID NO: 259568 - protein, 9 aa, Dengue virus
LKCGSGIFI

SEQ ID NO: 259569 - protein, 9 aa, Dengue virus
VTPMLRHTI

SEQ ID NO: 259570 - protein, 9 aa, Dengue virus
LTLATGPIT

SEQ ID NO: 259571 - protein, 9 aa, Dengue virus
LIMKDGRSL

SEQ ID NO: 259572 - protein, 9 aa, Dengue virus
WLVHRQWFL

SEQ ID NO: 259573 - protein, 9 aa, Dengue virus
MGLGKGWPI

SEQ ID NO: 259574 - protein, 9 aa, Dengue virus
IYADDTAGW

SEQ ID NO: 259575 - protein, 9 aa, Dengue virus
LKRVRNRVS

SEQ ID NO: 259576 - protein, 9 aa, Dengue virus
HRMDLGVPL

SEQ ID NO: 259577 - protein, 9 aa, Dengue virus
LILAPTRVV

SEQ ID NO: 259578 - protein, 9 aa, Dengue virus
ISQGAGWSL

SEQ ID NO: 259579 - protein, 9 aa, Dengue virus
ARGYISTRV

SEQ ID NO: 259580 - protein, 9 aa, Dengue virus
YLEFEALGF

SEQ ID NO: 259581 - protein, 9 aa, Dengue virus
VILAGPMPV

SEQ ID NO: 259582 - protein, 9 aa, Dengue virus
IFITNNVHT

SEQ ID NO: 259583 - protein, 9 aa, Dengue virus
LVPHVGMGL

SEQ ID NO: 259584 - protein, 9 aa, Dengue virus
KQLGQVMLL

SEQ ID NO: 259585 - protein, 9 aa, Dengue virus
FQPESPSRL

SEQ ID NO: 259586 - protein, 9 aa, Dengue virus
SKMDLGVPL

SEQ ID NO: 259587 - protein, 9 aa, Dengue virus
YLAGAGLAF

SEQ ID NO: 259588 - protein, 9 aa, Dengue virus
VMAFIAFLR

SEQ ID NO: 259589 - protein, 9 aa, Dengue virus
FTNMEVQLI

SEQ ID NO: 259590 - protein, 9 aa, Dengue virus
LMRTSWAFC

SEQ ID NO: 259591 - protein, 9 aa, Dengue virus
LGRGWPIHR

SEQ ID NO: 259592 - protein, 9 aa, Dengue virus
LILAPTRVV

SEQ ID NO: 259593 - protein, 9 aa, Dengue virus
FQADSPKRL

SEQ ID NO: 259594 - protein, 9 aa, Dengue virus
ISEMGANFR

SEQ ID NO: 259595 - protein, 9 aa, Dengue virus
ANISLAAIA

SEQ ID NO: 259596 - protein, 9 aa, Dengue virus
MGLDKGWPL

SEQ ID NO: 259597 - protein, 9 aa, Dengue virus
YVSAIAQAK

SEQ ID NO: 259598 - protein, 9 aa, Dengue virus
ISYGGGWKL

SEQ ID NO: 259599 - protein, 9 aa, Dengue virus
FTNMEVQLI

SEQ ID NO: 259600 - protein, 9 aa, Dengue virus
VVGLYGNGV

SEQ ID NO: 259601 - protein, 9 aa, Dengue virus
PLLAMGCYS

SEQ ID NO: 259602 - protein, 9 aa, Dengue virus
LVTFKNPHA

SEQ ID NO: 259603 - protein, 9 aa, Dengue virus
MVTQIAMTD

SEQ ID NO: 259604 - protein, 9 aa, Dengue virus
IANQAVVLM

SEQ ID NO: 259605 - protein, 9 aa, Dengue virus
VRSNAALGA

SEQ ID NO: 259606 - protein, 9 aa, Dengue virus
GGLLIACYV

SEQ ID NO: 259607 - protein, 9 aa, Dengue virus
LNTFTNMEA

SEQ ID NO: 259608 - protein, 9 aa, Dengue virus
MRGAKRMAI

SEQ ID NO: 259609 - protein, 9 aa, Dengue virus
IMKDGRVLV

SEQ ID NO: 259610 - protein, 9 aa, Dengue virus
VILAGPMPV

SEQ ID NO: 259611 - protein, 9 aa, Dengue virus
WYGMEIRPL

SEQ ID NO: 259612 - protein, 9 aa, Dengue virus
VTHSSAAQR

SEQ ID NO: 259613 - protein, 9 aa, Dengue virus
CLGKSYAQM

SEQ ID NO: 259614 - protein, 9 aa, Dengue virus
VLTLATGPV

SEQ ID NO: 259615 - protein, 9 aa, Dengue virus
LQGQGPMKM

SEQ ID NO: 259616 - protein, 9 aa, Dengue virus
YNHALNELP

SEQ ID NO: 259617 - protein, 9 aa, Dengue virus
FGGVSWVMK

SEQ ID NO: 259618 - protein, 9 aa, Dengue virus
TWSIHAKHQ

SEQ ID NO: 259619 - protein, 9 aa, Dengue virus
YAIIGPGLQ

SEQ ID NO: 259620 - protein, 9 aa, Dengue virus
LNTFTNMEA

SEQ ID NO: 259621 - protein, 9 aa, Dengue virus
RKKLRPRWL

SEQ ID NO: 259622 - protein, 9 aa, Dengue virus
FRAERVIDP

SEQ ID NO: 259623 - protein, 9 aa, Dengue virus
KLMSAAVKD

SEQ ID NO: 259624 - protein, 9 aa, Dengue virus
IVSSVNMIS

SEQ ID NO: 259625 - protein, 9 aa, Dengue virus
FSGQGPMKL

SEQ ID NO: 259626 - protein, 9 aa, Dengue virus
DVPLAGPLI

SEQ ID NO: 259627 - protein, 9 aa, Dengue virus
LGSQEGAMH

SEQ ID NO: 259628 - protein, 9 aa, Dengue virus
YAVSRGTSK

SEQ ID NO: 259629 - protein, 9 aa, Dengue virus
MVNGVVRLL

SEQ ID NO: 259630 - protein, 9 aa, Dengue virus
AIIGPGLQA

SEQ ID NO: 259631 - protein, 9 aa, Dengue virus
YVFMGEPLE

SEQ ID NO: 259632 - protein, 9 aa, Dengue virus
FGMFTTNIW

SEQ ID NO: 259633 - protein, 9 aa, Dengue virus
TTWSIHAKH

SEQ ID NO: 259634 - protein, 9 aa, Dengue virus
FWNTTIAVS

SEQ ID NO: 259635 - protein, 9 aa, Dengue virus
YGWNLVKLM

SEQ ID NO: 259636 - protein, 9 aa, Dengue virus
CYVITGTSA

SEQ ID NO: 259637 - protein, 9 aa, Dengue virus
YGNGVVTKS

SEQ ID NO: 259638 - protein, 9 aa, Dengue virus
FQADSPSKL

SEQ ID NO: 259639 - protein, 9 aa, Dengue virus
SKMLLNRFT

SEQ ID NO: 259640 - protein, 9 aa, Dengue virus
YHGSYEVKA

SEQ ID NO: 259641 - protein, 9 aa, Dengue virus
PETLETLLL

SEQ ID NO: 259642 - protein, 9 aa, Dengue virus
FQPESPSRL

SEQ ID NO: 259643 - protein, 9 aa, Dengue virus
TVQQLTKRF

SEQ ID NO: 259644 - protein, 9 aa, Dengue virus
IRYQTPAIR

SEQ ID NO: 259645 - protein, 9 aa, Dengue virus
LYAVATTFI

SEQ ID NO: 259646 - protein, 9 aa, Dengue virus
FVADNVHTR

SEQ ID NO: 259647 - protein, 9 aa, Dengue virus
VVLAGPMPV

SEQ ID NO: 259648 - protein, 9 aa, Dengue virus
AVSRGTAKL

SEQ ID NO: 259649 - protein, 9 aa, Dengue virus
YRILQRGLL

SEQ ID NO: 259650 - protein, 9 aa, Dengue virus
LTAIANQAA

SEQ ID NO: 259651 - protein, 9 aa, Dengue virus
FIAFLRFLA

SEQ ID NO: 259652 - protein, 9 aa, Dengue virus
VEMGEAAGI

SEQ ID NO: 259653 - protein, 9 aa, Dengue virus
FVIDNVHTR

SEQ ID NO: 259654 - protein, 9 aa, Dengue virus
NRVSTPQGL

SEQ ID NO: 259655 - protein, 9 aa, Dengue virus
IEESRTIRV

SEQ ID NO: 259656 - protein, 9 aa, Dengue virus
IHATHQWMT

SEQ ID NO: 259657 - protein, 9 aa, Dengue virus
FVELMRRGD

SEQ ID NO: 259658 - protein, 9 aa, Dengue virus
KVIQLSRKT

SEQ ID NO: 259659 - protein, 9 aa, Dengue virus
LTAIANQAA

SEQ ID NO: 259660 - protein, 9 aa, Dengue virus
LVLEHGGCV

SEQ ID NO: 259661 - protein, 9 aa, Dengue virus
FTSKVRSNA

SEQ ID NO: 259662 - protein, 9 aa, Dengue virus
MWSLMYFHR

SEQ ID NO: 259663 - protein, 9 aa, Dengue virus
IGKMFEATA

SEQ ID NO: 259664 - protein, 9 aa, Dengue virus
CHATFTMRL

SEQ ID NO: 259665 - protein, 9 aa, Dengue virus
ILLMRTSWA

SEQ ID NO: 259666 - protein, 9 aa, Dengue virus
YKFQADSPS

SEQ ID NO: 259667 - protein, 9 aa, Dengue virus
FTSKVRSNA

SEQ ID NO: 259668 - protein, 9 aa, Dengue virus
FTSKVRSNA

SEQ ID NO: 259669 - protein, 9 aa, Dengue virus
PARLATAIA

SEQ ID NO: 259670 - protein, 9 aa, Dengue virus
LLRNDVPLA

SEQ ID NO: 259671 - protein, 9 aa, Dengue virus
LPVWLAHKV

SEQ ID NO: 259672 - protein, 9 aa, Dengue virus
TLYAVATTI

SEQ ID NO: 259673 - protein, 9 aa, Dengue virus
YISTRVEMG

SEQ ID NO: 259674 - protein, 9 aa, Dengue virus
IRYQTTAVK

SEQ ID NO: 259675 - protein, 9 aa, Dengue virus
FWNTTIAVS

SEQ ID NO: 259676 - protein, 9 aa, Dengue virus
FMTATPPGS

SEQ ID NO: 259677 - protein, 9 aa, Dengue virus
YRIKQRGIL

SEQ ID NO: 259678 - protein, 9 aa, Dengue virus
YRLRGEQRK

SEQ ID NO: 259679 - protein, 9 aa, Dengue virus
FLRFLAIPP

SEQ ID NO: 259680 - protein, 9 aa, Dengue virus
VTVASAAQR

SEQ ID NO: 259681 - protein, 9 aa, Dengue virus
WMVHRQWFF

SEQ ID NO: 259682 - protein, 9 aa, Dengue virus
FQADSPKRL

SEQ ID NO: 259683 - protein, 9 aa, Dengue virus
VRSNAALGA

SEQ ID NO: 259684 - protein, 9 aa, Dengue virus
FVIDNVHTR

SEQ ID NO: 259685 - protein, 9 aa, Dengue virus
WSLKETACL

SEQ ID NO: 259686 - protein, 9 aa, Dengue virus
DVPLAGPLI

SEQ ID NO: 259687 - protein, 9 aa, Dengue virus
MTSKMLLNR

SEQ ID NO: 259688 - protein, 9 aa, Dengue virus
LGKSYAQMW

SEQ ID NO: 259689 - protein, 9 aa, Dengue virus
VVVLGSQEG

SEQ ID NO: 259690 - protein, 9 aa, Dengue virus
FGMFSTNIW

SEQ ID NO: 259691 - protein, 9 aa, Dengue virus
IVLEHGGCV

SEQ ID NO: 259692 - protein, 9 aa, Dengue virus
QTWMSSEGA

SEQ ID NO: 259693 - protein, 9 aa, Dengue virus
FGIFTTNIW

SEQ ID NO: 259694 - protein, 9 aa, Dengue virus
RLLTKPWDV

SEQ ID NO: 259695 - protein, 9 aa, Dengue virus
YSGVEGEGL

SEQ ID NO: 259696 - protein, 9 aa, Dengue virus
ITLATGPLS

SEQ ID NO: 259697 - protein, 9 aa, Dengue virus
FEKQLGQIM

SEQ ID NO: 259698 - protein, 9 aa, Dengue virus
PLLALGCYS

SEQ ID NO: 259699 - protein, 9 aa, Dengue virus
INGVVKLLT

SEQ ID NO: 259700 - protein, 9 aa, Dengue virus
VYNMMGKRE

SEQ ID NO: 259701 - protein, 9 aa, Dengue virus
VYNMMGKRE

SEQ ID NO: 259702 - protein, 9 aa, Dengue virus
VWLAYKVAS

SEQ ID NO: 259703 - protein, 9 aa, Dengue virus
LVSILLSSL

SEQ ID NO: 259704 - protein, 9 aa, Dengue virus
PLLAMGCYS

SEQ ID NO: 259705 - protein, 9 aa, Dengue virus
LIALNDMGK

SEQ ID NO: 259706 - protein, 9 aa, Dengue virus
FITFLRVLS

SEQ ID NO: 259707 - protein, 9 aa, Dengue virus
LRPASAWTL

SEQ ID NO: 259708 - protein, 9 aa, Dengue virus
FRAERVIDP

SEQ ID NO: 259709 - protein, 9 aa, Dengue virus
LIMKDGRVL

SEQ ID NO: 259710 - protein, 9 aa, Dengue virus
IGKMLEATA

SEQ ID NO: 259711 - protein, 9 aa, Dengue virus
FGIFTTNIW

SEQ ID NO: 259712 - protein, 9 aa, Dengue virus
TAKGARRMA

SEQ ID NO: 259713 - protein, 9 aa, Dengue virus
LYAVATTFI

SEQ ID NO: 259714 - protein, 9 aa, Dengue virus
WAFCEVLTL

SEQ ID NO: 259715 - protein, 9 aa, Dengue virus
WKLEKASFI

SEQ ID NO: 259716 - protein, 9 aa, Dengue virus
YLEFEALGF

SEQ ID NO: 259717 - protein, 9 aa, Dengue virus
NEAIMAVGL

SEQ ID NO: 259718 - protein, 9 aa, Dengue virus
LVALIAVLT

SEQ ID NO: 259719 - protein, 9 aa, Dengue virus
VILAGPIPV

SEQ ID NO: 259720 - protein, 9 aa, Dengue virus
MGLGKGWPL

SEQ ID NO: 259721 - protein, 9 aa, Dengue virus
YRLRGESRK

SEQ ID NO: 259722 - protein, 9 aa, Dengue virus
IVLLIPEPD

SEQ ID NO: 259723 - protein, 9 aa, Dengue virus
LSSLLRNDV

SEQ ID NO: 259724 - protein, 9 aa, Dengue virus
WADVKNDMI

SEQ ID NO: 259725 - protein, 9 aa, Dengue virus
FEKQLGQVM

SEQ ID NO: 259726 - protein, 9 aa, Dengue virus
IYSDPLALR

SEQ ID NO: 259727 - protein, 9 aa, Dengue virus
IKDQRAVHA

SEQ ID NO: 259728 - protein, 9 aa, Dengue virus
HLKCKVRME

SEQ ID NO: 259729 - protein, 9 aa, Dengue virus
SKMDIGVPL

SEQ ID NO: 259730 - protein, 9 aa, Dengue virus
AYKVASEGI

SEQ ID NO: 259731 - protein, 9 aa, Dengue virus
ATTFITPML

SEQ ID NO: 259732 - protein, 9 aa, Dengue virus
VVPMVTQLA

SEQ ID NO: 259733 - protein, 9 aa, Dengue virus
IANQATVLM

SEQ ID NO: 259734 - protein, 9 aa, Dengue virus
YVFMGEPLE

SEQ ID NO: 259735 - protein, 9 aa, Dengue virus
ILLSSLLKN

SEQ ID NO: 259736 - protein, 9 aa, Dengue virus
ENSTANVSL

SEQ ID NO: 259737 - protein, 9 aa, Dengue virus
CHATFTTRL

SEQ ID NO: 259738 - protein, 9 aa, Dengue virus
HWFSRENSL

SEQ ID NO: 259739 - protein, 9 aa, Dengue virus
LLLMRTSWA

SEQ ID NO: 259740 - protein, 9 aa, Dengue virus
VIMDEAHFT

SEQ ID NO: 259741 - protein, 9 aa, Dengue virus
MWHVTRGAV

SEQ ID NO: 259742 - protein, 9 aa, Dengue virus
NLSLAAIAN

SEQ ID NO: 259743 - protein, 9 aa, Dengue virus
FQEGTFHTM

SEQ ID NO: 259744 - protein, 9 aa, Dengue virus
IVASVNTTS

SEQ ID NO: 259745 - protein, 9 aa, Dengue virus
LIGRARISQ

SEQ ID NO: 259746 - protein, 9 aa, Dengue virus
DLRLASNAI

SEQ ID NO: 259747 - protein, 9 aa, Dengue virus
WNLVKLYSG

SEQ ID NO: 259748 - protein, 9 aa, Dengue virus
RVIQLSRKT

SEQ ID NO: 259749 - protein, 9 aa, Dengue virus
VVTTSGTYV

SEQ ID NO: 259750 - protein, 9 aa, Dengue virus
GLFGKGSLV

SEQ ID NO: 259751 - protein, 9 aa, Dengue virus
AYVMTGRSA

SEQ ID NO: 259752 - protein, 9 aa, Dengue virus
WSLKETACL

SEQ ID NO: 259753 - protein, 9 aa, Dengue virus
LVLEHGGCV

SEQ ID NO: 259754 - protein, 9 aa, Dengue virus
FITFLRVLS

SEQ ID NO: 259755 - protein, 9 aa, Dengue virus
WKIEKASFI

SEQ ID NO: 259756 - protein, 9 aa, Dengue virus
PLKLFMALV

SEQ ID NO: 259757 - protein, 9 aa, Dengue virus
IAMTDTTPF

SEQ ID NO: 259758 - protein, 9 aa, Dengue virus
YLAGAGLLF

SEQ ID NO: 259759 - protein, 9 aa, Dengue virus
RSVALAPHV

SEQ ID NO: 259760 - protein, 9 aa, Dengue virus
GYSQIGAGV

SEQ ID NO: 259761 - protein, 9 aa, Dengue virus
FCEALTLAT

SEQ ID NO: 259762 - protein, 9 aa, Dengue virus
VRSNAAIGA

SEQ ID NO: 259763 - protein, 9 aa, Dengue virus
VTLDFSPGT

SEQ ID NO: 259764 - protein, 9 aa, Dengue virus
MGLGKGWPI

SEQ ID NO: 259765 - protein, 9 aa, Dengue virus
FKEFAAGRK

SEQ ID NO: 259766 - protein, 9 aa, Dengue virus
WSLMYFHRR

SEQ ID NO: 259767 - protein, 9 aa, Dengue virus
IHAHHQWMT

SEQ ID NO: 259768 - protein, 9 aa, Dengue virus
FCSHHFHEL

SEQ ID NO: 259769 - protein, 9 aa, Dengue virus
RVIQLSRKT

SEQ ID NO: 259770 - protein, 9 aa, Dengue virus
VVLMGLGKG

SEQ ID NO: 259771 - protein, 9 aa, Dengue virus
AVSRGSAKL

SEQ ID NO: 259772 - protein, 9 aa, Dengue virus
MVLLVPEPE

SEQ ID NO: 259773 - protein, 9 aa, Dengue virus
FEKQLGQVM

SEQ ID NO: 259774 - protein, 9 aa, Dengue virus
VSQGAGWSL

SEQ ID NO: 259775 - protein, 9 aa, Dengue virus
WAYHGSYEV

SEQ ID NO: 259776 - protein, 9 aa, Dengue virus
LILCTGQLL

SEQ ID NO: 259777 - protein, 9 aa, Dengue virus
YLAGAGLLF

SEQ ID NO: 259778 - protein, 9 aa, Dengue virus
WDVVPTVTQ

SEQ ID NO: 259779 - protein, 9 aa, Dengue virus
VWFVPSIKS

SEQ ID NO: 259780 - protein, 9 aa, Dengue virus
FSRGNSLSG

SEQ ID NO: 259781 - protein, 9 aa, Dengue virus
CHATFTMRL

SEQ ID NO: 259782 - protein, 9 aa, Dengue virus
AYKVASEGI

SEQ ID NO: 259783 - protein, 9 aa, Dengue virus
LRLASNAIC

SEQ ID NO: 259784 - protein, 9 aa, Dengue virus
FVELMRRGD

SEQ ID NO: 259785 - protein, 9 aa, Dengue virus
WYGMEIRPL

SEQ ID NO: 259786 - protein, 9 aa, Dengue virus
QDNQLIYVI

SEQ ID NO: 259787 - protein, 9 aa, Dengue virus
GSAKLRWFV

SEQ ID NO: 259788 - protein, 9 aa, Dengue virus
NVSLAAIAN

SEQ ID NO: 259789 - protein, 9 aa, Dengue virus
LTIMDLHPG

SEQ ID NO: 259790 - protein, 9 aa, Dengue virus
LRWIVERGM

SEQ ID NO: 259791 - protein, 9 aa, Dengue virus
IKRKLRTLI

SEQ ID NO: 259792 - protein, 9 aa, Dengue virus
VASEMAEAL

SEQ ID NO: 259793 - protein, 9 aa, Dengue virus
MGLGKGWPL

SEQ ID NO: 259794 - protein, 9 aa, Dengue virus
VWLSYKVAS

SEQ ID NO: 259795 - protein, 9 aa, Dengue virus
FKTAHAKKQ

SEQ ID NO: 259796 - protein, 9 aa, Dengue virus
WAYHGSYEV

SEQ ID NO: 259797 - protein, 9 aa, Dengue virus
IRYQTTAVK

SEQ ID NO: 259798 - protein, 9 aa, Dengue virus
LVRLQSGVD

SEQ ID NO: 259799 - protein, 9 aa, Dengue virus
MLTILIRTG

SEQ ID NO: 259800 - protein, 9 aa, Dengue virus
YMWLGARYL

SEQ ID NO: 259801 - protein, 9 aa, Dengue virus
IRVLSLVEN

SEQ ID NO: 259802 - protein, 9 aa, Dengue virus
LKCGSGIFV

SEQ ID NO: 259803 - protein, 9 aa, Dengue virus
IHATHQWMT

SEQ ID NO: 259804 - protein, 9 aa, Dengue virus
IRSVTRLEN

SEQ ID NO: 259805 - protein, 9 aa, Dengue virus
YHGSYEVKA

SEQ ID NO: 259806 - protein, 9 aa, Dengue virus
AIANQAAIL

SEQ ID NO: 259807 - protein, 9 aa, Dengue virus
IKQRGILGR

SEQ ID NO: 259808 - protein, 9 aa, Dengue virus
LGSQEGAMH

SEQ ID NO: 259809 - protein, 9 aa, Dengue virus
SQVGVGIHM

SEQ ID NO: 259810 - protein, 9 aa, Dengue virus
HQWMTTEDM

SEQ ID NO: 259811 - protein, 9 aa, Dengue virus
PQWIAASII

SEQ ID NO: 259812 - protein, 9 aa, Dengue virus
GMLVRNPLS

SEQ ID NO: 259813 - protein, 9 aa, Dengue virus
VILAGPMPV

SEQ ID NO: 259814 - protein, 9 aa, Dengue virus
VILAGPMPV

SEQ ID NO: 259815 - protein, 9 aa, Dengue virus
YNLIIMDEA

SEQ ID NO: 259816 - protein, 9 aa, Dengue virus
IVREAIKRG

SEQ ID NO: 259817 - protein, 9 aa, Dengue virus
VCGIRSATR

SEQ ID NO: 259818 - protein, 9 aa, Dengue virus
LTLATGPIT

SEQ ID NO: 259819 - protein, 9 aa, Dengue virus
FGMFTTNIW

SEQ ID NO: 259820 - protein, 9 aa, Dengue virus
IKDQRAVHA

SEQ ID NO: 259821 - protein, 9 aa, Dengue virus
PVRVPNYNL

SEQ ID NO: 259822 - protein, 9 aa, Dengue virus
MRTALTGAT

SEQ ID NO: 259823 - protein, 9 aa, Dengue virus
KSYAQMWQL

SEQ ID NO: 259824 - protein, 9 aa, Dengue virus
FKAERVIDP

SEQ ID NO: 259825 - protein, 9 aa, Dengue virus
DVPLAGPLI

SEQ ID NO: 259826 - protein, 9 aa, Dengue virus
FQPESPARV

SEQ ID NO: 259827 - protein, 9 aa, Dengue virus
LVLEHGGCV

SEQ ID NO: 259828 - protein, 9 aa, Dengue virus
SIAARGYIS

SEQ ID NO: 259829 - protein, 9 aa, Dengue virus
IVASVNTTS

SEQ ID NO: 259830 - protein, 9 aa, Dengue virus
LIGLSSRAT

SEQ ID NO: 259831 - protein, 9 aa, Dengue virus
QRGLLGKTQ

SEQ ID NO: 259832 - protein, 9 aa, Dengue virus
ILLMRTTWA

SEQ ID NO: 259833 - protein, 9 aa, Dengue virus
LRTTTASGK

SEQ ID NO: 259834 - protein, 9 aa, Dengue virus
SCTLPPLRY

SEQ ID NO: 259835 - protein, 9 aa, Dengue virus
FITPMMRHT

SEQ ID NO: 259836 - protein, 9 aa, Dengue virus
GFGVFSTNI

SEQ ID NO: 259837 - protein, 9 aa, Dengue virus
TTWSIHAKH

SEQ ID NO: 259838 - protein, 9 aa, Dengue virus
PLVAGGLLI

SEQ ID NO: 259839 - protein, 9 aa, Dengue virus
FTRKVRSNA

SEQ ID NO: 259840 - protein, 9 aa, Dengue virus
SQKNGSWKL

SEQ ID NO: 259841 - protein, 9 aa, Dengue virus
FLEFEALGF

SEQ ID NO: 259842 - protein, 9 aa, Dengue virus
YKFQPESPA

SEQ ID NO: 259843 - protein, 9 aa, Dengue virus
MMVLLVPEP

SEQ ID NO: 259844 - protein, 9 aa, Dengue virus
VTYSLNTFT

SEQ ID NO: 259845 - protein, 9 aa, Dengue virus
HRLMSAAVK

SEQ ID NO: 259846 - protein, 9 aa, Dengue virus
GRSQVGVGI

SEQ ID NO: 259847 - protein, 9 aa, Dengue virus
TRLENLLWK

SEQ ID NO: 259848 - protein, 9 aa, Dengue virus
MDIGVPLLA

SEQ ID NO: 259849 - protein, 9 aa, Dengue virus
FQADSPKKL

SEQ ID NO: 259850 - protein, 9 aa, Dengue virus
KVIQLSRKT

SEQ ID NO: 259851 - protein, 9 aa, Dengue virus
FLAIPPTAG

SEQ ID NO: 259852 - protein, 9 aa, Dengue virus
FTNMEAQLI

SEQ ID NO: 259853 - protein, 9 aa, Dengue virus
WMTTEDMLS

SEQ ID NO: 259854 - protein, 9 aa, Dengue virus
LIGLTSRAT

SEQ ID NO: 259855 - protein, 9 aa, Dengue virus
VLSIPPTAG

SEQ ID NO: 259856 - protein, 9 aa, Dengue virus
IAVSTANIF

SEQ ID NO: 259857 - protein, 9 aa, Dengue virus
LGRGWPLHR

SEQ ID NO: 259858 - protein, 9 aa, Dengue virus
PMKLVMAFI

SEQ ID NO: 259859 - protein, 9 aa, Dengue virus
LLSSTRVPN

SEQ ID NO: 259860 - protein, 9 aa, Dengue virus
CGSLIGLSS

SEQ ID NO: 259861 - protein, 9 aa, Dengue virus
CYVITGTSA

SEQ ID NO: 259862 - protein, 9 aa, Dengue virus
VIPMVTQMA

SEQ ID NO: 259863 - protein, 9 aa, Dengue virus
CVTTMAQGK

SEQ ID NO: 259864 - protein, 9 aa, Dengue virus
VVLEHGGCV

SEQ ID NO: 259865 - protein, 9 aa, Dengue virus
TVASAAQRR

SEQ ID NO: 259866 - protein, 9 aa, Dengue virus
LMVLLVPEP

SEQ ID NO: 259867 - protein, 9 aa, Dengue virus
FQADSPSKL

SEQ ID NO: 259868 - protein, 9 aa, Dengue virus
VEMGEAAAI

SEQ ID NO: 259869 - protein, 9 aa, Dengue virus
FWNTTIAVS

SEQ ID NO: 259870 - protein, 9 aa, Dengue virus
MGLGKGWPL

SEQ ID NO: 259871 - protein, 9 aa, Dengue virus
LLSGRGPLK

SEQ ID NO: 259872 - protein, 9 aa, Dengue virus
LRMVLAFIT

SEQ ID NO: 259873 - protein, 9 aa, Dengue virus
DLRLASMAI

SEQ ID NO: 259874 - protein, 9 aa, Dengue virus
WKMERASFI

SEQ ID NO: 259875 - protein, 9 aa, Dengue virus
VIALEPGKN

SEQ ID NO: 259876 - protein, 9 aa, Dengue virus
CGSLIGLTS

SEQ ID NO: 259877 - protein, 9 aa, Dengue virus
WSLRETACL

SEQ ID NO: 259878 - protein, 9 aa, Dengue virus
CYSQVNPLT

SEQ ID NO: 259879 - protein, 9 aa, Dengue virus
SVAARGYIS

SEQ ID NO: 259880 - protein, 9 aa, Dengue virus
GQLLMMRTT

SEQ ID NO: 259881 - protein, 9 aa, Dengue virus
LTIMDLHPG

SEQ ID NO: 259882 - protein, 9 aa, Dengue virus
IGKMFEATA

SEQ ID NO: 259883 - protein, 9 aa, Dengue virus
RVIQLSRKT

SEQ ID NO: 259884 - protein, 9 aa, Dengue virus
KRGDLPVWL

SEQ ID NO: 259885 - protein, 9 aa, Dengue virus
ATTVLTPML

SEQ ID NO: 259886 - protein, 9 aa, Dengue virus
YMWLGARFL

SEQ ID NO: 259887 - protein, 9 aa, Dengue virus
FMALVAFLR

SEQ ID NO: 259888 - protein, 9 aa, Dengue virus
GLHKLGYIL

SEQ ID NO: 259889 - protein, 9 aa, Dengue virus
WLAHKVASE

SEQ ID NO: 259890 - protein, 9 aa, Dengue virus
VVTTSGTYV

SEQ ID NO: 259891 - protein, 9 aa, Dengue virus
QDNQLAYVV

SEQ ID NO: 259892 - protein, 9 aa, Dengue virus
VTRSGTYVS

SEQ ID NO: 259893 - protein, 9 aa, Dengue virus
VSILASSFL

SEQ ID NO: 259894 - protein, 9 aa, Dengue virus
VMTGRSADL

SEQ ID NO: 259895 - protein, 9 aa, Dengue virus
LYAVATTVL

SEQ ID NO: 259896 - protein, 9 aa, Dengue virus
VILAGPMPV

SEQ ID NO: 259897 - skipped

SEQ ID NO: 259898 - protein, 9 aa, Dengue virus
GGLLIACYV

SEQ ID NO: 259899 - protein, 9 aa, Dengue virus
KRFSLGLLS

SEQ ID NO: 259900 - protein, 9 aa, Dengue virus
FLAIPPTAG

SEQ ID NO: 259901 - protein, 9 aa, Dengue virus
CVGISSRDF

SEQ ID NO: 259902 - protein, 9 aa, Dengue virus
IRYQTTATK

SEQ ID NO: 259903 - protein, 9 aa, Dengue virus
RSVALAPHV

SEQ ID NO: 259904 - protein, 9 aa, Dengue virus
IKDSKAVHA

SEQ ID NO: 259905 - protein, 9 aa, Dengue virus
LAAIANQAT

SEQ ID NO: 259906 - protein, 9 aa, Dengue virus
ITLATGPLS

SEQ ID NO: 259907 - protein, 9 aa, Dengue virus
PQWIAASII

SEQ ID NO: 259908 - protein, 9 aa, Dengue virus
LRWFVERNL

SEQ ID NO: 259909 - protein, 9 aa, Dengue virus
KLMSAAVKD

SEQ ID NO: 259910 - protein, 9 aa, Dengue virus
FHTMWHVTR

SEQ ID NO: 259911 - protein, 9 aa, Dengue virus
MFESTYRGA

SEQ ID NO: 259912 - protein, 9 aa, Dengue virus
IANQAAVLM

SEQ ID NO: 259913 - protein, 9 aa, Dengue virus
YIYMGQPLN

SEQ ID NO: 259914 - protein, 9 aa, Dengue virus
CYSQVNPIT

SEQ ID NO: 259915 - protein, 9 aa, Dengue virus
LMCHATFTM

SEQ ID NO: 259916 - protein, 9 aa, Dengue virus
YMATLKNVR

SEQ ID NO: 259917 - protein, 9 aa, Dengue virus
ETWMSSEGA

SEQ ID NO: 259918 - protein, 9 aa, Dengue virus
ATTIITPML

SEQ ID NO: 259919 - protein, 9 aa, Dengue virus
YRLKGESRK

SEQ ID NO: 259920 - protein, 9 aa, Dengue virus
CVTTMAQGK

SEQ ID NO: 259921 - protein, 9 aa, Dengue virus
KLMSAAVKD

SEQ ID NO: 259922 - protein, 9 aa, Dengue virus
SILASSFLR

SEQ ID NO: 259923 - protein, 9 aa, Dengue virus
WALCESITL

SEQ ID NO: 259924 - protein, 9 aa, Dengue virus
TKRILPSIV

SEQ ID NO: 259925 - protein, 9 aa, Dengue virus
LVPHVGMGL

SEQ ID NO: 259926 - protein, 9 aa, Dengue virus
LSPVRVPNY

SEQ ID NO: 259927 - protein, 9 aa, Dengue virus
YMATLKNVR

SEQ ID NO: 259928 - protein, 9 aa, Dengue virus
ISQGAGWSL

SEQ ID NO: 259929 - protein, 9 aa, Dengue virus
LGSQEGAMH

SEQ ID NO: 259930 - protein, 9 aa, Dengue virus
IGKMLEATA

SEQ ID NO: 259931 - protein, 9 aa, Dengue virus
GGLLIACYV

SEQ ID NO: 259932 - protein, 9 aa, Dengue virus
TYVSAIAQT

SEQ ID NO: 259933 - protein, 9 aa, Dengue virus
FVEGVSGGA

SEQ ID NO: 259934 - protein, 9 aa, Dengue virus
LTALNDMGK

SEQ ID NO: 259935 - protein, 9 aa, Dengue virus
AEALKGLPI

SEQ ID NO: 259936 - protein, 9 aa, Dengue virus
WLDARTYSD

SEQ ID NO: 259937 - protein, 9 aa, Dengue virus
FSLGLLSGR

SEQ ID NO: 259938 - protein, 9 aa, Dengue virus
NGVLESQML

SEQ ID NO: 259939 - protein, 9 aa, Dengue virus
LLALLGAMT

SEQ ID NO: 259940 - protein, 9 aa, Dengue virus
VRSNAAMGA

SEQ ID NO: 259941 - protein, 9 aa, Dengue virus
NRVSTVQQL

SEQ ID NO: 259942 - protein, 9 aa, Dengue virus
HEWMTTEDM

SEQ ID NO: 259943 - protein, 9 aa, Dengue virus
LTKRFSLGL

SEQ ID NO: 259944 - protein, 9 aa, Dengue virus
FGIFTTNIW

SEQ ID NO: 259945 - protein, 9 aa, Dengue virus
FQEEQGWTS

SEQ ID NO: 259946 - protein, 9 aa, Dengue virus
FGMFSTNIW

SEQ ID NO: 259947 - protein, 9 aa, Dengue virus
LVLEHGGCV

SEQ ID NO: 259948 - protein, 9 aa, Dengue virus
MWHVTRGAV

SEQ ID NO: 259949 - protein, 9 aa, Dengue virus
FVIDNVHTR

SEQ ID NO: 259950 - protein, 9 aa, Dengue virus
FLAIPPTAG

SEQ ID NO: 259951 - protein, 9 aa, Dengue virus
WLDARVYAD

SEQ ID NO: 259952 - protein, 9 aa, Dengue virus
IKDSKAVHA

SEQ ID NO: 259953 - protein, 9 aa, Dengue virus
LMGLGRGWP

SEQ ID NO: 259954 - protein, 9 aa, Dengue virus
WDVLPMVTQ

SEQ ID NO: 259955 - protein, 9 aa, Dengue virus
PLVAGGLLT

SEQ ID NO: 259956 - protein, 9 aa, Dengue virus
WKIEKASFI

SEQ ID NO: 259957 - protein, 9 aa, Dengue virus
IRSVTRLEN

SEQ ID NO: 259958 - protein, 9 aa, Dengue virus
RMAILGDTA

SEQ ID NO: 259959 - protein, 9 aa, Dengue virus
FWNTTIAVS

SEQ ID NO: 259960 - protein, 9 aa, Dengue virus
ISKMLLNRF

SEQ ID NO: 259961 - protein, 9 aa, Dengue virus
MAMTDTTPF

SEQ ID NO: 259962 - protein, 9 aa, Dengue virus
MYWVSGATG

SEQ ID NO: 259963 - protein, 9 aa, Dengue virus
QTWMSAEGA

SEQ ID NO: 259964 - protein, 9 aa, Dengue virus
LTAIANQAA

SEQ ID NO: 259965 - protein, 9 aa, Dengue virus
VRSNAALGA

SEQ ID NO: 259966 - protein, 9 aa, Dengue virus
MLQGQGPMK

SEQ ID NO: 259967 - protein, 9 aa, Dengue virus
WMTTEDMLA

SEQ ID NO: 259968 - protein, 9 aa, Dengue virus
GIVSILASS

SEQ ID NO: 259969 - protein, 9 aa, Dengue virus
ENTSANLSL

SEQ ID NO: 259970 - protein, 9 aa, Dengue virus
LRTTTVSGK

SEQ ID NO: 259971 - protein, 9 aa, Dengue virus
TWSIHAKHQ

SEQ ID NO: 259972 - protein, 9 aa, Dengue virus
FQPESPARL

SEQ ID NO: 259973 - protein, 9 aa, Dengue virus
IEEGRTLRV

SEQ ID NO: 259974 - protein, 9 aa, Dengue virus
FHTMWHVTR

SEQ ID NO: 259975 - protein, 9 aa, Dengue virus
HQWMTTEDM

SEQ ID NO: 259976 - protein, 9 aa, Dengue virus
LNTFTNMEV

SEQ ID NO: 259977 - protein, 9 aa, Dengue virus
IEESRTIRV

SEQ ID NO: 259978 - protein, 9 aa, Dengue virus
YTTMFGGVS

SEQ ID NO: 259979 - protein, 9 aa, Dengue virus
IANQAAVLM

SEQ ID NO: 259980 - protein, 9 aa, Dengue virus
LRKNGKRVI

SEQ ID NO: 259981 - protein, 9 aa, Dengue virus
LVRCPLSRN

SEQ ID NO: 259982 - protein, 9 aa, Dengue virus
RSVALVPHV

SEQ ID NO: 259983 - protein, 9 aa, Dengue virus
VSGATGNIV

SEQ ID NO: 259984 - protein, 9 aa, Dengue virus
RLLTKPWDV

SEQ ID NO: 259985 - protein, 9 aa, Dengue virus
FLAIPPTAG

SEQ ID NO: 259986 - protein, 9 aa, Dengue virus
LRGLPIRYQ

SEQ ID NO: 259987 - protein, 9 aa, Dengue virus
LRTTTVTGK

SEQ ID NO: 259988 - protein, 9 aa, Dengue virus
AYKVAAEGI

SEQ ID NO: 259989 - protein, 9 aa, Dengue virus
FGMFSTNIW

SEQ ID NO: 259990 - protein, 9 aa, Dengue virus
LYAVATTFI

SEQ ID NO: 259991 - protein, 9 aa, Dengue virus
TFVELMRRG

SEQ ID NO: 259992 - protein, 9 aa, Dengue virus
VWFVPSIKA

SEQ ID NO: 259993 - protein, 9 aa, Dengue virus
LLKNDIPMT

SEQ ID NO: 259994 - protein, 9 aa, Dengue virus
IAVSTANIF

SEQ ID NO: 259995 - protein, 9 aa, Dengue virus
FIAFLRFLT

SEQ ID NO: 259996 - protein, 9 aa, Dengue virus
CNATSAWVM

SEQ ID NO: 259997 - protein, 9 aa, Dengue virus
IYSDPLALR

SEQ ID NO: 259998 - protein, 9 aa, Dengue virus
MAVGVVSIL

SEQ ID NO: 259999 - protein, 9 aa, Dengue virus
TKRYLPAIV

SEQ ID NO: 260000 - protein, 9 aa, Dengue virus
FNMLKRERN

SEQ ID NO: 260001 - protein, 9 aa, Dengue virus
FQPESPARL

SEQ ID NO: 260002 - protein, 9 aa, Dengue virus
FQADSPSKL

SEQ ID NO: 260003 - protein, 9 aa, Dengue virus
IAACLRKSG

SEQ ID NO: 260004 - protein, 9 aa, Dengue virus
WKMERASFI

SEQ ID NO: 260005 - protein, 9 aa, Dengue virus
PKKLASAIL

SEQ ID NO: 260006 - protein, 9 aa, Dengue virus
VWFVPSIKS

SEQ ID NO: 260007 - protein, 9 aa, Dengue virus
INGVVKLLT

SEQ ID NO: 260008 - protein, 9 aa, Dengue virus
ISRMLINRF

SEQ ID NO: 260009 - protein, 9 aa, Dengue virus
EYRLKGEAR

SEQ ID NO: 260010 - protein, 9 aa, Dengue virus
LCTKAEFCK

SEQ ID NO: 260011 - protein, 9 aa, Dengue virus
IVSILASSL

SEQ ID NO: 260012 - protein, 9 aa, Dengue virus
IAMTDTTPF

SEQ ID NO: 260013 - protein, 9 aa, Dengue virus
MYWVSNASG

SEQ ID NO: 260014 - protein, 9 aa, Dengue virus
MYWVSGATG

SEQ ID NO: 260015 - protein, 9 aa, Dengue virus
LKCGSGIFV

SEQ ID NO: 260016 - protein, 9 aa, Dengue virus
VILAGPMPV

SEQ ID NO: 260017 - protein, 9 aa, Dengue virus
FRAERVIDP

SEQ ID NO: 260018 - protein, 9 aa, Dengue virus
PRWLDARVY

SEQ ID NO: 260019 - protein, 9 aa, Dengue virus
VWFVPSIKA

SEQ ID NO: 260020 - protein, 9 aa, Dengue virus
FVEGVSGGS

SEQ ID NO: 260021 - protein, 9 aa, Dengue virus
LVSLLGSSL

SEQ ID NO: 260022 - protein, 9 aa, Dengue virus
IRSATRMEN

SEQ ID NO: 260023 - protein, 9 aa, Dengue virus
LMAMDLGEM

SEQ ID NO: 260024 - protein, 9 aa, Dengue virus
FRGSYLAGA

SEQ ID NO: 260025 - protein, 9 aa, Dengue virus
IFVIDNVHT

SEQ ID NO: 260026 - protein, 9 aa, Dengue virus
RWFVERNMV

SEQ ID NO: 260027 - protein, 9 aa, Dengue virus
LAPHVGMGL

SEQ ID NO: 260028 - protein, 9 aa, Dengue virus
VVVLGSQEG

SEQ ID NO: 260029 - protein, 9 aa, Dengue virus
CLRKNGKKV

SEQ ID NO: 260030 - protein, 9 aa, Dengue virus
WCNLTSTWV

SEQ ID NO: 260031 - protein, 9 aa, Dengue virus
NEGIMAVGM

SEQ ID NO: 260032 - protein, 9 aa, Dengue virus
PHWIAASII

SEQ ID NO: 260033 - protein, 9 aa, Dengue virus
FITPMMRHT

SEQ ID NO: 260034 - protein, 9 aa, Dengue virus
WMTTEDMLA

SEQ ID NO: 260035 - protein, 9 aa, Dengue virus
LTKRFSLGL

SEQ ID NO: 260036 - protein, 9 aa, Dengue virus
WCNATSTWV

SEQ ID NO: 260037 - protein, 9 aa, Dengue virus
FHKIFMKDG

SEQ ID NO: 260038 - protein, 9 aa, Dengue virus
LSGRGPLKL

SEQ ID NO: 260039 - protein, 9 aa, Dengue virus
VVLAGPMPV

SEQ ID NO: 260040 - protein, 9 aa, Dengue virus
WSYYMATLK

SEQ ID NO: 260041 - protein, 9 aa, Dengue virus
WQLMYFHRR

SEQ ID NO: 260042 - protein, 9 aa, Dengue virus
AIANQAVVL

SEQ ID NO: 260043 - protein, 9 aa, Dengue virus
SVALAPHVG

SEQ ID NO: 260044 - protein, 9 aa, Dengue virus
VYKEGVFHT

SEQ ID NO: 260045 - protein, 9 aa, Dengue virus
DARIYADPM

SEQ ID NO: 260046 - protein, 9 aa, Dengue virus
PIRVPNYNL

SEQ ID NO: 260047 - protein, 9 aa, Dengue virus
IMKNPTVDG

SEQ ID NO: 260048 - protein, 9 aa, Dengue virus
ISQGAGWSL

SEQ ID NO: 260049 - protein, 9 aa, Dengue virus
YISTRVEMG

SEQ ID NO: 260050 - protein, 9 aa, Dengue virus
ITLATGPLS

SEQ ID NO: 260051 - protein, 9 aa, Dengue virus
AKGSRAIWY

SEQ ID NO: 260052 - protein, 9 aa, Dengue virus
LLMMRTTWA

SEQ ID NO: 260053 - protein, 9 aa, Dengue virus
FMTATPPGT

SEQ ID NO: 260054 - protein, 9 aa, Dengue virus
VVLEHGSCV

SEQ ID NO: 260055 - protein, 9 aa, Dengue virus
AVSRGSAKI

SEQ ID NO: 260056 - protein, 9 aa, Dengue virus
SYKVASAGI

SEQ ID NO: 260057 - protein, 9 aa, Dengue virus
ISQGAGWSL

SEQ ID NO: 260058 - protein, 9 aa, Dengue virus
LPVWLAYKV

SEQ ID NO: 260059 - protein, 9 aa, Dengue virus
PRWLDARVY

SEQ ID NO: 260060 - protein, 9 aa, Dengue virus
IKRKLRTLI

SEQ ID NO: 260061 - protein, 9 aa, Dengue virus
ALKGLPIRY

SEQ ID NO: 260062 - protein, 9 aa, Dengue virus
ISKMLLNRF

SEQ ID NO: 260063 - protein, 9 aa, Dengue virus
LSLAAIANQ

SEQ ID NO: 260064 - protein, 9 aa, Dengue virus
SILASALLK

SEQ ID NO: 260065 - protein, 9 aa, Dengue virus
DLRLASMAI

SEQ ID NO: 260066 - protein, 9 aa, Dengue virus
VTRSGAYVS

SEQ ID NO: 260067 - protein, 9 aa, Dengue virus
YNLIVMDEA

SEQ ID NO: 260068 - protein, 9 aa, Dengue virus
FRLRGEQRK

SEQ ID NO: 260069 - protein, 9 aa, Dengue virus
FKLTYQNKV

SEQ ID NO: 260070 - protein, 9 aa, Dengue virus
FRADRVIDP

SEQ ID NO: 260071 - protein, 9 aa, Dengue virus
EFIKKVRTN

SEQ ID NO: 260072 - protein, 9 aa, Dengue virus
YSQIGAGVY

SEQ ID NO: 260073 - protein, 9 aa, Dengue virus
FEKQLGQVM

SEQ ID NO: 260074 - protein, 9 aa, Dengue virus
FLTIPPTAG

SEQ ID NO: 260075 - protein, 9 aa, Dengue virus
VTVLGSQEG

SEQ ID NO: 260076 - protein, 9 aa, Dengue virus
LETLMLVAL

SEQ ID NO: 260077 - protein, 9 aa, Dengue virus
RVILAGPMP

SEQ ID NO: 260078 - protein, 9 aa, Dengue virus
KSYAQMWQL

SEQ ID NO: 260079 - protein, 9 aa, Dengue virus
DMLSVWNRV

SEQ ID NO: 260080 - protein, 9 aa, Dengue virus
YCGGLKNVK

SEQ ID NO: 260081 - protein, 9 aa, Dengue virus
LIGLTSRAT

SEQ ID NO: 260082 - protein, 9 aa, Dengue virus
ATFTTRLLS

SEQ ID NO: 260083 - protein, 9 aa, Dengue virus
IWYMWLGAR

SEQ ID NO: 260084 - protein, 9 aa, Dengue virus
TRVVASEMA

SEQ ID NO: 260085 - protein, 9 aa, Dengue virus
ISQGAGWSL

SEQ ID NO: 260086 - protein, 9 aa, Dengue virus
FFDLPLPWA

SEQ ID NO: 260087 - protein, 9 aa, Dengue virus
MVTFKVPHA

SEQ ID NO: 260088 - protein, 9 aa, Dengue virus
ISYGGGWRL

SEQ ID NO: 260089 - protein, 9 aa, Dengue virus
NLSLAAIAN

SEQ ID NO: 260090 - protein, 9 aa, Dengue virus
ITLATGPLS

SEQ ID NO: 260091 - protein, 9 aa, Dengue virus
IIREAIKRK

SEQ ID NO: 260092 - protein, 9 aa, Dengue virus
RLLTKPWDV

SEQ ID NO: 260093 - protein, 9 aa, Dengue virus
MGLGKGWPI

SEQ ID NO: 260094 - protein, 9 aa, Dengue virus
LMRTTWAFC

SEQ ID NO: 260095 - protein, 9 aa, Dengue virus
LTIMDLHPG

SEQ ID NO: 260096 - protein, 9 aa, Dengue virus
HWFSRGNSL

SEQ ID NO: 260097 - protein, 9 aa, Dengue virus
LRPASAWTL

SEQ ID NO: 260098 - protein, 9 aa, Dengue virus
LETLMLVAL

SEQ ID NO: 260099 - protein, 9 aa, Dengue virus
FWNTTIAVS

SEQ ID NO: 260100 - protein, 9 aa, Dengue virus
FQADSPSKL

SEQ ID NO: 260101 - protein, 9 aa, Dengue virus
YFHRRDLRL

SEQ ID NO: 260102 - protein, 9 aa, Dengue virus
FCSHHFHQL

SEQ ID NO: 260103 - protein, 9 aa, Dengue virus
TGPLVAGGL

SEQ ID NO: 260104 - protein, 9 aa, Dengue virus
LRTTTASGK

SEQ ID NO: 260105 - protein, 9 aa, Dengue virus
RSGTYVSSI

SEQ ID NO: 260106 - protein, 9 aa, Dengue virus
TTRLENVMW

SEQ ID NO: 260107 - protein, 9 aa, Dengue virus
IRYQTTAVK

SEQ ID NO: 260108 - protein, 9 aa, Dengue virus
VKEVRGFTK

SEQ ID NO: 260109 - protein, 9 aa, Dengue virus
FCSHHFHEL

SEQ ID NO: 260110 - protein, 9 aa, Dengue virus
AVNMTSKML

SEQ ID NO: 260111 - protein, 9 aa, Dengue virus
YRILQRGLL

SEQ ID NO: 260112 - protein, 9 aa, Dengue virus
CYVLSGSSA

SEQ ID NO: 260113 - protein, 9 aa, Dengue virus
VLTLATGPV

SEQ ID NO: 260114 - protein, 9 aa, Dengue virus
ILLMRTSWA

SEQ ID NO: 260115 - protein, 9 aa, Dengue virus
LLMMRTTWA

SEQ ID NO: 260116 - protein, 9 aa, Dengue virus
FHQLIMKDG

SEQ ID NO: 260117 - protein, 9 aa, Dengue virus
LAPHVGLGL

SEQ ID NO: 260118 - protein, 9 aa, Dengue virus
AVSRGSAKL

SEQ ID NO: 260119 - protein, 9 aa, Dengue virus
MRLLSPVRV

SEQ ID NO: 260120 - protein, 9 aa, Dengue virus
CLRKSGKKV

SEQ ID NO: 260121 - protein, 9 aa, Dengue virus
VRTNAAMGA

SEQ ID NO: 260122 - protein, 9 aa, Dengue virus
FTTNIWMKF

SEQ ID NO: 260123 - protein, 9 aa, Dengue virus
VREALKRRL

SEQ ID NO: 260124 - protein, 9 aa, Dengue virus
VSRGTAKLR

SEQ ID NO: 260125 - protein, 9 aa, Dengue virus
VSRGSSKLR

SEQ ID NO: 260126 - protein, 9 aa, Dengue virus
FEKQLGQIM

SEQ ID NO: 260127 - protein, 9 aa, Dengue virus
GYSQIGAGV

SEQ ID NO: 260128 - protein, 9 aa, Dengue virus
KSYAQMWQL

SEQ ID NO: 260129 - protein, 9 aa, Dengue virus
VASEMAEAL

SEQ ID NO: 260130 - protein, 9 aa, Dengue virus
WLDARTYSD

SEQ ID NO: 260131 - protein, 9 aa, Dengue virus
ILGDTAWDF

SEQ ID NO: 260132 - protein, 9 aa, Dengue virus
LRTTTASGK

SEQ ID NO: 260133 - protein, 9 aa, Dengue virus
WKLARASFI

SEQ ID NO: 260134 - protein, 9 aa, Dengue virus
TYQNKVVRV

SEQ ID NO: 260135 - protein, 9 aa, Dengue virus
LNTFTNMEV

SEQ ID NO: 260136 - protein, 9 aa, Dengue virus
LKRARNRVS

SEQ ID NO: 260137 - protein, 9 aa, Dengue virus
VQLLLMRTS

SEQ ID NO: 260138 - protein, 9 aa, Dengue virus
FSRENSLSG

SEQ ID NO: 260139 - protein, 9 aa, Dengue virus
TARGARRMA

SEQ ID NO: 260140 - protein, 9 aa, Dengue virus
FGVFSTNIW

SEQ ID NO: 260141 - protein, 9 aa, Dengue virus
MLLDNINTP

SEQ ID NO: 260142 - protein, 9 aa, Dengue virus
IRYQTTAIK

SEQ ID NO: 260143 - protein, 9 aa, Dengue virus
TYQNKVVKV

SEQ ID NO: 260144 - protein, 9 aa, Dengue virus
YRLKGEARK

SEQ ID NO: 260145 - protein, 9 aa, Dengue virus
ISQGAGWSL

SEQ ID NO: 260146 - protein, 9 aa, Dengue virus
WCNATSAWV

SEQ ID NO: 260147 - protein, 9 aa, Dengue virus
FQADSPKRL

SEQ ID NO: 260148 - protein, 9 aa, Dengue virus
PVTAASAAQ

SEQ ID NO: 260149 - protein, 9 aa, Dengue virus
VIGLYGNGV

SEQ ID NO: 260150 - protein, 9 aa, Dengue virus
ATFTTRLLS

SEQ ID NO: 260151 - protein, 9 aa, Dengue virus
VKRFSTGLL

SEQ ID NO: 260152 - protein, 9 aa, Dengue virus
ILGRSQVGV

SEQ ID NO: 260153 - protein, 9 aa, Dengue virus
FLEFEALGF

SEQ ID NO: 260154 - protein, 9 aa, Dengue virus
LRMVLAFIT

SEQ ID NO: 260155 - protein, 9 aa, Dengue virus
LRTTTASGK

SEQ ID NO: 260156 - protein, 9 aa, Dengue virus
KLLTKPWDV

SEQ ID NO: 260157 - protein, 9 aa, Dengue virus
WYGMEIRPV

SEQ ID NO: 260158 - protein, 9 aa, Dengue virus
MHSALAGAT

SEQ ID NO: 260159 - protein, 9 aa, Dengue virus
LDKGWPLHR

SEQ ID NO: 260160 - protein, 9 aa, Dengue virus
TKRILPSIV

SEQ ID NO: 260161 - protein, 9 aa, Dengue virus
IENSTANVS

SEQ ID NO: 260162 - protein, 9 aa, Dengue virus
IEESRTIRV

SEQ ID NO: 260163 - protein, 9 aa, Dengue virus
FVDLMRRGD

SEQ ID NO: 260164 - protein, 9 aa, Dengue virus
FRLRGEQRK

SEQ ID NO: 260165 - protein, 9 aa, Dengue virus
FTNMEAQLI

SEQ ID NO: 260166 - protein, 9 aa, Dengue virus
MLLDNINTP

SEQ ID NO: 260167 - protein, 9 aa, Dengue virus
FRAERVIDP

SEQ ID NO: 260168 - protein, 9 aa, Dengue virus
FLEFEALGF

SEQ ID NO: 260169 - protein, 9 aa, Dengue virus
IRYQTPAIR

SEQ ID NO: 260170 - protein, 9 aa, Dengue virus
WKMERASFI

SEQ ID NO: 260171 - protein, 9 aa, Dengue virus
VDIGVPLLA

SEQ ID NO: 260172 - protein, 9 aa, Dengue virus
FAGHLKCRL

SEQ ID NO: 260173 - protein, 9 aa, Dengue virus
FTRKVRSNA

SEQ ID NO: 260174 - protein, 9 aa, Dengue virus
MYADDTAGW

SEQ ID NO: 260175 - protein, 9 aa, Dengue virus
WMVHRQWFF

SEQ ID NO: 260176 - protein, 9 aa, Dengue virus
VKDNRAVHA

SEQ ID NO: 260177 - protein, 9 aa, Dengue virus
VKDQRAVHA

SEQ ID NO: 260178 - protein, 9 aa, Dengue virus
LRWFVERNM

SEQ ID NO: 260179 - protein, 9 aa, Dengue virus
TWSIHAHHQ

SEQ ID NO: 260180 - protein, 9 aa, Dengue virus
CIGIGNRDF

SEQ ID NO: 260181 - protein, 9 aa, Dengue virus
VVLEHGSCV

SEQ ID NO: 260182 - protein, 9 aa, Dengue virus
LTLATGPVM

SEQ ID NO: 260183 - protein, 9 aa, Dengue virus
FKTAHAKKQ

SEQ ID NO: 260184 - protein, 9 aa, Dengue virus
VILAGPIPV

SEQ ID NO: 260185 - protein, 9 aa, Dengue virus
ILGDTAWDF

SEQ ID NO: 260186 - protein, 9 aa, Dengue virus
AIANQAVVL

SEQ ID NO: 260187 - protein, 9 aa, Dengue virus
TRRYLPAMV

SEQ ID NO: 260188 - protein, 9 aa, Dengue virus
VTAASAAQR

SEQ ID NO: 260189 - protein, 9 aa, Dengue virus
IVSSVNTIS

SEQ ID NO: 260190 - protein, 9 aa, Dengue virus
ATTIITPML

SEQ ID NO: 260191 - protein, 9 aa, Dengue virus
WAFCESLTL

SEQ ID NO: 260192 - protein, 9 aa, Dengue virus
TACLGKSYA

SEQ ID NO: 260193 - protein, 9 aa, Dengue virus
TAGILKRWG

SEQ ID NO: 260194 - protein, 9 aa, Dengue virus
LKGMPIRYQ

SEQ ID NO: 260195 - protein, 9 aa, Dengue virus
FLRVLSIPP

SEQ ID NO: 260196 - protein, 9 aa, Dengue virus
CVYNMMGKR

SEQ ID NO: 260197 - protein, 9 aa, Dengue virus
SVALTPHSG

SEQ ID NO: 260198 - protein, 9 aa, Dengue virus
HWFSRGNSL

SEQ ID NO: 260199 - protein, 9 aa, Dengue virus
HKMDLGVPL

SEQ ID NO: 260200 - protein, 9 aa, Dengue virus
KRILPSIVR

SEQ ID NO: 260201 - protein, 9 aa, Dengue virus
MHSALTGAT

SEQ ID NO: 260202 - protein, 9 aa, Dengue virus
FLNDMGKVR

SEQ ID NO: 260203 - protein, 9 aa, Dengue virus
PLVAGGLLT

SEQ ID NO: 260204 - protein, 9 aa, Dengue virus
VVVLGSQEG

SEQ ID NO: 260205 - protein, 9 aa, Dengue virus
WKLARASFI

SEQ ID NO: 260206 - protein, 9 aa, Dengue virus
LILAPTRVV

SEQ ID NO: 260207 - protein, 9 aa, Dengue virus
WLVHKQWFL

SEQ ID NO: 260208 - protein, 9 aa, Dengue virus
MAKNKPTLD

SEQ ID NO: 260209 - protein, 9 aa, Dengue virus
VWFVPSIKS

SEQ ID NO: 260210 - protein, 9 aa, Dengue virus
PMATYGWNL

SEQ ID NO: 260211 - protein, 9 aa, Dengue virus
FLEFEALGF

SEQ ID NO: 260212 - protein, 9 aa, Dengue virus
DLRLASMAI

SEQ ID NO: 260213 - protein, 9 aa, Dengue virus
MYADDTAGW

SEQ ID NO: 260214 - protein, 9 aa, Dengue virus
TRKYLPAII

SEQ ID NO: 260215 - protein, 9 aa, Dengue virus
AYVMTGRSA

SEQ ID NO: 260216 - protein, 9 aa, Dengue virus
IRYQTPAVK

SEQ ID NO: 260217 - protein, 9 aa, Dengue virus
PVRVPNYNL

SEQ ID NO: 260218 - protein, 9 aa, Dengue virus
HRLMSAAIK

SEQ ID NO: 260219 - protein, 9 aa, Dengue virus
LGSQEGAMH

SEQ ID NO: 260220 - protein, 9 aa, Dengue virus
FQADSPKKL

SEQ ID NO: 260221 - protein, 9 aa, Dengue virus
GLHKLGYIL

SEQ ID NO: 260222 - protein, 9 aa, Dengue virus
FCEALTLAT

SEQ ID NO: 260223 - protein, 9 aa, Dengue virus
VILAGPMPV

SEQ ID NO: 260224 - protein, 9 aa, Dengue virus
NRVSTVQQL

SEQ ID NO: 260225 - protein, 9 aa, Dengue virus
WADVRNDMI

SEQ ID NO: 260226 - protein, 9 aa, Dengue virus
YAQMWALMY

SEQ ID NO: 260227 - protein, 9 aa, Dengue virus
PQWIASSII

SEQ ID NO: 260228 - protein, 9 aa, Dengue virus
SKMDLGVPL

SEQ ID NO: 260229 - protein, 9 aa, Dengue virus
FCSHHFHQL

SEQ ID NO: 260230 - protein, 9 aa, Dengue virus
MINGVVRLL

SEQ ID NO: 260231 - protein, 9 aa, Dengue virus
CYVLSGSSA

SEQ ID NO: 260232 - protein, 9 aa, Dengue virus
AEALKGMPI

SEQ ID NO: 260233 - protein, 9 aa, Dengue virus
VVTRSGTYV

SEQ ID NO: 260234 - protein, 9 aa, Dengue virus
LAPHVGLGL

SEQ ID NO: 260235 - protein, 9 aa, Dengue virus
LSSLLKNDV

SEQ ID NO: 260236 - protein, 9 aa, Dengue virus
ISRMLLNRF

SEQ ID NO: 260237 - protein, 9 aa, Dengue virus
NLSLTAIAN

SEQ ID NO: 260238 - protein, 9 aa, Dengue virus
IIREAIKRK

SEQ ID NO: 260239 - protein, 9 aa, Dengue virus
HRMDLGVPL

SEQ ID NO: 260240 - protein, 9 aa, Dengue virus
YQHALSELP

SEQ ID NO: 260241 - protein, 9 aa, Dengue virus
MDLGVPLLA

SEQ ID NO: 260242 - protein, 9 aa, Dengue virus
CIKVLNPYM

SEQ ID NO: 260243 - protein, 9 aa, Dengue virus
AYKVASEGF

SEQ ID NO: 260244 - protein, 9 aa, Dengue virus
TRRYLPAMV

SEQ ID NO: 260245 - protein, 9 aa, Dengue virus
MAVGLVSLL

SEQ ID NO: 260246 - protein, 9 aa, Dengue virus
CIKVLNPYM

SEQ ID NO: 260247 - protein, 9 aa, Dengue virus
WTLMYFHRR

SEQ ID NO: 260248 - protein, 9 aa, Dengue virus
MHSALTGAT

SEQ ID NO: 260249 - protein, 9 aa, Dengue virus
PMVAGGLLL

SEQ ID NO: 260250 - protein, 9 aa, Dengue virus
LLVLCAVQL

SEQ ID NO: 260251 - protein, 9 aa, Dengue virus
FKAGRVIDP

SEQ ID NO: 260252 - protein, 9 aa, Dengue virus
LIGRARISQ

SEQ ID NO: 260253 - protein, 9 aa, Dengue virus
WYGMEIRPV

SEQ ID NO: 260254 - protein, 9 aa, Dengue virus
LVSILLSSL

SEQ ID NO: 260255 - protein, 9 aa, Dengue virus
FQADSPKRL

SEQ ID NO: 260256 - protein, 9 aa, Dengue virus
MDIGVPLLA

SEQ ID NO: 260257 - protein, 9 aa, Dengue virus
DVPMAGPLV

SEQ ID NO: 260258 - protein, 9 aa, Dengue virus
WSLRETACL

SEQ ID NO: 260259 - protein, 9 aa, Dengue virus
VITLATGPL

SEQ ID NO: 260260 - protein, 9 aa, Dengue virus
DARIYADPM

SEQ ID NO: 260261 - protein, 9 aa, Dengue virus
LTSTWVTYG

SEQ ID NO: 260262 - protein, 9 aa, Dengue virus
IVSSVNMVS

SEQ ID NO: 260263 - protein, 9 aa, Dengue virus
HKMDLGVPL

SEQ ID NO: 260264 - protein, 9 aa, Dengue virus
VVGLYGNGV

SEQ ID NO: 260265 - protein, 9 aa, Dengue virus
VVLMGLGKG

SEQ ID NO: 260266 - protein, 9 aa, Dengue virus
IVSAVNMTS

SEQ ID NO: 260267 - protein, 9 aa, Dengue virus
MPVTVASAA

SEQ ID NO: 260268 - protein, 9 aa, Dengue virus
IMKDGRVLV

SEQ ID NO: 260269 - protein, 9 aa, Dengue virus
IEESRTIRV

SEQ ID NO: 260270 - protein, 9 aa, Dengue virus
PKRLASAIQ

SEQ ID NO: 260271 - protein, 9 aa, Dengue virus
ARGYISTRV

SEQ ID NO: 260272 - protein, 9 aa, Dengue virus
VIPMVTQMA

SEQ ID NO: 260273 - protein, 9 aa, Dengue virus
QRGLFGYSQ

SEQ ID NO: 260274 - protein, 9 aa, Dengue virus
LQWIASAII

SEQ ID NO: 260275 - protein, 9 aa, Dengue virus
ITLATGPLS

SEQ ID NO: 260276 - protein, 9 aa, Dengue virus
YCGGLKNVT

SEQ ID NO: 260277 - protein, 9 aa, Dengue virus
VWLSYKVAS

SEQ ID NO: 260278 - protein, 9 aa, Dengue virus
FVEGLSGAT

SEQ ID NO: 260279 - protein, 9 aa, Dengue virus
VWLAHKVAA

SEQ ID NO: 260280 - protein, 9 aa, Dengue virus
CLRKSGKKV

SEQ ID NO: 260281 - protein, 9 aa, Dengue virus
LIGLSSRAT

SEQ ID NO: 260282 - protein, 9 aa, Dengue virus
IFITDNVHT

SEQ ID NO: 260283 - protein, 9 aa, Dengue virus
CIGISNRDF

SEQ ID NO: 260284 - protein, 9 aa, Dengue virus
FVELMKRGD

SEQ ID NO: 260285 - protein, 9 aa, Dengue virus
IVSSVNTIS

SEQ ID NO: 260286 - protein, 9 aa, Dengue virus
RMAILGETA

SEQ ID NO: 260287 - protein, 9 aa, Dengue virus
VWLAHKVAA

SEQ ID NO: 260288 - protein, 9 aa, Dengue virus
HRMDIGVPL

SEQ ID NO: 260289 - protein, 9 aa, Dengue virus
FGKGSLLTC

SEQ ID NO: 260290 - protein, 9 aa, Dengue virus
CVTTIAKSK

SEQ ID NO: 260291 - protein, 9 aa, Dengue virus
GGLLIACYV

SEQ ID NO: 260292 - protein, 9 aa, Dengue virus
FCEVLTLAT

SEQ ID NO: 260293 - protein, 9 aa, Dengue virus
RKYLPAIIR

SEQ ID NO: 260294 - protein, 9 aa, Dengue virus
FQADSPKRL

SEQ ID NO: 260295 - protein, 9 aa, Dengue virus
IVLLIPEPD

SEQ ID NO: 260296 - protein, 9 aa, Dengue virus
IVSSVNMIS

SEQ ID NO: 260297 - protein, 9 aa, Dengue virus
RKKLRPRWL

SEQ ID NO: 260298 - protein, 9 aa, Dengue virus
FGMFSTNIW

SEQ ID NO: 260299 - protein, 9 aa, Dengue virus
YCAGLKKVT

SEQ ID NO: 260300 - protein, 9 aa, Dengue virus
VRTNAAIGA

SEQ ID NO: 260301 - protein, 9 aa, Dengue virus
KRSVALVPH

SEQ ID NO: 260302 - protein, 9 aa, Dengue virus
KRRLRTLIL

SEQ ID NO: 260303 - protein, 9 aa, Dengue virus
LTLATGPVM

SEQ ID NO: 260304 - protein, 9 aa, Dengue virus
LYGNGVVTK

SEQ ID NO: 260305 - protein, 9 aa, Dengue virus
FTSKVRSNA

SEQ ID NO: 260306 - protein, 9 aa, Dengue virus
SKVDIGVPL

SEQ ID NO: 260307 - protein, 9 aa, Dengue virus
HRMDIGVPL

SEQ ID NO: 260308 - protein, 9 aa, Dengue virus
FCSHHFHKI

SEQ ID NO: 260309 - protein, 9 aa, Dengue virus
WMSSEGAWK

SEQ ID NO: 260310 - protein, 9 aa, Dengue virus
TFVELMKRG

SEQ ID NO: 260311 - protein, 9 aa, Dengue virus
HHFHKIFMK

SEQ ID NO: 260312 - protein, 9 aa, Dengue virus
ILGRSQVGV

SEQ ID NO: 260313 - protein, 9 aa, Dengue virus
PLIAGGMLI

SEQ ID NO: 260314 - protein, 9 aa, Dengue virus
GLFGKGSLL

SEQ ID NO: 260315 - protein, 9 aa, Dengue virus
VRSNAAMGA

SEQ ID NO: 260316 - protein, 9 aa, Dengue virus
NGVLESQML

SEQ ID NO: 260317 - protein, 9 aa, Dengue virus
LHKLGKCGS

SEQ ID NO: 260318 - protein, 9 aa, Dengue virus
WAYHGSYEA

SEQ ID NO: 260319 - protein, 9 aa, Dengue virus
ILLMRTSWA

SEQ ID NO: 260320 - protein, 9 aa, Dengue virus
RVIQLSRKT

SEQ ID NO: 260321 - protein, 9 aa, Dengue virus
CVTTMAKNK

SEQ ID NO: 260322 - protein, 9 aa, Dengue virus
LILAPTRVV

SEQ ID NO: 260323 - protein, 9 aa, Dengue virus
LVTFKNPHA

SEQ ID NO: 260324 - protein, 9 aa, Dengue virus
IVGLYGNGV

SEQ ID NO: 260325 - protein, 9 aa, Dengue virus
EGAMHSALA

SEQ ID NO: 260326 - protein, 9 aa, Dengue virus
VWLAYKVAS

SEQ ID NO: 260327 - protein, 9 aa, Dengue virus
NRVSTPQGL

SEQ ID NO: 260328 - protein, 9 aa, Dengue virus
WMTTEDMLK

SEQ ID NO: 260329 - protein, 9 aa, Dengue virus
WLDARTYSD

SEQ ID NO: 260330 - protein, 9 aa, Dengue virus
WIESQKNGS

SEQ ID NO: 260331 - protein, 9 aa, Dengue virus
MVLLIPEPE

SEQ ID NO: 260332 - protein, 9 aa, Dengue virus
RSVALAPHV

SEQ ID NO: 260333 - protein, 9 aa, Dengue virus
WAYHGSYEV

SEQ ID NO: 260334 - protein, 9 aa, Dengue virus
MAVGVVSIL

SEQ ID NO: 260335 - protein, 9 aa, Dengue virus
DVPLAGPMV

SEQ ID NO: 260336 - protein, 9 aa, Dengue virus
ALTLATGPI

SEQ ID NO: 260337 - protein, 9 aa, Dengue virus
WDVLPMVTQ

SEQ ID NO: 260338 - protein, 9 aa, Dengue virus
MVNGVVKLL

SEQ ID NO: 260339 - protein, 9 aa, Dengue virus
IGKMFETTM

SEQ ID NO: 260340 - protein, 9 aa, Dengue virus
LTAIANQAV

SEQ ID NO: 260341 - protein, 9 aa, Dengue virus
FQADSPKRL

SEQ ID NO: 260342 - protein, 9 aa, Dengue virus
DNQLTYVVI

SEQ ID NO: 260343 - protein, 9 aa, Dengue virus
LTIMDLHPG

SEQ ID NO: 260344 - protein, 9 aa, Dengue virus
FWNTTIAVS

SEQ ID NO: 260345 - protein, 9 aa, Dengue virus
NGVLESEMI

SEQ ID NO: 260346 - protein, 9 aa, Dengue virus
MGLGKGWPI

SEQ ID NO: 260347 - protein, 9 aa, Dengue virus
ISEMGANFK

SEQ ID NO: 260348 - protein, 9 aa, Dengue virus
FSKGLFSGQ

SEQ ID NO: 260349 - protein, 9 aa, Dengue virus
IVLEHGGCV

SEQ ID NO: 260350 - protein, 9 aa, Dengue virus
LPVWLAYKV

SEQ ID NO: 260351 - protein, 9 aa, Dengue virus
VIQLSRKTF

SEQ ID NO: 260352 - protein, 9 aa, Dengue virus
FGKGSLVTC

SEQ ID NO: 260353 - protein, 9 aa, Dengue virus
LLILCASQI

SEQ ID NO: 260354 - protein, 9 aa, Dengue virus
YWIESALND

SEQ ID NO: 260355 - protein, 9 aa, Dengue virus
FEKQLGQIM

SEQ ID NO: 260356 - protein, 9 aa, Dengue virus
IFVIDNVHT

SEQ ID NO: 260357 - protein, 9 aa, Dengue virus
LILAPTRVV

SEQ ID NO: 260358 - protein, 9 aa, Dengue virus
QTWMSSEGA

SEQ ID NO: 260359 - protein, 9 aa, Dengue virus
FGKAKGSRA

SEQ ID NO: 260360 - protein, 9 aa, Dengue virus
LRPASAWTL

SEQ ID NO: 260361 - protein, 9 aa, Dengue virus
AVSRGTAKL

SEQ ID NO: 260362 - protein, 9 aa, Dengue virus
FTDPSSVAA

SEQ ID NO: 260363 - protein, 9 aa, Dengue virus
FVELMKRGD

SEQ ID NO: 260364 - protein, 9 aa, Dengue virus
RMAILGDTA

SEQ ID NO: 260365 - protein, 9 aa, Dengue virus
LLILCASQI

SEQ ID NO: 260366 - protein, 9 aa, Dengue virus
ATTIVTPML

SEQ ID NO: 260367 - protein, 9 aa, Dengue virus
MGLGRGWPI

SEQ ID NO: 260368 - protein, 9 aa, Dengue virus
YLEFEALGF

SEQ ID NO: 260369 - protein, 9 aa, Dengue virus
LPVWLAYRV

SEQ ID NO: 260370 - protein, 9 aa, Dengue virus
ITLATGPLS

SEQ ID NO: 260371 - protein, 9 aa, Dengue virus
LKRERNRVS

SEQ ID NO: 260372 - protein, 9 aa, Dengue virus
ATTFITPMM

SEQ ID NO: 260373 - protein, 9 aa, Dengue virus
WSIHATHEW

SEQ ID NO: 260374 - protein, 9 aa, Dengue virus
GHLKCRLKM

SEQ ID NO: 260375 - protein, 9 aa, Dengue virus
IFGKTQVGV

SEQ ID NO: 260376 - protein, 9 aa, Dengue virus
VGMGEAAAI

SEQ ID NO: 260377 - protein, 9 aa, Dengue virus
LNGKGPLRM

SEQ ID NO: 260378 - protein, 9 aa, Dengue virus
FSGQGPMKL

SEQ ID NO: 260379 - protein, 9 aa, Dengue virus
MHSALAGAT

SEQ ID NO: 260380 - protein, 9 aa, Dengue virus
FMALVAFLR

SEQ ID NO: 260381 - protein, 9 aa, Dengue virus
HQWMTTEDM

SEQ ID NO: 260382 - protein, 9 aa, Dengue virus
AVSRGTAKL

SEQ ID NO: 260383 - protein, 9 aa, Dengue virus
WCNLTSTWV

SEQ ID NO: 260384 - protein, 9 aa, Dengue virus
LRLASNAIC

SEQ ID NO: 260385 - protein, 9 aa, Dengue virus
YRLRGEARK

SEQ ID NO: 260386 - protein, 9 aa, Dengue virus
TTTVSGKLI

SEQ ID NO: 260387 - protein, 9 aa, Dengue virus
FWNTTIAVS

SEQ ID NO: 260388 - protein, 9 aa, Dengue virus
VWLAHKVAS

SEQ ID NO: 260389 - protein, 9 aa, Dengue virus
HRMDIGVPL

SEQ ID NO: 260390 - protein, 9 aa, Dengue virus
WSIHASHEW

SEQ ID NO: 260391 - protein, 9 aa, Dengue virus
FTGHLKCKV

SEQ ID NO: 260392 - protein, 9 aa, Dengue virus
YMWLGARYL

SEQ ID NO: 260393 - protein, 9 aa, Dengue virus
VWFVPSIKA

SEQ ID NO: 260394 - protein, 9 aa, Dengue virus
LRTTTVTGK

SEQ ID NO: 260395 - protein, 9 aa, Dengue virus
MAMTDTTPF

SEQ ID NO: 260396 - protein, 9 aa, Dengue virus
ILASSLLRN

SEQ ID NO: 260397 - protein, 9 aa, Dengue virus
TTTVSGKLI

SEQ ID NO: 260398 - protein, 9 aa, Dengue virus
CRSCTMPPL

SEQ ID NO: 260399 - protein, 9 aa, Dengue virus
VNVSLTAIA

SEQ ID NO: 260400 - protein, 9 aa, Dengue virus
WCNLTSTWV

SEQ ID NO: 260401 - protein, 9 aa, Dengue virus
MGLDKGWPL

SEQ ID NO: 260402 - protein, 9 aa, Dengue virus
IKRKLRTLI

SEQ ID NO: 260403 - protein, 9 aa, Dengue virus
MAVGVVSIL

SEQ ID NO: 260404 - protein, 9 aa, Dengue virus
FQADSPKKL

SEQ ID NO: 260405 - protein, 9 aa, Dengue virus
AHWTEAKML

SEQ ID NO: 260406 - protein, 9 aa, Dengue virus
LIGLTARAT

SEQ ID NO: 260407 - protein, 9 aa, Dengue virus
ETWMSSEGA

SEQ ID NO: 260408 - protein, 9 aa, Dengue virus
WALCEVLTL

SEQ ID NO: 260409 - protein, 9 aa, Dengue virus
ARGYISTRV

SEQ ID NO: 260410 - protein, 9 aa, Dengue virus
ITLATGPLS

SEQ ID NO: 260411 - protein, 9 aa, Dengue virus
WSYYCGGLK

SEQ ID NO: 260412 - protein, 9 aa, Dengue virus
FQPESPARV

SEQ ID NO: 260413 - protein, 9 aa, Dengue virus
FQPESPARV

SEQ ID NO: 260414 - protein, 9 aa, Dengue virus
IKQQGILGK

SEQ ID NO: 260415 - protein, 9 aa, Dengue virus
FHTMWHVTR

SEQ ID NO: 260416 - protein, 9 aa, Dengue virus
VVLEHGSCV

SEQ ID NO: 260417 - protein, 9 aa, Dengue virus
GLFGKGSLV

SEQ ID NO: 260418 - protein, 9 aa, Dengue virus
KSYAQMWTL

SEQ ID NO: 260419 - protein, 9 aa, Dengue virus
FGKAKGSRA

SEQ ID NO: 260420 - protein, 9 aa, Dengue virus
IWYMWLGAR

SEQ ID NO: 260421 - protein, 9 aa, Dengue virus
YRIKQQGIL

SEQ ID NO: 260422 - protein, 9 aa, Dengue virus
PMVAGGLLL

SEQ ID NO: 260423 - protein, 9 aa, Dengue virus
GGMLIACYV

SEQ ID NO: 260424 - protein, 9 aa, Dengue virus
MVSILASAL

SEQ ID NO: 260425 - protein, 9 aa, Dengue virus
ISNGTGNIV

SEQ ID NO: 260426 - protein, 9 aa, Dengue virus
AIANQAAVL

SEQ ID NO: 260427 - protein, 9 aa, Dengue virus
YGWNLVKLM

SEQ ID NO: 260428 - protein, 9 aa, Dengue virus
RVIQLSRKT

SEQ ID NO: 260429 - protein, 9 aa, Dengue virus
VWFVPSIKA

SEQ ID NO: 260430 - protein, 9 aa, Dengue virus
LLKNDIPMT

SEQ ID NO: 260431 - protein, 9 aa, Dengue virus
YVSAITQAE

SEQ ID NO: 260432 - protein, 9 aa, Dengue virus
VIQLSRKTF

SEQ ID NO: 260433 - protein, 9 aa, Dengue virus
NVSLAAIAN

SEQ ID NO: 260434 - protein, 9 aa, Dengue virus
YFHRRDLRL

SEQ ID NO: 260435 - protein, 9 aa, Dengue virus
LVLEHGGCV

SEQ ID NO: 260436 - protein, 9 aa, Dengue virus
FTRKVRSNA

SEQ ID NO: 260437 - protein, 9 aa, Dengue virus
WAYHGSYEV

SEQ ID NO: 260438 - protein, 9 aa, Dengue virus
FGKGGIVTC

SEQ ID NO: 260439 - protein, 9 aa, Dengue virus
YRIKQRGIL

SEQ ID NO: 260440 - protein, 9 aa, Dengue virus
VSILASSFL

SEQ ID NO: 260441 - protein, 9 aa, Dengue virus
WSIHASHEW

SEQ ID NO: 260442 - protein, 9 aa, Dengue virus
FEKQLGQVM

SEQ ID NO: 260443 - protein, 9 aa, Dengue virus
MATLKNVRE

SEQ ID NO: 260444 - protein, 9 aa, Dengue virus
DLRLASMAI

SEQ ID NO: 260445 - protein, 9 aa, Dengue virus
LTIMDLHPG

SEQ ID NO: 260446 - protein, 9 aa, Dengue virus
FQPESPARV

SEQ ID NO: 260447 - protein, 9 aa, Dengue virus
LLKNDVPLA

SEQ ID NO: 260448 - protein, 9 aa, Dengue virus
WVSNASGNI

SEQ ID NO: 260449 - protein, 9 aa, Dengue virus
FEKQLGQVM

SEQ ID NO: 260450 - protein, 9 aa, Dengue virus
KVIQLSRKT

SEQ ID NO: 260451 - protein, 9 aa, Dengue virus
NAAMGAVFT

SEQ ID NO: 260452 - protein, 9 aa, Dengue virus
YNLVIMDEA

SEQ ID NO: 260453 - protein, 9 aa, Dengue virus
LIMKDGRSL

SEQ ID NO: 260454 - protein, 9 aa, Dengue virus
IVGLYGNGV

SEQ ID NO: 260455 - protein, 9 aa, Dengue virus
HEWMTTEDM

SEQ ID NO: 260456 - protein, 9 aa, Dengue virus
NIVSSVNMI

SEQ ID NO: 260457 - protein, 9 aa, Dengue virus
LLVLCVTQV

SEQ ID NO: 260458 - protein, 9 aa, Dengue virus
NLSLTAIAN

SEQ ID NO: 260459 - protein, 9 aa, Dengue virus
WMTTEDMLS

SEQ ID NO: 260460 - protein, 9 aa, Dengue virus
PMSTYGWNL

SEQ ID NO: 260461 - protein, 9 aa, Dengue virus
CIGIGNRDF

SEQ ID NO: 260462 - protein, 9 aa, Dengue virus
MWQLMYFHR

SEQ ID NO: 260463 - protein, 9 aa, Dengue virus
LNTFTNMEA

SEQ ID NO: 260464 - protein, 9 aa, Dengue virus
MATYGWNLV

SEQ ID NO: 260465 - protein, 9 aa, Dengue virus
SKMDIGVPL

SEQ ID NO: 260466 - protein, 9 aa, Dengue virus
VILAGPIPV

SEQ ID NO: 260467 - protein, 9 aa, Dengue virus
IRVLSLVEN

SEQ ID NO: 260468 - protein, 9 aa, Dengue virus
GSQLAKRFS

SEQ ID NO: 260469 - protein, 9 aa, Dengue virus
QTWMSSEGA

SEQ ID NO: 260470 - protein, 9 aa, Dengue virus
YYCAGLKKV

SEQ ID NO: 260471 - protein, 9 aa, Dengue virus
IKAGNDIAA

SEQ ID NO: 260472 - protein, 9 aa, Dengue virus
LYAVATTII

SEQ ID NO: 260473 - protein, 9 aa, Dengue virus
IETLMLLTL

SEQ ID NO: 260474 - protein, 9 aa, Dengue virus
PLLAIGCYS

SEQ ID NO: 260475 - protein, 9 aa, Dengue virus
AEALKGLPI

SEQ ID NO: 260476 - protein, 9 aa, Dengue virus
IFITDNVHT

SEQ ID NO: 260477 - protein, 9 aa, Dengue virus
WLVHRQWFL

SEQ ID NO: 260478 - protein, 9 aa, Dengue virus
KLASAILNA

SEQ ID NO: 260479 - protein, 9 aa, Dengue virus
PETMETLLL

SEQ ID NO: 260480 - protein, 9 aa, Dengue virus
CHATFTTRL

SEQ ID NO: 260481 - protein, 9 aa, Dengue virus
NISLAAIAN

SEQ ID NO: 260482 - protein, 9 aa, Dengue virus
RSVALAPHV

SEQ ID NO: 260483 - protein, 9 aa, Dengue virus
YAIIGPGLQ

SEQ ID NO: 260484 - protein, 9 aa, Dengue virus
IANQAAILM

SEQ ID NO: 260485 - protein, 9 aa, Dengue virus
IVLEHGGCV

SEQ ID NO: 260486 - protein, 9 aa, Dengue virus
FVEGVSGGA

SEQ ID NO: 260487 - protein, 9 aa, Dengue virus
LLMRTTWAL

SEQ ID NO: 260488 - protein, 9 aa, Dengue virus
WCNATSAWV

SEQ ID NO: 260489 - protein, 9 aa, Dengue virus
YSGVEGEGL

SEQ ID NO: 260490 - protein, 9 aa, Dengue virus
WPLNEGVMA

SEQ ID NO: 260491 - protein, 9 aa, Dengue virus
LTIMDLHPG

SEQ ID NO: 260492 - protein, 9 aa, Dengue virus
RVIQLSRKT

SEQ ID NO: 260493 - protein, 9 aa, Dengue virus
ILGETAWDF

SEQ ID NO: 260494 - protein, 9 aa, Dengue virus
FESTYRGAK

SEQ ID NO: 260495 - protein, 9 aa, Dengue virus
CYVLSGSSA

SEQ ID NO: 260496 - protein, 9 aa, Dengue virus
IVASVNTTS

SEQ ID NO: 260497 - protein, 9 aa, Dengue virus
NRVSTGSQL

SEQ ID NO: 260498 - protein, 9 aa, Dengue virus
SIAARGYIS

SEQ ID NO: 260499 - protein, 9 aa, Dengue virus
LLILCASQI

SEQ ID NO: 260500 - protein, 9 aa, Dengue virus
VKEVRGFTK

SEQ ID NO: 260501 - protein, 9 aa, Dengue virus
FTSKVRSNA

SEQ ID NO: 260502 - protein, 9 aa, Dengue virus
IKTGNDIAA

SEQ ID NO: 260503 - protein, 9 aa, Dengue virus
LKCGSGIFI

SEQ ID NO: 260504 - protein, 9 aa, Dengue virus
WTLMYFHRR

SEQ ID NO: 260505 - protein, 9 aa, Dengue virus
HRMDIGVPL

SEQ ID NO: 260506 - protein, 9 aa, Dengue virus
AVSRGSAKL

SEQ ID NO: 260507 - protein, 9 aa, Dengue virus
MYWVSGATG

SEQ ID NO: 260508 - protein, 9 aa, Dengue virus
CYVITGTSA

SEQ ID NO: 260509 - protein, 9 aa, Dengue virus
YTALFSGVS

SEQ ID NO: 260510 - protein, 9 aa, Dengue virus
NEAIMAVGL

SEQ ID NO: 260511 - protein, 9 aa, Dengue virus
MLLDNIYTP

SEQ ID NO: 260512 - protein, 9 aa, Dengue virus
LMGLDKGWP

SEQ ID NO: 260513 - protein, 9 aa, Dengue virus
IRYQTTATK

SEQ ID NO: 260514 - protein, 9 aa, Dengue virus
MKMVMAFIA

SEQ ID NO: 260515 - protein, 9 aa, Dengue virus
WYGMEIRPI

SEQ ID NO: 260516 - protein, 9 aa, Dengue virus
VRTNAAMGA

SEQ ID NO: 260517 - protein, 9 aa, Dengue virus
VTYGLNTFT

SEQ ID NO: 260518 - protein, 9 aa, Dengue virus
IVSSVNMVS

SEQ ID NO: 260519 - protein, 9 aa, Dengue virus
MGLGKGWPL

SEQ ID NO: 260520 - protein, 9 aa, Dengue virus
NVSLAAIAN

SEQ ID NO: 260521 - protein, 9 aa, Dengue virus
MHSALTGAT

SEQ ID NO: 260522 - protein, 9 aa, Dengue virus
PLIAGGMLI

SEQ ID NO: 260523 - protein, 9 aa, Dengue virus
MAMTDTTPF

SEQ ID NO: 260524 - protein, 9 aa, Dengue virus
FETTMRGAK

SEQ ID NO: 260525 - protein, 9 aa, Dengue virus
FTRKVRSNA

SEQ ID NO: 260526 - protein, 9 aa, Dengue virus
YLAGAGLAF

SEQ ID NO: 260527 - protein, 9 aa, Dengue virus
SRLLINRFT

SEQ ID NO: 260528 - protein, 9 aa, Dengue virus
LTAIANQAA

SEQ ID NO: 260529 - protein, 9 aa, Dengue virus
IHMENVFHT

SEQ ID NO: 260530 - protein, 9 aa, Dengue virus
ISLAAIANQ

SEQ ID NO: 260531 - protein, 9 aa, Dengue virus
AIANQAAIL

SEQ ID NO: 260532 - protein, 9 aa, Dengue virus
VEAGRTLRV

SEQ ID NO: 260533 - protein, 9 aa, Dengue virus
IRYQTTAVK

SEQ ID NO: 260534 - protein, 9 aa, Dengue virus
LYAVATTFI

SEQ ID NO: 260535 - protein, 9 aa, Dengue virus
FHTMWHVTR

SEQ ID NO: 260536 - protein, 9 aa, Dengue virus
LTLATGPVS

SEQ ID NO: 260537 - protein, 9 aa, Dengue virus
HWIAASIIL

SEQ ID NO: 260538 - protein, 9 aa, Dengue virus
AIANQATVL

SEQ ID NO: 260539 - protein, 9 aa, Dengue virus
VVPMVTQLA

SEQ ID NO: 260540 - protein, 9 aa, Dengue virus
VWLSYKVAS

SEQ ID NO: 260541 - protein, 9 aa, Dengue virus
VIDLEPVIY

SEQ ID NO: 260542 - protein, 9 aa, Dengue virus
YAQMWSLMY

SEQ ID NO: 260543 - protein, 9 aa, Dengue virus
VYRIKQRGI

SEQ ID NO: 260544 - protein, 9 aa, Dengue virus
YQHALSELP

SEQ ID NO: 260545 - protein, 9 aa, Dengue virus
STRVPNYNL

SEQ ID NO: 260546 - protein, 9 aa, Dengue virus
TKRYLPAIV

SEQ ID NO: 260547 - protein, 9 aa, Dengue virus
FCEALTLAT

SEQ ID NO: 260548 - protein, 9 aa, Dengue virus
VIVLGSQEG

SEQ ID NO: 260549 - protein, 9 aa, Dengue virus
FQPESPARL

SEQ ID NO: 260550 - protein, 9 aa, Dengue virus
LRHSIENSS

SEQ ID NO: 260551 - protein, 9 aa, Dengue virus
WMSAEGAWR

SEQ ID NO: 260552 - protein, 9 aa, Dengue virus
WMTTEDMLA

SEQ ID NO: 260553 - protein, 9 aa, Dengue virus
YNLVVMDEA

SEQ ID NO: 260554 - protein, 9 aa, Dengue virus
IMKDGRVLV

SEQ ID NO: 260555 - protein, 9 aa, Dengue virus
CGVRSTTRL

SEQ ID NO: 260556 - protein, 9 aa, Dengue virus
VAIDLDPIS

SEQ ID NO: 260557 - protein, 9 aa, Dengue virus
MRTTWALCE

SEQ ID NO: 260558 - protein, 9 aa, Dengue virus
RVILAGPMP

SEQ ID NO: 260559 - protein, 9 aa, Dengue virus
FKAERVIDP

SEQ ID NO: 260560 - protein, 9 aa, Dengue virus
VWFVPSIKT

SEQ ID NO: 260561 - protein, 9 aa, Dengue virus
FCESLTLAT

SEQ ID NO: 260562 - protein, 9 aa, Dengue virus
LKCGNGIFV

SEQ ID NO: 260563 - protein, 9 aa, Dengue virus
WDFVVTTDI

SEQ ID NO: 260564 - protein, 9 aa, Dengue virus
MGLGKGWPL

SEQ ID NO: 260565 - protein, 9 aa, Dengue virus
WAYHGSYEV

SEQ ID NO: 260566 - protein, 9 aa, Dengue virus
MGLDKGWPI

SEQ ID NO: 260567 - protein, 9 aa, Dengue virus
LLNGKGPLR

SEQ ID NO: 260568 - protein, 9 aa, Dengue virus
QRGLFGYSQ

SEQ ID NO: 260569 - protein, 9 aa, Dengue virus
LLTLLATVT

SEQ ID NO: 260570 - protein, 9 aa, Dengue virus
ENTSANLSL

SEQ ID NO: 260571 - protein, 9 aa, Dengue virus
AKRFSRGML

SEQ ID NO: 260572 - protein, 9 aa, Dengue virus
INGVVRLLT

SEQ ID NO: 260573 - protein, 9 aa, Dengue virus
LMRTTWALC

SEQ ID NO: 260574 - protein, 9 aa, Dengue virus
CRSCTLPPL

SEQ ID NO: 260575 - protein, 9 aa, Dengue virus
ANIFRGSYL

SEQ ID NO: 260576 - protein, 9 aa, Dengue virus
LWEGNPGRF

SEQ ID NO: 260577 - protein, 9 aa, Dengue virus
FLAIPPTAG

SEQ ID NO: 260578 - protein, 9 aa, Dengue virus
CLGKAYAQM

SEQ ID NO: 260579 - protein, 9 aa, Dengue virus
WSLKETACL

SEQ ID NO: 260580 - protein, 9 aa, Dengue virus
IFVIDNVHT

SEQ ID NO: 260581 - protein, 9 aa, Dengue virus
LLALNDMGK

SEQ ID NO: 260582 - protein, 9 aa, Dengue virus
LVSILLSSL

SEQ ID NO: 260583 - protein, 9 aa, Dengue virus
ARGYISTRV

SEQ ID NO: 260584 - protein, 9 aa, Dengue virus
DLRLASMAI

SEQ ID NO: 260585 - protein, 9 aa, Dengue virus
YWIESRLND

SEQ ID NO: 260586 - protein, 9 aa, Dengue virus
HQWMTTEDM

SEQ ID NO: 260587 - protein, 9 aa, Dengue virus
VTLDFSPGT

SEQ ID NO: 260588 - protein, 9 aa, Dengue virus
ISEMGANFK

SEQ ID NO: 260589 - protein, 9 aa, Dengue virus
CVKVLNPYM

SEQ ID NO: 260590 - protein, 9 aa, Dengue virus
ETTMRGAKR

SEQ ID NO: 260591 - protein, 9 aa, Dengue virus
DVPLAGPLI

SEQ ID NO: 260592 - protein, 9 aa, Dengue virus
LASAIQKAH

SEQ ID NO: 260593 - protein, 9 aa, Dengue virus
LETLMLVAL

SEQ ID NO: 260594 - protein, 9 aa, Dengue virus
VVTTSGTYV

SEQ ID NO: 260595 - protein, 9 aa, Dengue virus
QRGLFGYSQ

SEQ ID NO: 260596 - protein, 9 aa, Dengue virus
IVSSVNMVS

SEQ ID NO: 260597 - protein, 9 aa, Dengue virus
IDLDPVVYD

SEQ ID NO: 260598 - protein, 9 aa, Dengue virus
FNMLKRARN

SEQ ID NO: 260599 - protein, 9 aa, Dengue virus
LGKGWPIHR

SEQ ID NO: 260600 - protein, 9 aa, Dengue virus
FTNMEAQLI

SEQ ID NO: 260601 - protein, 9 aa, Dengue virus
IAKSKPTLD

SEQ ID NO: 260602 - protein, 9 aa, Dengue virus
IANQATVLM

SEQ ID NO: 260603 - protein, 9 aa, Dengue virus
RKKLRPRWL

SEQ ID NO: 260604 - protein, 9 aa, Dengue virus
IETLMLLTL

SEQ ID NO: 260605 - protein, 9 aa, Dengue virus
LNTFTNMEA

SEQ ID NO: 260606 - protein, 9 aa, Dengue virus
VMAFIAFLR

SEQ ID NO: 260607 - protein, 9 aa, Dengue virus
FGSVYTTMF

SEQ ID NO: 260608 - protein, 9 aa, Dengue virus
GVFHTMWHV

SEQ ID NO: 260609 - protein, 9 aa, Dengue virus
SCTLPPLRF

SEQ ID NO: 260610 - protein, 9 aa, Dengue virus
PLKLFMALV

SEQ ID NO: 260611 - protein, 9 aa, Dengue virus
WALCEALTL

SEQ ID NO: 260612 - protein, 9 aa, Dengue virus
LAPHVGMGL

SEQ ID NO: 260613 - protein, 9 aa, Dengue virus
FSGVEGEGL

SEQ ID NO: 260614 - protein, 9 aa, Dengue virus
FSSELLSGR

SEQ ID NO: 260615 - protein, 9 aa, Dengue virus
PRRCLKPVI

SEQ ID NO: 260616 - protein, 9 aa, Dengue virus
AVVLMGLDK

SEQ ID NO: 260617 - protein, 9 aa, Dengue virus
CVTTMAKNK

SEQ ID NO: 260618 - protein, 9 aa, Dengue virus
YLEFEALGF

SEQ ID NO: 260619 - protein, 9 aa, Dengue virus
FEKQLGQIM

SEQ ID NO: 260620 - protein, 9 aa, Dengue virus
FVADNVHTR

SEQ ID NO: 260621 - protein, 9 aa, Dengue virus
MGLDKGWPL

SEQ ID NO: 260622 - protein, 9 aa, Dengue virus
IAACLRKSG

SEQ ID NO: 260623 - protein, 9 aa, Dengue virus
MVREAIRRG

SEQ ID NO: 260624 - protein, 9 aa, Dengue virus
DIPMTGPLV

SEQ ID NO: 260625 - protein, 9 aa, Dengue virus
MGLGKGWPI

SEQ ID NO: 260626 - protein, 9 aa, Dengue virus
LAAIANQAV

SEQ ID NO: 260627 - protein, 9 aa, Dengue virus
WKLEKASFI

SEQ ID NO: 260628 - protein, 9 aa, Dengue virus
LHPASAWTL

SEQ ID NO: 260629 - protein, 9 aa, Dengue virus
IFVTDNVHT

SEQ ID NO: 260630 - protein, 9 aa, Dengue virus
ALKGLPIRY

SEQ ID NO: 260631 - protein, 9 aa, Dengue virus
YWIESSKNQ

SEQ ID NO: 260632 - protein, 9 aa, Dengue virus
MGLGRGWPI

SEQ ID NO: 260633 - protein, 9 aa, Dengue virus
VITGTSADL

SEQ ID NO: 260634 - protein, 9 aa, Dengue virus
AHWTEAKML

SEQ ID NO: 260635 - protein, 9 aa, Dengue virus
AIVREALKR

SEQ ID NO: 260636 - protein, 9 aa, Dengue virus
YFHRRDLRL

SEQ ID NO: 260637 - protein, 9 aa, Dengue virus
WTLMYFHRR

SEQ ID NO: 260638 - protein, 9 aa, Dengue virus
IEESRTIRV

SEQ ID NO: 260639 - protein, 9 aa, Dengue virus
FNMLKRARN

SEQ ID NO: 260640 - protein, 9 aa, Dengue virus
VEMGEAAGI

SEQ ID NO: 260641 - protein, 9 aa, Dengue virus
PVTVASAAQ

SEQ ID NO: 260642 - protein, 9 aa, Dengue virus
MDLGVPLLA

SEQ ID NO: 260643 - protein, 9 aa, Dengue virus
CLGKSYAQM

SEQ ID NO: 260644 - protein, 9 aa, Dengue virus
FMALVAFLR

SEQ ID NO: 260645 - protein, 9 aa, Dengue virus
VIMDEAHFT

SEQ ID NO: 260646 - protein, 9 aa, Dengue virus
FGKGSLLTC

SEQ ID NO: 260647 - protein, 9 aa, Dengue virus
ILLMRTSWA

SEQ ID NO: 260648 - protein, 9 aa, Dengue virus
MLVRNPLSR

SEQ ID NO: 260649 - protein, 9 aa, Dengue virus
VVGLYGNGV

SEQ ID NO: 260650 - protein, 9 aa, Dengue virus
LVPHVGMGL

SEQ ID NO: 260651 - protein, 9 aa, Dengue virus
FESTYRGAK

SEQ ID NO: 260652 - protein, 9 aa, Dengue virus
LLLMRTSWA

SEQ ID NO: 260653 - protein, 9 aa, Dengue virus
YNLVIMDEA

SEQ ID NO: 260654 - protein, 9 aa, Dengue virus
PRWLDARIY

SEQ ID NO: 260655 - protein, 9 aa, Dengue virus
WALCEALTL

SEQ ID NO: 260656 - protein, 9 aa, Dengue virus
CYVLSGSSA

SEQ ID NO: 260657 - protein, 9 aa, Dengue virus
FHTMWHVTR

SEQ ID NO: 260658 - protein, 9 aa, Dengue virus
TRKYLPAII

SEQ ID NO: 260659 - protein, 9 aa, Dengue virus
HRMDLGVPL

SEQ ID NO: 260660 - protein, 9 aa, Dengue virus
VRSNAAIGA

SEQ ID NO: 260661 - protein, 9 aa, Dengue virus
MVREAIRRG

SEQ ID NO: 260662 - protein, 9 aa, Dengue virus
IANQAAILM

SEQ ID NO: 260663 - protein, 9 aa, Dengue virus
RVIQLSRKT

SEQ ID NO: 260664 - protein, 9 aa, Dengue virus
LIGLSSRAT

SEQ ID NO: 260665 - protein, 9 aa, Dengue virus
FCEALTLAT

SEQ ID NO: 260666 - protein, 9 aa, Dengue virus
IVREAIKRK

SEQ ID NO: 260667 - protein, 9 aa, Dengue virus
IFITNNVHT

SEQ ID NO: 260668 - protein, 9 aa, Dengue virus
ESRTIRVLS

SEQ ID NO: 260669 - protein, 9 aa, Dengue virus
MMVLLVPEP

SEQ ID NO: 260670 - protein, 9 aa, Dengue virus
LLSSTRVPN

SEQ ID NO: 260671 - protein, 9 aa, Dengue virus
CRSCTLPPL

SEQ ID NO: 260672 - protein, 9 aa, Dengue virus
YWIESSKNQ

SEQ ID NO: 260673 - protein, 9 aa, Dengue virus
WVSCGTGNI

SEQ ID NO: 260674 - protein, 9 aa, Dengue virus
LRPASAWTL

SEQ ID NO: 260675 - protein, 9 aa, Dengue virus
YSGVEGEGL

SEQ ID NO: 260676 - protein, 9 aa, Dengue virus
AVMAVGVVS

SEQ ID NO: 260677 - protein, 9 aa, Dengue virus
LPVWLSYKV

SEQ ID NO: 260678 - protein, 9 aa, Dengue virus
FLEFEALGF

SEQ ID NO: 260679 - protein, 9 aa, Dengue virus
YIYMGQPLN

SEQ ID NO: 260680 - protein, 9 aa, Dengue virus
MYWVSNASG

SEQ ID NO: 260681 - protein, 9 aa, Dengue virus
RMAILGDTA

SEQ ID NO: 260682 - protein, 9 aa, Dengue virus
FGVFTTNIW

SEQ ID NO: 260683 - protein, 9 aa, Dengue virus
TACLGKSYA

SEQ ID NO: 260684 - protein, 9 aa, Dengue virus
LLALLGAMT

SEQ ID NO: 260685 - protein, 9 aa, Dengue virus
NTTIAVSMA

SEQ ID NO: 260686 - protein, 9 aa, Dengue virus
FNMLKRERN

SEQ ID NO: 260687 - protein, 9 aa, Dengue virus
AYVSAIAQA

SEQ ID NO: 260688 - protein, 9 aa, Dengue virus
ARATWATNI

SEQ ID NO: 260689 - protein, 9 aa, Dengue virus
SYAQMWTLM

SEQ ID NO: 260690 - protein, 9 aa, Dengue virus
YRHAVEELP

SEQ ID NO: 260691 - protein, 9 aa, Dengue virus
TMAQGKPTL

SEQ ID NO: 260692 - protein, 9 aa, Dengue virus
LKRRLRTLI

SEQ ID NO: 260693 - protein, 9 aa, Dengue virus
KLGKCGSCV

SEQ ID NO: 260694 - protein, 9 aa, Dengue virus
FRAERVIDP

SEQ ID NO: 260695 - protein, 9 aa, Dengue virus
WVSNASGNI

SEQ ID NO: 260696 - protein, 9 aa, Dengue virus
SCTLPPLRY

SEQ ID NO: 260697 - protein, 9 aa, Dengue virus
YRLRGESRK

SEQ ID NO: 260698 - protein, 9 aa, Dengue virus
CRSCTLPPL

SEQ ID NO: 260699 - protein, 9 aa, Dengue virus
LLKTALLIV

SEQ ID NO: 260700 - protein, 9 aa, Dengue virus
DVPLAGPMV

SEQ ID NO: 260701 - protein, 9 aa, Dengue virus
FEKQLGQVM

SEQ ID NO: 260702 - protein, 9 aa, Dengue virus
LRLAANAIC

SEQ ID NO: 260703 - protein, 9 aa, Dengue virus
LEPGKNPRA

SEQ ID NO: 260704 - protein, 9 aa, Dengue virus
IAKNKPTLD

SEQ ID NO: 260705 - protein, 9 aa, Dengue virus
LMRTSWALC

SEQ ID NO: 260706 - protein, 9 aa, Dengue virus
LYAVATTVL

SEQ ID NO: 260707 - protein, 9 aa, Dengue virus
FIKKVRTNA

SEQ ID NO: 260708 - protein, 9 aa, Dengue virus
VTTMAQGKP

SEQ ID NO: 260709 - protein, 9 aa, Dengue virus
IRSATRMEN

SEQ ID NO: 260710 - protein, 9 aa, Dengue virus
LTAIANQAV

SEQ ID NO: 260711 - protein, 9 aa, Dengue virus
TKRILPSIV

SEQ ID NO: 260712 - protein, 9 aa, Dengue virus
AGIMKNPTV

SEQ ID NO: 260713 - protein, 9 aa, Dengue virus
VTLDFSPGT

SEQ ID NO: 260714 - protein, 9 aa, Dengue virus
IAACLRKSG

SEQ ID NO: 260715 - protein, 9 aa, Dengue virus
WQIEKASLI

SEQ ID NO: 260716 - protein, 9 aa, Dengue virus
NRVSTVQQL

SEQ ID NO: 260717 - protein, 9 aa, Dengue virus
AIANQATVL

SEQ ID NO: 260718 - protein, 9 aa, Dengue virus
FCESLTLAT

SEQ ID NO: 260719 - protein, 9 aa, Dengue virus
FKNAHAKRQ

SEQ ID NO: 260720 - protein, 9 aa, Dengue virus
IWYMWLGAR

SEQ ID NO: 260721 - protein, 9 aa, Dengue virus
FSLGLLSGR

SEQ ID NO: 260722 - protein, 9 aa, Dengue virus
CVTTMAKNK

SEQ ID NO: 260723 - protein, 9 aa, Dengue virus
FVEGVSGGA

SEQ ID NO: 260724 - protein, 9 aa, Dengue virus
LYGNGVVTT

SEQ ID NO: 260725 - protein, 9 aa, Dengue virus
VCYVLSGSS

SEQ ID NO: 260726 - protein, 9 aa, Dengue virus
LQWFVERNM

SEQ ID NO: 260727 - protein, 9 aa, Dengue virus
FIAFLRFLT

SEQ ID NO: 260728 - protein, 9 aa, Dengue virus
PVRVPNYNM

SEQ ID NO: 260729 - protein, 9 aa, Dengue virus
FKNAHAKRQ

SEQ ID NO: 260730 - protein, 9 aa, Dengue virus
IVLLIPEPD

SEQ ID NO: 260731 - protein, 9 aa, Dengue virus
FRGSYLAGA

SEQ ID NO: 260732 - protein, 9 aa, Dengue virus
VEAGRTLRV

SEQ ID NO: 260733 - protein, 9 aa, Dengue virus
FVEGLSGAT

SEQ ID NO: 260734 - protein, 9 aa, Dengue virus
FRGSYLAGA

SEQ ID NO: 260735 - protein, 9 aa, Dengue virus
LRTTTASGK

SEQ ID NO: 260736 - protein, 9 aa, Dengue virus
FTDPASIAA

SEQ ID NO: 260737 - protein, 9 aa, Dengue virus
VVPTVTQMA

SEQ ID NO: 260738 - protein, 9 aa, Dengue virus
VRSNAALGA

SEQ ID NO: 260739 - protein, 9 aa, Dengue virus
YGNGVVTRS

SEQ ID NO: 260740 - protein, 9 aa, Dengue virus
VTHASAAQR

SEQ ID NO: 260741 - protein, 9 aa, Dengue virus
WYGMEIRPL

SEQ ID NO: 260742 - protein, 9 aa, Dengue virus
LVALIAVLT

SEQ ID NO: 260743 - protein, 9 aa, Dengue virus
IGKMLEATA

SEQ ID NO: 260744 - protein, 9 aa, Dengue virus
TVSQLAKRF

SEQ ID NO: 260745 - protein, 9 aa, Dengue virus
FITPMMRHT

SEQ ID NO: 260746 - protein, 9 aa, Dengue virus
FVDLMRRGD

SEQ ID NO: 260747 - protein, 9 aa, Dengue virus
FQPESPARL

SEQ ID NO: 260748 - protein, 9 aa, Dengue virus
VEMGEAAGI

SEQ ID NO: 260749 - protein, 9 aa, Dengue virus
IVLEHGGCV

SEQ ID NO: 260750 - protein, 9 aa, Dengue virus
DVPMAGPLV

SEQ ID NO: 260751 - protein, 9 aa, Dengue virus
QDNQLTYVV

SEQ ID NO: 260752 - protein, 9 aa, Dengue virus
FCSHHFHQL

SEQ ID NO: 260753 - protein, 9 aa, Dengue virus
MMRTTWALC

SEQ ID NO: 260754 - protein, 9 aa, Dengue virus
WDYVVTTDI

SEQ ID NO: 260755 - protein, 9 aa, Dengue virus
MVSRMLLNR

SEQ ID NO: 260756 - protein, 9 aa, Dengue virus
KLLTKPWDV

SEQ ID NO: 260757 - protein, 9 aa, Dengue virus
ATARGARRM

SEQ ID NO: 260758 - protein, 9 aa, Dengue virus
WALCEALTL

SEQ ID NO: 260759 - protein, 9 aa, Dengue virus
LMRTTWALC

SEQ ID NO: 260760 - protein, 9 aa, Dengue virus
DIPMTGPLV

SEQ ID NO: 260761 - protein, 9 aa, Dengue virus
IGKMFETTM

SEQ ID NO: 260762 - protein, 9 aa, Dengue virus
VIVLGSQEG

SEQ ID NO: 260763 - protein, 9 aa, Dengue virus
HQWMTTEDM

SEQ ID NO: 260764 - protein, 9 aa, Dengue virus
RMAILGETA

SEQ ID NO: 260765 - protein, 9 aa, Dengue virus
FSGQGPMKL

SEQ ID NO: 260766 - protein, 9 aa, Dengue virus
KVIQLSRKT

SEQ ID NO: 260767 - protein, 9 aa, Dengue virus
FQPESPARV

SEQ ID NO: 260768 - protein, 9 aa, Dengue virus
CIKILNPYM

SEQ ID NO: 260769 - protein, 9 aa, Dengue virus
LQGQGPMKM

SEQ ID NO: 260770 - protein, 9 aa, Dengue virus
IFVVDNVHT

SEQ ID NO: 260771 - protein, 9 aa, Dengue virus
VTLDFSPGT

SEQ ID NO: 260772 - protein, 9 aa, Dengue virus
ISQGAGWSL

SEQ ID NO: 260773 - protein, 9 aa, Dengue virus
LLKNDVPLA

SEQ ID NO: 260774 - protein, 9 aa, Dengue virus
IRYQTTATK

SEQ ID NO: 260775 - protein, 9 aa, Dengue virus
IANQAAILM

SEQ ID NO: 260776 - protein, 9 aa, Dengue virus
VWLAHKVAA

SEQ ID NO: 260777 - protein, 9 aa, Dengue virus
LGSQEGAMH

SEQ ID NO: 260778 - protein, 9 aa, Dengue virus
FIKKVRTNA

SEQ ID NO: 260779 - protein, 9 aa, Dengue virus
LLKNDVPLA

SEQ ID NO: 260780 - protein, 9 aa, Dengue virus
LTPHSGTGL

SEQ ID NO: 260781 - protein, 9 aa, Dengue virus
GLHRLGYIL

SEQ ID NO: 260782 - protein, 9 aa, Dengue virus
WLDARVYSD

SEQ ID NO: 260783 - protein, 9 aa, Dengue virus
CYVITGTSA

SEQ ID NO: 260784 - protein, 9 aa, Dengue virus
KVIQLSRKT

SEQ ID NO: 260785 - protein, 9 aa, Dengue virus
MAMTDTTPF

SEQ ID NO: 260786 - protein, 9 aa, Dengue virus
MCTLMALDL

SEQ ID NO: 260787 - protein, 9 aa, Dengue virus
WQIEKASLI

SEQ ID NO: 260788 - protein, 9 aa, Dengue virus
MGLDKGWPI

SEQ ID NO: 260789 - protein, 9 aa, Dengue virus
DLRLAANAI

SEQ ID NO: 260790 - protein, 9 aa, Dengue virus
LRKNGKKVI

SEQ ID NO: 260791 - protein, 9 aa, Dengue virus
ILASSLLRN

SEQ ID NO: 260792 - protein, 9 aa, Dengue virus
QYVFMGEPL

SEQ ID NO: 260793 - protein, 9 aa, Dengue virus
FQPESPKRL

SEQ ID NO: 260794 - protein, 9 aa, Dengue virus
FIAFLRFLA

SEQ ID NO: 260795 - protein, 9 aa, Dengue virus
YNLVIMDEA

SEQ ID NO: 260796 - protein, 9 aa, Dengue virus
WADVRNDLI

SEQ ID NO: 260797 - protein, 9 aa, Dengue virus
NVSLAAIAN

SEQ ID NO: 260798 - protein, 9 aa, Dengue virus
FRLRGEQRK

SEQ ID NO: 260799 - protein, 9 aa, Dengue virus
TRKYLPAIV

SEQ ID NO: 260800 - protein, 9 aa, Dengue virus
SVNMVSRML

SEQ ID NO: 260801 - protein, 9 aa, Dengue virus
LVKLYSGKD

SEQ ID NO: 260802 - protein, 9 aa, Dengue virus
HVGMGLETR

SEQ ID NO: 260803 - protein, 9 aa, Dengue virus
HQWMTTEDM

SEQ ID NO: 260804 - protein, 9 aa, Dengue virus
LVKLYSGKD

SEQ ID NO: 260805 - protein, 9 aa, Dengue virus
DVPLAGPMV

SEQ ID NO: 260806 - protein, 9 aa, Dengue virus
IAVSMANIF

SEQ ID NO: 260807 - protein, 9 aa, Dengue virus
WDVVPTVTQ

SEQ ID NO: 260808 - protein, 9 aa, Dengue virus
GSQLAKRFS

SEQ ID NO: 260809 - protein, 9 aa, Dengue virus
TRVGMGEAA

SEQ ID NO: 260810 - protein, 9 aa, Dengue virus
MDIGVPLLA

SEQ ID NO: 260811 - protein, 9 aa, Dengue virus
IHMENVFHT

SEQ ID NO: 260812 - protein, 9 aa, Dengue virus
ILQRGLLGK

SEQ ID NO: 260813 - protein, 9 aa, Dengue virus
FTMRLLSPV

SEQ ID NO: 260814 - protein, 9 aa, Dengue virus
LRRMAISGD

SEQ ID NO: 260815 - protein, 9 aa, Dengue virus
WYGMEIRPL

SEQ ID NO: 260816 - protein, 9 aa, Dengue virus
WSIHATHEW

SEQ ID NO: 260817 - protein, 9 aa, Dengue virus
GAYVSAIAQ

SEQ ID NO: 260818 - protein, 9 aa, Dengue virus
VVVLGSQEG

SEQ ID NO: 260819 - protein, 9 aa, Dengue virus
IKDQRAVHA

SEQ ID NO: 260820 - protein, 9 aa, Dengue virus
LLALNDMGK

SEQ ID NO: 260821 - protein, 9 aa, Dengue virus
LKRARNRVS

SEQ ID NO: 260822 - protein, 9 aa, Dengue virus
ILASALLKN

SEQ ID NO: 260823 - protein, 9 aa, Dengue virus
MVLLIPEPE

SEQ ID NO: 260824 - protein, 9 aa, Dengue virus
IIREAIKRK

SEQ ID NO: 260825 - protein, 9 aa, Dengue virus
VWFVPSIKT

SEQ ID NO: 260826 - protein, 9 aa, Dengue virus
FGGVSWVMK

SEQ ID NO: 260827 - protein, 9 aa, Dengue virus
RLLTKPWDV

SEQ ID NO: 260828 - protein, 9 aa, Dengue virus
FVTNEVHTW

SEQ ID NO: 260829 - protein, 9 aa, Dengue virus
CYSQVNPLT

SEQ ID NO: 260830 - protein, 9 aa, Dengue virus
CVTTMAKNK

SEQ ID NO: 260831 - protein, 9 aa, Dengue virus
LLSGRGPLK

SEQ ID NO: 260832 - protein, 9 aa, Dengue virus
YCGGLKNVT

SEQ ID NO: 260833 - protein, 9 aa, Dengue virus
VSILASSFL

SEQ ID NO: 260834 - protein, 9 aa, Dengue virus
WIRDNPNMT

SEQ ID NO: 260835 - protein, 9 aa, Dengue virus
LIMKDGRSL

SEQ ID NO: 260836 - protein, 9 aa, Dengue virus
FLRVLSIPP

SEQ ID NO: 260837 - protein, 9 aa, Dengue virus
FCKKVRSNA

SEQ ID NO: 260838 - protein, 9 aa, Dengue virus
FTNMEAQLI

SEQ ID NO: 260839 - protein, 9 aa, Dengue virus
IGKMFEATA

SEQ ID NO: 260840 - protein, 9 aa, Dengue virus
YISTRVEMG

SEQ ID NO: 260841 - protein, 9 aa, Dengue virus
VTYSLNTFT

SEQ ID NO: 260842 - protein, 9 aa, Dengue virus
AGRTLRVLS

SEQ ID NO: 260843 - protein, 9 aa, Dengue virus
SRTTWSIHA

SEQ ID NO: 260844 - protein, 9 aa, Dengue virus
IVASVNTTS

SEQ ID NO: 260845 - protein, 9 aa, Dengue virus
TARGARRMA

SEQ ID NO: 260846 - protein, 9 aa, Dengue virus
YGVLFSGVS

SEQ ID NO: 260847 - protein, 9 aa, Dengue virus
RMAILGDTA

SEQ ID NO: 260848 - protein, 9 aa, Dengue virus
FQPESPARL

SEQ ID NO: 260849 - protein, 9 aa, Dengue virus
MWALMYFHR

SEQ ID NO: 260850 - protein, 9 aa, Dengue virus
LILCASQIL

SEQ ID NO: 260851 - protein, 9 aa, Dengue virus
WLVHKQWFL

SEQ ID NO: 260852 - protein, 9 aa, Dengue virus
VILAGPMPV

SEQ ID NO: 260853 - protein, 9 aa, Dengue virus
WAYHGSYEV

SEQ ID NO: 260854 - protein, 9 aa, Dengue virus
LIMKDGRSL

SEQ ID NO: 260855 - protein, 9 aa, Dengue virus
GRTLRVLKM

SEQ ID NO: 260856 - protein, 9 aa, Dengue virus
GGMLIACYV

SEQ ID NO: 260857 - protein, 9 aa, Dengue virus
MVSILASAL

SEQ ID NO: 260858 - protein, 9 aa, Dengue virus
WAYHGSYEV

SEQ ID NO: 260859 - protein, 9 aa, Dengue virus
ANIFRGSYL

SEQ ID NO: 260860 - protein, 9 aa, Dengue virus
WYGMEIRPV

SEQ ID NO: 260861 - protein, 9 aa, Dengue virus
HQWMTTEDM

SEQ ID NO: 260862 - protein, 9 aa, Dengue virus
FKAGRVIDP

SEQ ID NO: 260863 - protein, 9 aa, Dengue virus
FCSHHFHEL

SEQ ID NO: 260864 - protein, 9 aa, Dengue virus
SVALAPHVG

SEQ ID NO: 260865 - protein, 9 aa, Dengue virus
LLRNDVPLA

SEQ ID NO: 260866 - protein, 9 aa, Dengue virus
LTAIANQAT

SEQ ID NO: 260867 - protein, 9 aa, Dengue virus
YRGAKRMAI

SEQ ID NO: 260868 - protein, 9 aa, Dengue virus
FQPESPSRL

SEQ ID NO: 260869 - protein, 9 aa, Dengue virus
FCKKVRSNA

SEQ ID NO: 260870 - protein, 9 aa, Dengue virus
IANQAAILM

SEQ ID NO: 260871 - protein, 9 aa, Dengue virus
WSIHASHEW

SEQ ID NO: 260872 - protein, 9 aa, Dengue virus
CLRKNGKKV

SEQ ID NO: 260873 - protein, 9 aa, Dengue virus
YYMATLKNV

SEQ ID NO: 260874 - protein, 9 aa, Dengue virus
VWLAYKVAS

SEQ ID NO: 260875 - protein, 9 aa, Dengue virus
TTTVTGKII

SEQ ID NO: 260876 - protein, 9 aa, Dengue virus
VTYGLNTFT

SEQ ID NO: 260877 - protein, 9 aa, Dengue virus
RSVALAPHV

SEQ ID NO: 260878 - protein, 9 aa, Dengue virus
FVEGLSGAT

SEQ ID NO: 260879 - protein, 9 aa, Dengue virus
GIMAVGMVS

SEQ ID NO: 260880 - protein, 9 aa, Dengue virus
ARGYISTRV

SEQ ID NO: 260881 - protein, 9 aa, Dengue virus
LVSLLGSSL

SEQ ID NO: 260882 - protein, 9 aa, Dengue virus
CVTTIAKNK

SEQ ID NO: 260883 - protein, 9 aa, Dengue virus
PMKLVMAFI

SEQ ID NO: 260884 - protein, 9 aa, Dengue virus
YISTRVGMG

SEQ ID NO: 260885 - protein, 9 aa, Dengue virus
WSLRETACL

SEQ ID NO: 260886 - protein, 9 aa, Dengue virus
WLVHKQWFF

SEQ ID NO: 260887 - protein, 9 aa, Dengue virus
LALEPGKNP

SEQ ID NO: 260888 - protein, 9 aa, Dengue virus
LEPGKNPRA

SEQ ID NO: 260889 - protein, 9 aa, Dengue virus
PRWLDARIY

SEQ ID NO: 260890 - protein, 9 aa, Dengue virus
MGLGKGWPI

SEQ ID NO: 260891 - protein, 9 aa, Dengue virus
SVALAPHVG

SEQ ID NO: 260892 - protein, 9 aa, Dengue virus
LLTLIAVLT

SEQ ID NO: 260893 - protein, 9 aa, Dengue virus
FQPESPARV

SEQ ID NO: 260894 - protein, 9 aa, Dengue virus
WYGMEIRPV

SEQ ID NO: 260895 - protein, 9 aa, Dengue virus
FVELMKRGD

SEQ ID NO: 260896 - protein, 9 aa, Dengue virus
IVASVNTTS

SEQ ID NO: 260897 - protein, 9 aa, Dengue virus
LLNGKGPLR

SEQ ID NO: 260898 - protein, 9 aa, Dengue virus
MDIGVPLLA

SEQ ID NO: 260899 - protein, 9 aa, Dengue virus
LVTFKNPHA

SEQ ID NO: 260900 - protein, 9 aa, Dengue virus
RLLTKPWDV

SEQ ID NO: 260901 - protein, 9 aa, Dengue virus
MRGAKRMAI

SEQ ID NO: 260902 - protein, 9 aa, Dengue virus
LKGMPIRYQ

SEQ ID NO: 260903 - protein, 9 aa, Dengue virus
AGIMKNPTV

SEQ ID NO: 260904 - protein, 9 aa, Dengue virus
MWHVTRGAV

SEQ ID NO: 260905 - protein, 9 aa, Dengue virus
FLRVLSIPP

SEQ ID NO: 260906 - protein, 9 aa, Dengue virus
CGSLIGLSS

SEQ ID NO: 260907 - protein, 9 aa, Dengue virus
MAKNKPTLD

SEQ ID NO: 260908 - protein, 9 aa, Dengue virus
LMRTSWALC

SEQ ID NO: 260909 - protein, 9 aa, Dengue virus
SVALTPHSG

SEQ ID NO: 260910 - protein, 9 aa, Dengue virus
DLPVWLAYK

SEQ ID NO: 260911 - protein, 9 aa, Dengue virus
IAMTDTTPF

SEQ ID NO: 260912 - protein, 9 aa, Dengue virus
IFVIDNVHT

SEQ ID NO: 260913 - protein, 9 aa, Dengue virus
LRTTTVTGK

SEQ ID NO: 260914 - protein, 9 aa, Dengue virus
FVADNVHTW

SEQ ID NO: 260915 - protein, 9 aa, Dengue virus
MHSALTGAT

SEQ ID NO: 260916 - protein, 9 aa, Dengue virus
VILAGPIPV

SEQ ID NO: 260917 - protein, 9 aa, Dengue virus
YTPEGIIPT

SEQ ID NO: 260918 - protein, 9 aa, Dengue virus
MGLDKGWPI

SEQ ID NO: 260919 - protein, 9 aa, Dengue virus
IRYQTPAIR

SEQ ID NO: 260920 - protein, 9 aa, Dengue virus
CYSQVNPIT

SEQ ID NO: 260921 - protein, 9 aa, Dengue virus
MLLDNIYTP

SEQ ID NO: 260922 - protein, 9 aa, Dengue virus
WMTTEDMLA

SEQ ID NO: 260923 - protein, 9 aa, Dengue virus
LILAPTRVV

SEQ ID NO: 260924 - protein, 9 aa, Dengue virus
ISKMLINRF

SEQ ID NO: 260925 - protein, 9 aa, Dengue virus
KVIQLSRKT

SEQ ID NO: 260926 - protein, 9 aa, Dengue virus
LMGLGRGWP

SEQ ID NO: 260927 - protein, 9 aa, Dengue virus
WVDLVLEHG

SEQ ID NO: 260928 - protein, 9 aa, Dengue virus
LTPHSGMGL

SEQ ID NO: 260929 - protein, 9 aa, Dengue virus
FQPESPSRL

SEQ ID NO: 260930 - protein, 9 aa, Dengue virus
WMSSEGAWK

SEQ ID NO: 260931 - protein, 9 aa, Dengue virus
MDLGVPLLA

SEQ ID NO: 260932 - protein, 9 aa, Dengue virus
VLARWGTFK

SEQ ID NO: 260933 - protein, 9 aa, Dengue virus
FIAFLRFLA

SEQ ID NO: 260934 - protein, 9 aa, Dengue virus
LVTFKNPHA

SEQ ID NO: 260935 - protein, 9 aa, Dengue virus
IKRGLRTLI

SEQ ID NO: 260936 - protein, 9 aa, Dengue virus
VASEMAEAL

SEQ ID NO: 260937 - protein, 9 aa, Dengue virus
WDFVVTTDI

SEQ ID NO: 260938 - protein, 9 aa, Dengue virus
FCEVLTLAT

SEQ ID NO: 260939 - protein, 9 aa, Dengue virus
PMSTYGWNI

SEQ ID NO: 260940 - protein, 9 aa, Dengue virus
VSQGAGWSL

SEQ ID NO: 260941 - protein, 9 aa, Dengue virus
LLILCTGQL

SEQ ID NO: 260942 - protein, 9 aa, Dengue virus
LGKGWPIHK

SEQ ID NO: 260943 - protein, 9 aa, Dengue virus
AYVMTGRSA

SEQ ID NO: 260944 - protein, 9 aa, Dengue virus
SCTMPPLRF

SEQ ID NO: 260945 - protein, 9 aa, Dengue virus
IRYQTTATK

SEQ ID NO: 260946 - protein, 9 aa, Dengue virus
IKDSKAVHA

SEQ ID NO: 260947 - protein, 9 aa, Dengue virus
YETKQTGSA

SEQ ID NO: 260948 - protein, 9 aa, Dengue virus
PLKLFMALV

SEQ ID NO: 260949 - protein, 9 aa, Dengue virus
YRGAKRMAI

SEQ ID NO: 260950 - protein, 9 aa, Dengue virus
LTPMLRHSI

SEQ ID NO: 260951 - protein, 9 aa, Dengue virus
FQPESPKRL

SEQ ID NO: 260952 - protein, 9 aa, Dengue virus
PQWIASAII

SEQ ID NO: 260953 - protein, 9 aa, Dengue virus
WMTTEDMLS

SEQ ID NO: 260954 - protein, 9 aa, Dengue virus
ARGYISTRV

SEQ ID NO: 260955 - protein, 9 aa, Dengue virus
LGSQEGAMH

SEQ ID NO: 260956 - protein, 9 aa, Dengue virus
IMKNPTVDG

SEQ ID NO: 260957 - protein, 9 aa, Dengue virus
IVLEHGSCV

SEQ ID NO: 260958 - protein, 9 aa, Dengue virus
WQIEKASLI

SEQ ID NO: 260959 - protein, 9 aa, Dengue virus
YRLKGESRK

SEQ ID NO: 260960 - protein, 9 aa, Dengue virus
LTLATGPVS

SEQ ID NO: 260961 - protein, 9 aa, Dengue virus
TKRYLPAIV

SEQ ID NO: 260962 - protein, 9 aa, Dengue virus
MDIGVPLLA

SEQ ID NO: 260963 - protein, 9 aa, Dengue virus
IFVADNVHT

SEQ ID NO: 260964 - protein, 9 aa, Dengue virus
YGAAFSGVS

SEQ ID NO: 260965 - protein, 9 aa, Dengue virus
FKVPHAKKQ

SEQ ID NO: 260966 - protein, 9 aa, Dengue virus
GQLLLMRTS

SEQ ID NO: 260967 - protein, 9 aa, Dengue virus
LLRNDVPMA

SEQ ID NO: 260968 - protein, 9 aa, Dengue virus
PLKLFMAFV

SEQ ID NO: 260969 - protein, 9 aa, Dengue virus
VKLHSGVDV

SEQ ID NO: 260970 - protein, 9 aa, Dengue virus
LILAPTRVV

SEQ ID NO: 260971 - protein, 9 aa, Dengue virus
MDLGVPLLA

SEQ ID NO: 260972 - protein, 9 aa, Dengue virus
IENTSANLS

SEQ ID NO: 260973 - protein, 9 aa, Dengue virus
VILAGPIPV

SEQ ID NO: 260974 - protein, 9 aa, Dengue virus
ITPMLRHTI

SEQ ID NO: 260975 - protein, 9 aa, Dengue virus
VVGLYGNGV

SEQ ID NO: 260976 - protein, 9 aa, Dengue virus
VITGTSADL

SEQ ID NO: 260977 - protein, 9 aa, Dengue virus
PRWLDARVY

SEQ ID NO: 260978 - protein, 9 aa, Dengue virus
SKMLLNRFT

SEQ ID NO: 260979 - protein, 9 aa, Dengue virus
WKMERASFI

SEQ ID NO: 260980 - protein, 9 aa, Dengue virus
MYWVSNASG

SEQ ID NO: 260981 - protein, 9 aa, Dengue virus
MYWVSNASG

SEQ ID NO: 260982 - protein, 9 aa, Dengue virus
FLRFLTIPP

SEQ ID NO: 260983 - protein, 9 aa, Dengue virus
AGIMKNPTV

SEQ ID NO: 260984 - protein, 9 aa, Dengue virus
KLGKCGSCV

SEQ ID NO: 260985 - protein, 9 aa, Dengue virus
FIAFLRFLA

SEQ ID NO: 260986 - protein, 9 aa, Dengue virus
YRLRGESRK

SEQ ID NO: 260987 - protein, 9 aa, Dengue virus
FITNEVHTW

SEQ ID NO: 260988 - protein, 9 aa, Dengue virus
LQWIASAIV

SEQ ID NO: 260989 - protein, 9 aa, Dengue virus
ANIFRGSYL

SEQ ID NO: 260990 - protein, 9 aa, Dengue virus
FGVFTTNIW

SEQ ID NO: 260991 - protein, 9 aa, Dengue virus
MVSILASAL

SEQ ID NO: 260992 - protein, 9 aa, Dengue virus
LWEGSPGRF

SEQ ID NO: 260993 - protein, 9 aa, Dengue virus
NRVSTGSQL

SEQ ID NO: 260994 - protein, 9 aa, Dengue virus
LILCASQIL

SEQ ID NO: 260995 - protein, 9 aa, Dengue virus
IANQAAILM

SEQ ID NO: 260996 - protein, 9 aa, Dengue virus
VVVLGSQEG

SEQ ID NO: 260997 - protein, 9 aa, Dengue virus
LAAIANQAT

SEQ ID NO: 260998 - protein, 9 aa, Dengue virus
VWLAHKVAS

SEQ ID NO: 260999 - protein, 9 aa, Dengue virus
FIKKVRTNA

SEQ ID NO: 261000 - protein, 9 aa, Dengue virus
MATYGWNLV

SEQ ID NO: 261001 - protein, 9 aa, Dengue virus
IVSSVNMIS

SEQ ID NO: 261002 - protein, 9 aa, Dengue virus
SRLLINRFT

SEQ ID NO: 261003 - protein, 9 aa, Dengue virus
LKPRWLDAR

SEQ ID NO: 261004 - protein, 9 aa, Dengue virus
ENTSANLSL

SEQ ID NO: 261005 - protein, 9 aa, Dengue virus
VTVLGSQEG

SEQ ID NO: 261006 - protein, 9 aa, Dengue virus
YLPAIVREA

SEQ ID NO: 261007 - protein, 9 aa, Dengue virus
FVDLMKRGD

SEQ ID NO: 261008 - protein, 9 aa, Dengue virus
FTDPSSVAA

SEQ ID NO: 261009 - protein, 9 aa, Dengue virus
LVTFKNPHA

SEQ ID NO: 261010 - protein, 9 aa, Dengue virus
FLRFLTIPP

SEQ ID NO: 261011 - protein, 9 aa, Dengue virus
MLLDNINTP

SEQ ID NO: 261012 - protein, 9 aa, Dengue virus
TRKYLPAIV

SEQ ID NO: 261013 - protein, 9 aa, Dengue virus
LKCGSGIFV

SEQ ID NO: 261014 - protein, 9 aa, Dengue virus
IAACLRKSG

SEQ ID NO: 261015 - protein, 9 aa, Dengue virus
VLALEPGKN

SEQ ID NO: 261016 - protein, 9 aa, Dengue virus
AIANQATVL

SEQ ID NO: 261017 - protein, 9 aa, Dengue virus
MRRGDLPVW

SEQ ID NO: 261018 - protein, 9 aa, Dengue virus
LYAVATTFI

SEQ ID NO: 261019 - protein, 9 aa, Dengue virus
RVSTVSQLA

SEQ ID NO: 261020 - protein, 9 aa, Dengue virus
NEGVMAVGL

SEQ ID NO: 261021 - protein, 9 aa, Dengue virus
VILAGPIPV

SEQ ID NO: 261022 - protein, 9 aa, Dengue virus
WMTTEDMLS

SEQ ID NO: 261023 - protein, 9 aa, Dengue virus
WIASSIILE

SEQ ID NO: 261024 - protein, 9 aa, Dengue virus
ILLMRTSWA

SEQ ID NO: 261025 - protein, 9 aa, Dengue virus
PMATYGWNL

SEQ ID NO: 261026 - protein, 9 aa, Dengue virus
KRGDLPVWL

SEQ ID NO: 261027 - protein, 9 aa, Dengue virus
LGLLSGRGP

SEQ ID NO: 261028 - protein, 9 aa, Dengue virus
IRYQTTAVK

SEQ ID NO: 261029 - protein, 9 aa, Dengue virus
ISEMGANFR

SEQ ID NO: 261030 - protein, 9 aa, Dengue virus
SYAQMWALM

SEQ ID NO: 261031 - protein, 9 aa, Dengue virus
WAFCESLTL

SEQ ID NO: 261032 - protein, 9 aa, Dengue virus
AVSRGSAKL

SEQ ID NO: 261033 - protein, 9 aa, Dengue virus
CVGISSRDF

SEQ ID NO: 261034 - protein, 9 aa, Dengue virus
MWHVTRGAV

SEQ ID NO: 261035 - protein, 9 aa, Dengue virus
MRGAKRMAI

SEQ ID NO: 261036 - protein, 9 aa, Dengue virus
LVLEHGGCV

SEQ ID NO: 261037 - protein, 9 aa, Dengue virus
FQPESPARL

SEQ ID NO: 261038 - protein, 9 aa, Dengue virus
IENTSANLS

SEQ ID NO: 261039 - protein, 9 aa, Dengue virus
WMTTEDMLS

SEQ ID NO: 261040 - protein, 9 aa, Dengue virus
LVALIAVLT

SEQ ID NO: 261041 - protein, 9 aa, Dengue virus
CVTTIAKNK

SEQ ID NO: 261042 - protein, 9 aa, Dengue virus
LTAIANQAA

SEQ ID NO: 261043 - protein, 9 aa, Dengue virus
IRRGLRTLI

SEQ ID NO: 261044 - protein, 9 aa, Dengue virus
IRYQTTAIK

SEQ ID NO: 261045 - protein, 9 aa, Dengue virus
VILAGPIPV

SEQ ID NO: 261046 - protein, 9 aa, Dengue virus
CYVITGTSA

SEQ ID NO: 261047 - protein, 9 aa, Dengue virus
IEESRTIRV

SEQ ID NO: 261048 - protein, 9 aa, Dengue virus
AAFSGVSWI

SEQ ID NO: 261049 - protein, 9 aa, Dengue virus
KRFSKGLFS

SEQ ID NO: 261050 - protein, 9 aa, Dengue virus
MDIGVPLLA

SEQ ID NO: 261051 - protein, 9 aa, Dengue virus
VWFVPSIKT

SEQ ID NO: 261052 - protein, 9 aa, Dengue virus
FMTATPPGT

SEQ ID NO: 261053 - protein, 9 aa, Dengue virus
FEKQLGQVM

SEQ ID NO: 261054 - protein, 9 aa, Dengue virus
ILGETAWDF

SEQ ID NO: 261055 - protein, 9 aa, Dengue virus
ENTTANISL

SEQ ID NO: 261056 - protein, 9 aa, Dengue virus
EGRTLRVLK

SEQ ID NO: 261057 - protein, 9 aa, Dengue virus
FWNTTIAVS

SEQ ID NO: 261058 - protein, 9 aa, Dengue virus
WMTTEDMLS

SEQ ID NO: 261059 - protein, 9 aa, Dengue virus
FRADRVIDP

SEQ ID NO: 261060 - protein, 9 aa, Dengue virus
IFITDNVHT

SEQ ID NO: 261061 - protein, 9 aa, Dengue virus
LRTTTVSGK

SEQ ID NO: 261062 - protein, 9 aa, Dengue virus
CIKVLNPYM

SEQ ID NO: 261063 - protein, 9 aa, Dengue virus
WIASSIILE

SEQ ID NO: 261064 - protein, 9 aa, Dengue virus
CHATFTTRL

SEQ ID NO: 261065 - protein, 9 aa, Dengue virus
VTHSSAAQR

SEQ ID NO: 261066 - protein, 9 aa, Dengue virus
VIGLYGNGV

SEQ ID NO: 261067 - protein, 9 aa, Dengue virus
ISYGGGWRF

SEQ ID NO: 261068 - protein, 9 aa, Dengue virus
LTAIANQAT

SEQ ID NO: 261069 - protein, 9 aa, Dengue virus
PESLETLML

SEQ ID NO: 261070 - protein, 9 aa, Dengue virus
IDLDPVVYD

SEQ ID NO: 261071 - protein, 9 aa, Dengue virus
FEKQLGQVM

SEQ ID NO: 261072 - protein, 9 aa, Dengue virus
IKDQRAVHA

SEQ ID NO: 261073 - protein, 9 aa, Dengue virus
FLRFLTIPP

SEQ ID NO: 261074 - protein, 9 aa, Dengue virus
IVSILASSL

SEQ ID NO: 261075 - protein, 9 aa, Dengue virus
WAYHGSYEA

SEQ ID NO: 261076 - protein, 9 aa, Dengue virus
LIMKDGRSL

SEQ ID NO: 261077 - protein, 9 aa, Dengue virus
LTLATGPIL

SEQ ID NO: 261078 - protein, 9 aa, Dengue virus
AYKVASEGI

SEQ ID NO: 261079 - protein, 9 aa, Dengue virus
IRYQTTAVK

SEQ ID NO: 261080 - protein, 9 aa, Dengue virus
NAALGAVFT

SEQ ID NO: 261081 - protein, 9 aa, Dengue virus
LILAPTRVV

SEQ ID NO: 261082 - protein, 9 aa, Dengue virus
FETTMRGAK

SEQ ID NO: 261083 - protein, 9 aa, Dengue virus
LLILCTGQL

SEQ ID NO: 261084 - protein, 9 aa, Dengue virus
FCSHHFHKI

SEQ ID NO: 261085 - protein, 9 aa, Dengue virus
YRLRGEQRK

SEQ ID NO: 261086 - protein, 9 aa, Dengue virus
TYQNKVVRV

SEQ ID NO: 261087 - protein, 9 aa, Dengue virus
YAVATTVLT

SEQ ID NO: 261088 - protein, 9 aa, Dengue virus
MATYGWNLV

SEQ ID NO: 261089 - protein, 9 aa, Dengue virus
FITPMLRHS

SEQ ID NO: 261090 - protein, 9 aa, Dengue virus
LLLMRTSWA

SEQ ID NO: 261091 - protein, 9 aa, Dengue virus
RMAILGDTA

SEQ ID NO: 261092 - protein, 9 aa, Dengue virus
YFHRRDLRL

SEQ ID NO: 261093 - protein, 9 aa, Dengue virus
GYSQIGAGV

SEQ ID NO: 261094 - protein, 9 aa, Dengue virus
INGVVRLLT

SEQ ID NO: 261095 - protein, 9 aa, Dengue virus
CYVLSGSSA

SEQ ID NO: 261096 - protein, 9 aa, Dengue virus
AEALKGLPI

SEQ ID NO: 261097 - protein, 9 aa, Dengue virus
CYVLSGSSA

SEQ ID NO: 261098 - protein, 9 aa, Dengue virus
MVLLIPEPE

SEQ ID NO: 261099 - protein, 9 aa, Dengue virus
IRYQTPAIR

SEQ ID NO: 261100 - protein, 9 aa, Dengue virus
WCNATSTWV

SEQ ID NO: 261101 - protein, 9 aa, Dengue virus
VVPMVTQLA

SEQ ID NO: 261102 - protein, 9 aa, Dengue virus
KVIQLSRKT

SEQ ID NO: 261103 - protein, 9 aa, Dengue virus
WSLMYFHRR

SEQ ID NO: 261104 - protein, 9 aa, Dengue virus
YRLRGESRK

SEQ ID NO: 261105 - protein, 9 aa, Dengue virus
TRRYLPAMV

SEQ ID NO: 261106 - protein, 9 aa, Dengue virus
LWEGNPGKF

SEQ ID NO: 261107 - protein, 9 aa, Dengue virus
LQGQGPMKM

SEQ ID NO: 261108 - protein, 9 aa, Dengue virus
IVASVNTTS

SEQ ID NO: 261109 - protein, 9 aa, Dengue virus
LETLMLVAL

SEQ ID NO: 261110 - protein, 9 aa, Dengue virus
TIETLMLLT

SEQ ID NO: 261111 - protein, 9 aa, Dengue virus
AVSRGSAKI

SEQ ID NO: 261112 - protein, 9 aa, Dengue virus
AEALKGMPI

SEQ ID NO: 261113 - protein, 9 aa, Dengue virus
LNTFTNMEV

SEQ ID NO: 261114 - protein, 9 aa, Dengue virus
KRFSKGLFS

SEQ ID NO: 261115 - protein, 9 aa, Dengue virus
FKLTYQNKV

SEQ ID NO: 261116 - protein, 9 aa, Dengue virus
WNLVKLHSG

SEQ ID NO: 261117 - protein, 9 aa, Dengue virus
WYGMEIRPI

SEQ ID NO: 261118 - protein, 9 aa, Dengue virus
LGSQEGAMR

SEQ ID NO: 261119 - protein, 9 aa, Dengue virus
FHTMWHVTR

SEQ ID NO: 261120 - protein, 9 aa, Dengue virus
VLPMVTQIA

SEQ ID NO: 261121 - protein, 9 aa, Dengue virus
ILARWGSFK

SEQ ID NO: 261122 - protein, 9 aa, Dengue virus
FIKKVRTNA

SEQ ID NO: 261123 - protein, 9 aa, Dengue virus
ILASALLKN

SEQ ID NO: 261124 - protein, 9 aa, Dengue virus
LTLATGPIL

SEQ ID NO: 261125 - protein, 9 aa, Dengue virus
YGNGVVTTS

SEQ ID NO: 261126 - protein, 9 aa, Dengue virus
LVPHVGMGL

SEQ ID NO: 261127 - protein, 9 aa, Dengue virus
IFVADNVHT

SEQ ID NO: 261128 - protein, 9 aa, Dengue virus
LLMMRTTWA

SEQ ID NO: 261129 - protein, 9 aa, Dengue virus
VDIGVPLLA

SEQ ID NO: 261130 - protein, 9 aa, Dengue virus
IRQMESEGI

SEQ ID NO: 261131 - protein, 9 aa, Dengue virus
FCSHHFHQL

SEQ ID NO: 261132 - protein, 9 aa, Dengue virus
WSLRETACL

SEQ ID NO: 261133 - protein, 9 aa, Dengue virus
LKCGSGIFV

SEQ ID NO: 261134 - protein, 9 aa, Dengue virus
ATTIVTPML

SEQ ID NO: 261135 - protein, 9 aa, Dengue virus
MATYGWNLV

SEQ ID NO: 261136 - protein, 9 aa, Dengue virus
VVPMVTQLA

SEQ ID NO: 261137 - protein, 9 aa, Dengue virus
WSGVEGEGL

SEQ ID NO: 261138 - protein, 9 aa, Dengue virus
WIASAIVLE

SEQ ID NO: 261139 - protein, 9 aa, Dengue virus
KLMSAAIKD

SEQ ID NO: 261140 - protein, 9 aa, Dengue virus
ILEVDRTLA

SEQ ID NO: 261141 - protein, 9 aa, Dengue virus
VWFVPSIKT

SEQ ID NO: 261142 - protein, 9 aa, Dengue virus
VILAGPMPV

SEQ ID NO: 261143 - protein, 9 aa, Dengue virus
YNHALNELP

SEQ ID NO: 261144 - protein, 9 aa, Dengue virus
AKRFSRGML

SEQ ID NO: 261145 - protein, 9 aa, Dengue virus
VTVLGSQEG

SEQ ID NO: 261146 - protein, 9 aa, Dengue virus
TKRILPSIV

SEQ ID NO: 261147 - protein, 9 aa, Dengue virus
IWYMWLGAR

SEQ ID NO: 261148 - protein, 9 aa, Dengue virus
MGLDKGWPI

SEQ ID NO: 261149 - protein, 9 aa, Dengue virus
LAAIANQAA

SEQ ID NO: 261150 - protein, 9 aa, Dengue virus
YGWNLVRLQ

SEQ ID NO: 261151 - protein, 9 aa, Dengue virus
YRLKGEARK

SEQ ID NO: 261152 - protein, 9 aa, Dengue virus
DARIYSDPL

SEQ ID NO: 261153 - protein, 9 aa, Dengue virus
VKEVRGFTK

SEQ ID NO: 261154 - protein, 9 aa, Dengue virus
YSGVEGEGL

SEQ ID NO: 261155 - protein, 9 aa, Dengue virus
TYVSAITQA

SEQ ID NO: 261156 - protein, 9 aa, Dengue virus
DVPMAGPLV

SEQ ID NO: 261157 - protein, 9 aa, Dengue virus
LVMKDGRKL

SEQ ID NO: 261158 - protein, 9 aa, Dengue virus
FKLTYQNKV

SEQ ID NO: 261159 - protein, 9 aa, Dengue virus
IAVSTANIF

SEQ ID NO: 261160 - protein, 9 aa, Dengue virus
GCYSQVNPI

SEQ ID NO: 261161 - protein, 9 aa, Dengue virus
LVTFKTAHA

SEQ ID NO: 261162 - protein, 9 aa, Dengue virus
IENTSANLS

SEQ ID NO: 261163 - protein, 9 aa, Dengue virus
YISTRVGMG

SEQ ID NO: 261164 - protein, 9 aa, Dengue virus
PVRVPNYNL

SEQ ID NO: 261165 - protein, 9 aa, Dengue virus
VITGTSADL

SEQ ID NO: 261166 - protein, 9 aa, Dengue virus
FTRKVRSNA

SEQ ID NO: 261167 - protein, 9 aa, Dengue virus
IEESRTIRV

SEQ ID NO: 261168 - protein, 9 aa, Dengue virus
FHTMWHVTR

SEQ ID NO: 261169 - protein, 9 aa, Dengue virus
FTNMEVQLI

SEQ ID NO: 261170 - protein, 9 aa, Dengue virus
IENTTANIS

SEQ ID NO: 261171 - protein, 9 aa, Dengue virus
VILAGPMPV

SEQ ID NO: 261172 - protein, 9 aa, Dengue virus
RSVALVPHV

SEQ ID NO: 261173 - protein, 9 aa, Dengue virus
VLPMVTQIA

SEQ ID NO: 261174 - protein, 9 aa, Dengue virus
SMVNGVVRL

SEQ ID NO: 261175 - protein, 9 aa, Dengue virus
VVLAGPMPV

SEQ ID NO: 261176 - protein, 9 aa, Dengue virus
CGIRSTTRL

SEQ ID NO: 261177 - protein, 9 aa, Dengue virus
LLILCTGQL

SEQ ID NO: 261178 - protein, 9 aa, Dengue virus
MGLDKGWPL

SEQ ID NO: 261179 - protein, 9 aa, Dengue virus
YRLRGEARK

SEQ ID NO: 261180 - protein, 9 aa, Dengue virus
IWYMWLGAR

SEQ ID NO: 261181 - protein, 9 aa, Dengue virus
MRGAKRMAI

SEQ ID NO: 261182 - protein, 9 aa, Dengue virus
FTSKVRSNA

SEQ ID NO: 261183 - protein, 9 aa, Dengue virus
WVSNASGNI

SEQ ID NO: 261184 - protein, 9 aa, Dengue virus
IFITDNVHT

SEQ ID NO: 261185 - protein, 9 aa, Dengue virus
LVHKQWFLN

SEQ ID NO: 261186 - protein, 9 aa, Dengue virus
LILAPTRVV

SEQ ID NO: 261187 - protein, 9 aa, Dengue virus
GRSQVGVGI

SEQ ID NO: 261188 - protein, 9 aa, Dengue virus
LDKGWPLHR

SEQ ID NO: 261189 - protein, 9 aa, Dengue virus
FGKAKGSRA

SEQ ID NO: 261190 - protein, 9 aa, Dengue virus
FWNTTIAVS

SEQ ID NO: 261191 - protein, 9 aa, Dengue virus
YAVATTFIT

SEQ ID NO: 261192 - protein, 9 aa, Dengue virus
VILAGPIPV

SEQ ID NO: 261193 - protein, 9 aa, Dengue virus
SVALVPHVG

SEQ ID NO: 261194 - protein, 9 aa, Dengue virus
WSYYMATLK

SEQ ID NO: 261195 - protein, 9 aa, Dengue virus
WLAHKVASE

SEQ ID NO: 261196 - protein, 9 aa, Dengue virus
LRPASAWTL

SEQ ID NO: 261197 - protein, 9 aa, Dengue virus
IVASVNTTS

SEQ ID NO: 261198 - protein, 9 aa, Dengue virus
WLAYKVASE

SEQ ID NO: 261199 - protein, 9 aa, Dengue virus
TRLLSSTRV

SEQ ID NO: 261200 - protein, 9 aa, Dengue virus
MGLDKGWPL

SEQ ID NO: 261201 - protein, 9 aa, Dengue virus
IRYQTPAVK

SEQ ID NO: 261202 - protein, 9 aa, Dengue virus
FWNTTIAVS

SEQ ID NO: 261203 - protein, 9 aa, Dengue virus
AKRFSRGML

SEQ ID NO: 261204 - protein, 9 aa, Dengue virus
MRLLSPVRV

SEQ ID NO: 261205 - protein, 9 aa, Dengue virus
WIESQKNGS

SEQ ID NO: 261206 - protein, 9 aa, Dengue virus
LRPASAWTL

SEQ ID NO: 261207 - protein, 9 aa, Dengue virus
FGKAKGSRA

SEQ ID NO: 261208 - protein, 9 aa, Dengue virus
PMKMVMAFI

SEQ ID NO: 261209 - protein, 9 aa, Dengue virus
VEAGRTLRV

SEQ ID NO: 261210 - protein, 9 aa, Dengue virus
YISTRVGMG

SEQ ID NO: 261211 - protein, 9 aa, Dengue virus
VNGVVKLLT

SEQ ID NO: 261212 - protein, 9 aa, Dengue virus
HQWMTTEDM

SEQ ID NO: 261213 - protein, 9 aa, Dengue virus
MGLGRGWPI

SEQ ID NO: 261214 - protein, 9 aa, Dengue virus
IRRGLRTLI

SEQ ID NO: 261215 - protein, 9 aa, Dengue virus
IFMTATPPG

SEQ ID NO: 261216 - protein, 9 aa, Dengue virus
ILLMRTSWA

SEQ ID NO: 261217 - protein, 9 aa, Dengue virus
LKRARNRVS

SEQ ID NO: 261218 - protein, 9 aa, Dengue virus
YSQVNPLTL

SEQ ID NO: 261219 - protein, 9 aa, Dengue virus
IKDSKAVHA

SEQ ID NO: 261220 - protein, 9 aa, Dengue virus
PIRVPNYNL

SEQ ID NO: 261221 - protein, 9 aa, Dengue virus
YSQVNPTTL

SEQ ID NO: 261222 - protein, 9 aa, Dengue virus
AVSMANIFR

SEQ ID NO: 261223 - protein, 9 aa, Dengue virus
KVRMEKLRI

SEQ ID NO: 261224 - protein, 9 aa, Dengue virus
MSAAIKDQR

SEQ ID NO: 261225 - protein, 9 aa, Dengue virus
VWFVPSIKS

SEQ ID NO: 261226 - protein, 9 aa, Dengue virus
TMAKNKPTL

SEQ ID NO: 261227 - protein, 9 aa, Dengue virus
MGLGKGWPI

SEQ ID NO: 261228 - protein, 9 aa, Dengue virus
LAAIANQAV

SEQ ID NO: 261229 - protein, 9 aa, Dengue virus
PQWIAASII

SEQ ID NO: 261230 - protein, 9 aa, Dengue virus
IFVVDNVHT

SEQ ID NO: 261231 - protein, 9 aa, Dengue virus
PMSTYGWNL

SEQ ID NO: 261232 - protein, 9 aa, Dengue virus
YAQMWSLMY

SEQ ID NO: 261233 - protein, 9 aa, Dengue virus
LRTTTVSGK

SEQ ID NO: 261234 - protein, 9 aa, Dengue virus
VKATGSASS

SEQ ID NO: 261235 - protein, 9 aa, Dengue virus
WCNATSTWV

SEQ ID NO: 261236 - protein, 9 aa, Dengue virus
VLTLATGPV

SEQ ID NO: 261237 - protein, 9 aa, Dengue virus
VNTTSRLLL

SEQ ID NO: 261238 - protein, 9 aa, Dengue virus
FTRKVRSNA

SEQ ID NO: 261239 - protein, 9 aa, Dengue virus
IAKNKPTLD

SEQ ID NO: 261240 - protein, 9 aa, Dengue virus
LTIMDLHPG

SEQ ID NO: 261241 - protein, 9 aa, Dengue virus
VEAGRTLRV

SEQ ID NO: 261242 - protein, 9 aa, Dengue virus
LLRNDVPLA

SEQ ID NO: 261243 - protein, 9 aa, Dengue virus
CHATFTMRL

SEQ ID NO: 261244 - protein, 9 aa, Dengue virus
WQIEKASLI

SEQ ID NO: 261245 - protein, 9 aa, Dengue virus
YAQMWALMY

SEQ ID NO: 261246 - protein, 9 aa, Dengue virus
IKRKLRTLV

SEQ ID NO: 261247 - protein, 9 aa, Dengue virus
LLRNDVPMA

SEQ ID NO: 261248 - protein, 9 aa, Dengue virus
ARGYISTRV

SEQ ID NO: 261249 - protein, 9 aa, Dengue virus
FHTMWHVTR

SEQ ID NO: 261250 - protein, 9 aa, Dengue virus
LLKNDVPLA

SEQ ID NO: 261251 - protein, 9 aa, Dengue virus
FCSHHFHQL

SEQ ID NO: 261252 - protein, 9 aa, Dengue virus
VWLAHKVAS

SEQ ID NO: 261253 - protein, 9 aa, Dengue virus
FTNMEAQLI

SEQ ID NO: 261254 - protein, 9 aa, Dengue virus
LFSGVSWTM

SEQ ID NO: 261255 - protein, 9 aa, Dengue virus
LQWIASAIV

SEQ ID NO: 261256 - protein, 9 aa, Dengue virus
WMTTEDMLS

SEQ ID NO: 261257 - protein, 9 aa, Dengue virus
FEKQLGQVM

SEQ ID NO: 261258 - protein, 9 aa, Dengue virus
IYRIKQKGI

SEQ ID NO: 261259 - protein, 9 aa, Dengue virus
IRYQTPAVK

SEQ ID NO: 261260 - protein, 9 aa, Dengue virus
HEWMTTEDM

SEQ ID NO: 261261 - protein, 9 aa, Dengue virus
LLLMRTSWA

SEQ ID NO: 261262 - protein, 9 aa, Dengue virus
IKRKLRTLI

SEQ ID NO: 261263 - protein, 9 aa, Dengue virus
LQWIASAII

SEQ ID NO: 261264 - protein, 9 aa, Dengue virus
LRKSGKRVI

SEQ ID NO: 261265 - protein, 9 aa, Dengue virus
SVALAPHVG

SEQ ID NO: 261266 - protein, 9 aa, Dengue virus
YVLSGSSAD

SEQ ID NO: 261267 - protein, 9 aa, Dengue virus
LRKSGKRVI

SEQ ID NO: 261268 - protein, 9 aa, Dengue virus
MRTTWALCE

SEQ ID NO: 261269 - protein, 9 aa, Dengue virus
WCNATSAWV

SEQ ID NO: 261270 - protein, 9 aa, Dengue virus
IANQATVLM

SEQ ID NO: 261271 - protein, 9 aa, Dengue virus
YSQVNPLTL

SEQ ID NO: 261272 - protein, 9 aa, Dengue virus
FEATARGAR

SEQ ID NO: 261273 - protein, 9 aa, Dengue virus
RVIQLSRKT

SEQ ID NO: 261274 - protein, 9 aa, Dengue virus
YKFQPESPA

SEQ ID NO: 261275 - protein, 9 aa, Dengue virus
FQADSPKRL

SEQ ID NO: 261276 - protein, 9 aa, Dengue virus
LILAPTRVV

SEQ ID NO: 261277 - protein, 9 aa, Dengue virus
LTLATGPVS

SEQ ID NO: 261278 - protein, 9 aa, Dengue virus
FGRAKGSRA

SEQ ID NO: 261279 - protein, 9 aa, Dengue virus
IHMENVFHT

SEQ ID NO: 261280 - protein, 9 aa, Dengue virus
LQWIASAIV

SEQ ID NO: 261281 - protein, 9 aa, Dengue virus
VRTNAAIGA

SEQ ID NO: 261282 - protein, 9 aa, Dengue virus
QTWMSSEGA

SEQ ID NO: 261283 - protein, 9 aa, Dengue virus
AYKVAAEGI

SEQ ID NO: 261284 - protein, 9 aa, Dengue virus
LNTFTNMEV

SEQ ID NO: 261285 - protein, 9 aa, Dengue virus
INKVRSNAA

SEQ ID NO: 261286 - protein, 9 aa, Dengue virus
KRFSLGLLS

SEQ ID NO: 261287 - protein, 9 aa, Dengue virus
WNTTIAVST

SEQ ID NO: 261288 - protein, 9 aa, Dengue virus
LTAIANQAV

SEQ ID NO: 261289 - protein, 9 aa, Dengue virus
ITPMLRHTI

SEQ ID NO: 261290 - protein, 9 aa, Dengue virus
MGLGKGWPI

SEQ ID NO: 261291 - protein, 9 aa, Dengue virus
WTLYAVATT

SEQ ID NO: 261292 - protein, 9 aa, Dengue virus
WLVHRQWFL

SEQ ID NO: 261293 - protein, 9 aa, Dengue virus
IKDSKAVHA

SEQ ID NO: 261294 - protein, 9 aa, Dengue virus
VKRFSSELL

SEQ ID NO: 261295 - protein, 9 aa, Dengue virus
LFSGVSWTM

SEQ ID NO: 261296 - protein, 9 aa, Dengue virus
LKGLPIRYQ

SEQ ID NO: 261297 - protein, 9 aa, Dengue virus
IENSTANVS

SEQ ID NO: 261298 - protein, 9 aa, Dengue virus
ISRMLLNRF

SEQ ID NO: 261299 - protein, 9 aa, Dengue virus
YAQMWTLMY

SEQ ID NO: 261300 - protein, 9 aa, Dengue virus
LNTFTNMEV

SEQ ID NO: 261301 - protein, 9 aa, Dengue virus
KFWNTTIAV

SEQ ID NO: 261302 - protein, 9 aa, Dengue virus
YRLRGEARK

SEQ ID NO: 261303 - protein, 9 aa, Dengue virus
VVTTSGTYV

SEQ ID NO: 261304 - protein, 9 aa, Dengue virus
FRAERVIDP

SEQ ID NO: 261305 - protein, 9 aa, Dengue virus
VLSIPPTAG

SEQ ID NO: 261306 - protein, 9 aa, Dengue virus
YRLKGEARK

SEQ ID NO: 261307 - protein, 9 aa, Dengue virus
IENTSANLS

SEQ ID NO: 261308 - protein, 9 aa, Dengue virus
LKRERNRVS

SEQ ID NO: 261309 - protein, 9 aa, Dengue virus
RMAILGDTA

SEQ ID NO: 261310 - protein, 9 aa, Dengue virus
YRGAKRMAI

SEQ ID NO: 261311 - protein, 9 aa, Dengue virus
FKLTYQNKV

SEQ ID NO: 261312 - protein, 9 aa, Dengue virus
DLPVWLAYR

SEQ ID NO: 261313 - protein, 9 aa, Dengue virus
YSQVNPLTL

SEQ ID NO: 261314 - protein, 9 aa, Dengue virus
LAAIANQAT

SEQ ID NO: 261315 - protein, 9 aa, Dengue virus
ILLMRTSWA

SEQ ID NO: 261316 - protein, 9 aa, Dengue virus
YNMMGKREK

SEQ ID NO: 261317 - protein, 9 aa, Dengue virus
YTALFGGVS

SEQ ID NO: 261318 - protein, 9 aa, Dengue virus
IKRGLRTLI

SEQ ID NO: 261319 - protein, 9 aa, Dengue virus
YCGGLKNVK

SEQ ID NO: 261320 - protein, 9 aa, Dengue virus
IENTTANIS

SEQ ID NO: 261321 - protein, 9 aa, Dengue virus
YWIESRLND

SEQ ID NO: 261322 - protein, 9 aa, Dengue virus
CYVITGRSA

SEQ ID NO: 261323 - protein, 9 aa, Dengue virus
SVALVPHVG

SEQ ID NO: 261324 - protein, 9 aa, Dengue virus
KQWFLNLPL

SEQ ID NO: 261325 - protein, 9 aa, Dengue virus
CVKVLNPYM

SEQ ID NO: 261326 - protein, 9 aa, Dengue virus
LRWFVERNM

SEQ ID NO: 261327 - protein, 9 aa, Dengue virus
LTAIANQAA

SEQ ID NO: 261328 - protein, 9 aa, Dengue virus
WTLYAVATT

SEQ ID NO: 261329 - protein, 9 aa, Dengue virus
LLLMRTSWA

SEQ ID NO: 261330 - protein, 9 aa, Dengue virus
YRILQRGLL

SEQ ID NO: 261331 - protein, 9 aa, Dengue virus
AYVMTGRSA

SEQ ID NO: 261332 - protein, 9 aa, Dengue virus
FEKQLGQVM

SEQ ID NO: 261333 - protein, 9 aa, Dengue virus
IVSSVNMIS

SEQ ID NO: 261334 - protein, 9 aa, Dengue virus
VWFVPSIKA

SEQ ID NO: 261335 - protein, 9 aa, Dengue virus
TSRLLINRF

SEQ ID NO: 261336 - protein, 9 aa, Dengue virus
TRKYLPAIV

SEQ ID NO: 261337 - protein, 9 aa, Dengue virus
FLAIPPTAG

SEQ ID NO: 261338 - protein, 9 aa, Dengue virus
IYRIKQKGI

SEQ ID NO: 261339 - protein, 9 aa, Dengue virus
LKGLPIRYQ

SEQ ID NO: 261340 - protein, 9 aa, Dengue virus
IFMKDGREI

SEQ ID NO: 261341 - protein, 9 aa, Dengue virus
IVREAIKRG

SEQ ID NO: 261342 - protein, 9 aa, Dengue virus
FGKGSLLTC

SEQ ID NO: 261343 - protein, 9 aa, Dengue virus
WSIHATHQW

SEQ ID NO: 261344 - protein, 9 aa, Dengue virus
FKAGRVIDP

SEQ ID NO: 261345 - protein, 9 aa, Dengue virus
FITFLRVLS

SEQ ID NO: 261346 - protein, 9 aa, Dengue virus
ISYGGGWKL

SEQ ID NO: 261347 - protein, 9 aa, Dengue virus
YRIMQRGLF

SEQ ID NO: 261348 - protein, 9 aa, Dengue virus
LIGLTSRAT

SEQ ID NO: 261349 - protein, 9 aa, Dengue virus
YKFQADSPS

SEQ ID NO: 261350 - protein, 9 aa, Dengue virus
FQADSPKRL

SEQ ID NO: 261351 - protein, 9 aa, Dengue virus
MFEATARGA

SEQ ID NO: 261352 - protein, 9 aa, Dengue virus
TLYAVATTI

SEQ ID NO: 261353 - protein, 9 aa, Dengue virus
VWFVPSIKS

SEQ ID NO: 261354 - protein, 9 aa, Dengue virus
WKMERASFI

SEQ ID NO: 261355 - protein, 9 aa, Dengue virus
CVKILNPYM

SEQ ID NO: 261356 - protein, 9 aa, Dengue virus
LTLATGPVL

SEQ ID NO: 261357 - protein, 9 aa, Dengue virus
SVNTTSRLL

SEQ ID NO: 261358 - protein, 9 aa, Dengue virus
DLRLAANAI

SEQ ID NO: 261359 - protein, 9 aa, Dengue virus
IWYMWLGAR

SEQ ID NO: 261360 - protein, 9 aa, Dengue virus
VMAFIAFLR

SEQ ID NO: 261361 - protein, 9 aa, Dengue virus
FSGQGPMKL

SEQ ID NO: 261362 - protein, 9 aa, Dengue virus
RMAILGDTA

SEQ ID NO: 261363 - protein, 9 aa, Dengue virus
YGWNLVRLQ

SEQ ID NO: 261364 - protein, 9 aa, Dengue virus
YNMMGKREK

SEQ ID NO: 261365 - protein, 9 aa, Dengue virus
IAKSKPTLD

SEQ ID NO: 261366 - protein, 9 aa, Dengue virus
IFVADNVHT

SEQ ID NO: 261367 - protein, 9 aa, Dengue virus
YNMMGKREK

SEQ ID NO: 261368 - protein, 9 aa, Dengue virus
YLAGAGLLF

SEQ ID NO: 261369 - protein, 9 aa, Dengue virus
YWIESSKNQ

SEQ ID NO: 261370 - protein, 9 aa, Dengue virus
LQRGLLGKT

SEQ ID NO: 261371 - protein, 9 aa, Dengue virus
FWNTTIAVS

SEQ ID NO: 261372 - protein, 9 aa, Dengue virus
IRYQTTAIK

SEQ ID NO: 261373 - protein, 9 aa, Dengue virus
IAVSTANIF

SEQ ID NO: 261374 - protein, 9 aa, Dengue virus
LIGLSSRAT

SEQ ID NO: 261375 - protein, 9 aa, Dengue virus
WCNLTSTWV

SEQ ID NO: 261376 - protein, 9 aa, Dengue virus
FLEFEALGF

SEQ ID NO: 261377 - protein, 9 aa, Dengue virus
YAQMWALMY

SEQ ID NO: 261378 - protein, 9 aa, Dengue virus
ITLATGPLS

SEQ ID NO: 261379 - protein, 9 aa, Dengue virus
CHATFTMRL

SEQ ID NO: 261380 - protein, 9 aa, Dengue virus
PIRVPNYNL

SEQ ID NO: 261381 - protein, 9 aa, Dengue virus
LTAIANQAT

SEQ ID NO: 261382 - protein, 9 aa, Dengue virus
IMKNPTVDG

SEQ ID NO: 261383 - protein, 9 aa, Dengue virus
YNMMGKREK

SEQ ID NO: 261384 - protein, 9 aa, Dengue virus
MMRTTWALC

SEQ ID NO: 261385 - protein, 9 aa, Dengue virus
YRLRGEARK

SEQ ID NO: 261386 - protein, 9 aa, Dengue virus
FTTNIWLKL

SEQ ID NO: 261387 - protein, 9 aa, Dengue virus
IRRGLRTLI

SEQ ID NO: 261388 - protein, 9 aa, Dengue virus
VNTTSRLLI

SEQ ID NO: 261389 - protein, 9 aa, Dengue virus
YNLIVMDEA

SEQ ID NO: 261390 - protein, 9 aa, Dengue virus
WMTTEDMLT

SEQ ID NO: 261391 - protein, 9 aa, Dengue virus
WFSRENSLS

SEQ ID NO: 261392 - protein, 9 aa, Dengue virus
VRSTTRLEN

SEQ ID NO: 261393 - protein, 9 aa, Dengue virus
YMATLKNVR

SEQ ID NO: 261394 - protein, 9 aa, Dengue virus
WASVKKDLI

SEQ ID NO: 261395 - protein, 9 aa, Dengue virus
MRLLSPVRV

SEQ ID NO: 261396 - protein, 9 aa, Dengue virus
IFVTDNVHT

SEQ ID NO: 261397 - protein, 9 aa, Dengue virus
IAVSTANIF

SEQ ID NO: 261398 - protein, 9 aa, Dengue virus
FLTIPPTAG

SEQ ID NO: 261399 - protein, 9 aa, Dengue virus
LKGMPIRYQ

SEQ ID NO: 261400 - protein, 9 aa, Dengue virus
FVVDNVHTR

SEQ ID NO: 261401 - protein, 9 aa, Dengue virus
LLSSTRVPN

SEQ ID NO: 261402 - protein, 9 aa, Dengue virus
VVKLLTKPW

SEQ ID NO: 261403 - protein, 9 aa, Dengue virus
GLFGKGSLV

SEQ ID NO: 261404 - protein, 9 aa, Dengue virus
WKMERASFI

SEQ ID NO: 261405 - protein, 9 aa, Dengue virus
IALEPGKNP

SEQ ID NO: 261406 - protein, 9 aa, Dengue virus
YMWLGARYL

SEQ ID NO: 261407 - protein, 9 aa, Dengue virus
ILLMRTTWA

SEQ ID NO: 261408 - protein, 9 aa, Dengue virus
VVSILASSF

SEQ ID NO: 261409 - protein, 9 aa, Dengue virus
HRLMSAAIK

SEQ ID NO: 261410 - protein, 9 aa, Dengue virus
LLILCASQI

SEQ ID NO: 261411 - protein, 9 aa, Dengue virus
LKGLPIRYQ

SEQ ID NO: 261412 - protein, 9 aa, Dengue virus
LTIMDLHPG

SEQ ID NO: 261413 - protein, 9 aa, Dengue virus
WLVHRQWFL

SEQ ID NO: 261414 - protein, 9 aa, Dengue virus
SVALVPHVG

SEQ ID NO: 261415 - protein, 9 aa, Dengue virus
HRRDLRLAA

SEQ ID NO: 261416 - protein, 9 aa, Dengue virus
VVRLLTKPW

SEQ ID NO: 261417 - protein, 9 aa, Dengue virus
IANQATVLM

SEQ ID NO: 261418 - protein, 9 aa, Dengue virus
TQVLLMRTT

SEQ ID NO: 261419 - protein, 9 aa, Dengue virus
IFVTDNVHT

SEQ ID NO: 261420 - protein, 9 aa, Dengue virus
IYRIKQKGI

SEQ ID NO: 261421 - protein, 9 aa, Dengue virus
YVSAIAQTE

SEQ ID NO: 261422 - protein, 9 aa, Dengue virus
ITPMLRHTI

SEQ ID NO: 261423 - protein, 9 aa, Dengue virus
NRVSTGSQL

SEQ ID NO: 261424 - protein, 9 aa, Dengue virus
FKAERVIDP

SEQ ID NO: 261425 - protein, 9 aa, Dengue virus
LTPMLRHSI

SEQ ID NO: 261426 - protein, 9 aa, Dengue virus
IEAGRTLRV

SEQ ID NO: 261427 - protein, 9 aa, Dengue virus
AVSMANIFR

SEQ ID NO: 261428 - protein, 9 aa, Dengue virus
VILAGPMPV

SEQ ID NO: 261429 - protein, 9 aa, Dengue virus
VMAFIAFLR

SEQ ID NO: 261430 - protein, 9 aa, Dengue virus
IVSSVNTIS

SEQ ID NO: 261431 - protein, 9 aa, Dengue virus
VVTRSGAYV

SEQ ID NO: 261432 - protein, 9 aa, Dengue virus
VWFVPSIKA

SEQ ID NO: 261433 - protein, 9 aa, Dengue virus
LRGLPIRYQ

SEQ ID NO: 261434 - protein, 9 aa, Dengue virus
IRYQTPAIR

SEQ ID NO: 261435 - protein, 9 aa, Dengue virus
YAVATTIIT

SEQ ID NO: 261436 - protein, 9 aa, Dengue virus
CHATFTMRL

SEQ ID NO: 261437 - protein, 9 aa, Dengue virus
LVTFKNAHA

SEQ ID NO: 261438 - protein, 9 aa, Dengue virus
YFHRRDLRL

SEQ ID NO: 261439 - protein, 9 aa, Dengue virus
LKRVRNRVS

SEQ ID NO: 261440 - protein, 9 aa, Dengue virus
YRIKQQGIL

SEQ ID NO: 261441 - protein, 9 aa, Dengue virus
FEKQLGQVM

SEQ ID NO: 261442 - protein, 9 aa, Dengue virus
YVSSIAQTE

SEQ ID NO: 261443 - protein, 9 aa, Dengue virus
FTNMEAQLI

SEQ ID NO: 261444 - protein, 9 aa, Dengue virus
FSGQGPMKL

SEQ ID NO: 261445 - protein, 9 aa, Dengue virus
SVNMVSRML

SEQ ID NO: 261446 - protein, 9 aa, Dengue virus
YGWNIVKLH

SEQ ID NO: 261447 - protein, 9 aa, Dengue virus
SVNMVSRML

SEQ ID NO: 261448 - protein, 9 aa, Dengue virus
WLVHKQWFL

SEQ ID NO: 261449 - protein, 9 aa, Dengue virus
RSVTRLENI

SEQ ID NO: 261450 - protein, 9 aa, Dengue virus
VVSILASSF

SEQ ID NO: 261451 - protein, 9 aa, Dengue virus
HKMDLGVPL

SEQ ID NO: 261452 - protein, 9 aa, Dengue virus
ITLATGPLS

SEQ ID NO: 261453 - protein, 9 aa, Dengue virus
LISYGGGWR

SEQ ID NO: 261454 - protein, 9 aa, Dengue virus
VLTLATGPV

SEQ ID NO: 261455 - protein, 9 aa, Dengue virus
MRLLSPVRV

SEQ ID NO: 261456 - protein, 9 aa, Dengue virus
FCSHHFHEL

SEQ ID NO: 261457 - protein, 9 aa, Dengue virus
YVITGTSAD

SEQ ID NO: 261458 - protein, 9 aa, Dengue virus
YYCAGLKKV

SEQ ID NO: 261459 - protein, 9 aa, Dengue virus
LTIMDLHPG

SEQ ID NO: 261460 - protein, 9 aa, Dengue virus
MGLGKGWPI

SEQ ID NO: 261461 - protein, 9 aa, Dengue virus
WMTTEDMLK

SEQ ID NO: 261462 - protein, 9 aa, Dengue virus
FEKQLGQIM

SEQ ID NO: 261463 - protein, 9 aa, Dengue virus
LLLMRTSWA

SEQ ID NO: 261464 - protein, 9 aa, Dengue virus
LRPASAWTL

SEQ ID NO: 261465 - protein, 9 aa, Dengue virus
FGRAKGSRA

SEQ ID NO: 261466 - protein, 9 aa, Dengue virus
TIENTSANL

SEQ ID NO: 261467 - protein, 9 aa, Dengue virus
VRSTTRLEN

SEQ ID NO: 261468 - protein, 9 aa, Dengue virus
VWLAYKVAA

SEQ ID NO: 261469 - protein, 9 aa, Dengue virus
IANQATVLM

SEQ ID NO: 261470 - protein, 9 aa, Dengue virus
IRYQTTAVK

SEQ ID NO: 261471 - protein, 9 aa, Dengue virus
VSILLSSLL

SEQ ID NO: 261472 - protein, 9 aa, Dengue virus
WKLARASFI

SEQ ID NO: 261473 - protein, 9 aa, Dengue virus
MVNGVVRLL

SEQ ID NO: 261474 - protein, 9 aa, Dengue virus
IVSSVNTIS

SEQ ID NO: 261475 - protein, 9 aa, Dengue virus
MGLGKGWPI

SEQ ID NO: 261476 - protein, 9 aa, Dengue virus
IFITNNVHT

SEQ ID NO: 261477 - protein, 9 aa, Dengue virus
ATTVLTPML

SEQ ID NO: 261478 - protein, 9 aa, Dengue virus
FTNMEVQLI

SEQ ID NO: 261479 - protein, 9 aa, Dengue virus
IRYQTTAIK

SEQ ID NO: 261480 - protein, 9 aa, Dengue virus
VFHTMWHVT

SEQ ID NO: 261481 - protein, 9 aa, Dengue virus
KLMSAAVKD

SEQ ID NO: 261482 - protein, 9 aa, Dengue virus
LIRCPLSRN

SEQ ID NO: 261483 - protein, 9 aa, Dengue virus
ATTIVTPML

SEQ ID NO: 261484 - protein, 9 aa, Dengue virus
TRLLSSTRV

SEQ ID NO: 261485 - protein, 9 aa, Dengue virus
LNGKGPLRM

SEQ ID NO: 261486 - protein, 9 aa, Dengue virus
LAMTDTTPF

SEQ ID NO: 261487 - protein, 9 aa, Dengue virus
TYSLNTFTN

SEQ ID NO: 261488 - protein, 9 aa, Dengue virus
VTHASAAQR

SEQ ID NO: 261489 - protein, 9 aa, Dengue virus
FLRVLSIPP

SEQ ID NO: 261490 - protein, 9 aa, Dengue virus
LRGLPIRYQ

SEQ ID NO: 261491 - protein, 9 aa, Dengue virus
ILLMRTTWA

SEQ ID NO: 261492 - protein, 9 aa, Dengue virus
FCEVLTLAT

SEQ ID NO: 261493 - protein, 9 aa, Dengue virus
VWIQDNPNM

SEQ ID NO: 261494 - protein, 9 aa, Dengue virus
LGKAYAQMW

SEQ ID NO: 261495 - protein, 9 aa, Dengue virus
WCNATSTWV

SEQ ID NO: 261496 - protein, 9 aa, Dengue virus
TQVGVGIHI

SEQ ID NO: 261497 - protein, 9 aa, Dengue virus
HRVDLGVPL

SEQ ID NO: 261498 - protein, 9 aa, Dengue virus
VCGIRSVTR

SEQ ID NO: 261499 - protein, 9 aa, Dengue virus
LMRTSWALC

SEQ ID NO: 261500 - protein, 9 aa, Dengue virus
KLLTKPWDV

SEQ ID NO: 261501 - protein, 9 aa, Dengue virus
WKLARASFI

SEQ ID NO: 261502 - protein, 9 aa, Dengue virus
IKKVRTNAA

SEQ ID NO: 261503 - protein, 9 aa, Dengue virus
IFVVDNVHT

SEQ ID NO: 261504 - protein, 9 aa, Dengue virus
WNIVKLHSG

SEQ ID NO: 261505 - protein, 9 aa, Dengue virus
FQPESPARV

SEQ ID NO: 261506 - protein, 9 aa, Dengue virus
MFEATARGA

SEQ ID NO: 261507 - protein, 9 aa, Dengue virus
FEKQLGQVM

SEQ ID NO: 261508 - protein, 9 aa, Dengue virus
TTTVSGKLI

SEQ ID NO: 261509 - protein, 9 aa, Dengue virus
VYRIKQRGI

SEQ ID NO: 261510 - protein, 9 aa, Dengue virus
TWSIHAHHQ

SEQ ID NO: 261511 - protein, 9 aa, Dengue virus
LLKNDVPLA

SEQ ID NO: 261512 - protein, 9 aa, Dengue virus
FCKKVRSNA

SEQ ID NO: 261513 - protein, 9 aa, Dengue virus
ATTIITPML

SEQ ID NO: 261514 - protein, 9 aa, Dengue virus
IRWIVERGM

SEQ ID NO: 261515 - protein, 9 aa, Dengue virus
LSSTRVPNY

SEQ ID NO: 261516 - protein, 9 aa, Dengue virus
YGMEIRPVS

SEQ ID NO: 261517 - protein, 9 aa, Dengue virus
TACLGKAYA

SEQ ID NO: 261518 - protein, 9 aa, Dengue virus
PLRMVLAFI

SEQ ID NO: 261519 - protein, 9 aa, Dengue virus
NRVSTVQQL

SEQ ID NO: 261520 - protein, 9 aa, Dengue virus
LIGLTSRAT

SEQ ID NO: 261521 - protein, 9 aa, Dengue virus
SVNTISKML

SEQ ID NO: 261522 - protein, 9 aa, Dengue virus
LTPMLRHSI

SEQ ID NO: 261523 - protein, 9 aa, Dengue virus
SRMLLNRFT

SEQ ID NO: 261524 - protein, 9 aa, Dengue virus
YVLSGSSAD

SEQ ID NO: 261525 - protein, 9 aa, Dengue virus
YLAGAGLAF

SEQ ID NO: 261526 - protein, 9 aa, Dengue virus
ENSSVNVSL

SEQ ID NO: 261527 - protein, 9 aa, Dengue virus
YYCAGLKKV

SEQ ID NO: 261528 - protein, 9 aa, Dengue virus
SYAQMWQLM

SEQ ID NO: 261529 - protein, 9 aa, Dengue virus
IMKNPTVDG

SEQ ID NO: 261530 - protein, 9 aa, Dengue virus
LTIMDLHPG

SEQ ID NO: 261531 - protein, 9 aa, Dengue virus
TWSIHATHQ

SEQ ID NO: 261532 - protein, 9 aa, Dengue virus
TWSIHAKHQ

SEQ ID NO: 261533 - protein, 9 aa, Dengue virus
KRFSKGLFS

SEQ ID NO: 261534 - protein, 9 aa, Dengue virus
IYRIKQKGI

SEQ ID NO: 261535 - protein, 9 aa, Dengue virus
FCEVLTLAT

SEQ ID NO: 261536 - protein, 9 aa, Dengue virus
PVRVPNYNM

SEQ ID NO: 261537 - protein, 9 aa, Dengue virus
IRYQTPAVK

SEQ ID NO: 261538 - protein, 9 aa, Dengue virus
LTLATGPVL

SEQ ID NO: 261539 - protein, 9 aa, Dengue virus
MMRTTWALC

SEQ ID NO: 261540 - protein, 9 aa, Dengue virus
FLRFLTIPP

SEQ ID NO: 261541 - protein, 9 aa, Dengue virus
LTIMDLHPG

SEQ ID NO: 261542 - protein, 9 aa, Dengue virus
AIANQAAVL

SEQ ID NO: 261543 - protein, 9 aa, Dengue virus
IVREAIKRG

SEQ ID NO: 261544 - protein, 9 aa, Dengue virus
WQIEKASLI

SEQ ID NO: 261545 - protein, 9 aa, Dengue virus
FLEFEALGF

SEQ ID NO: 261546 - protein, 9 aa, Dengue virus
LLKNDIPMT

SEQ ID NO: 261547 - protein, 9 aa, Dengue virus
VQLLLMRTS

SEQ ID NO: 261548 - protein, 9 aa, Dengue virus
IRSVTRLEN

SEQ ID NO: 261549 - protein, 9 aa, Dengue virus
WIASAIILE

SEQ ID NO: 261550 - protein, 9 aa, Dengue virus
YKFQPESPA

SEQ ID NO: 261551 - protein, 9 aa, Dengue virus
YSQVNPTTL

SEQ ID NO: 261552 - protein, 9 aa, Dengue virus
IKRKLRTLV

SEQ ID NO: 261553 - protein, 9 aa, Dengue virus
FRKRRLTIM

SEQ ID NO: 261554 - protein, 9 aa, Dengue virus
TIENTTANI

SEQ ID NO: 261555 - protein, 9 aa, Dengue virus
VVTRSGAYV

SEQ ID NO: 261556 - protein, 9 aa, Dengue virus
SIENSSVNV

SEQ ID NO: 261557 - protein, 9 aa, Dengue virus
WALMYFHRR

SEQ ID NO: 261558 - protein, 9 aa, Dengue virus
LRHTIENTS

SEQ ID NO: 261559 - protein, 9 aa, Dengue virus
TSRLLLNRF

SEQ ID NO: 261560 - protein, 9 aa, Dengue virus
ALTLATGPI

SEQ ID NO: 261561 - protein, 9 aa, Dengue virus
LQGQGPMKM

SEQ ID NO: 261562 - protein, 9 aa, Dengue virus
WQLMYFHRR

SEQ ID NO: 261563 - protein, 9 aa, Dengue virus
CVTTIAKSK

SEQ ID NO: 261564 - protein, 9 aa, Dengue virus
IVSAVNMTS

SEQ ID NO: 261565 - protein, 9 aa, Dengue virus
FLRVLSIPP

SEQ ID NO: 261566 - protein, 9 aa, Dengue virus
FSGQGPMKL

SEQ ID NO: 261567 - protein, 9 aa, Dengue virus
MVTFKVPHA

SEQ ID NO: 261568 - protein, 9 aa, Dengue virus
HRVDLGVPL

SEQ ID NO: 261569 - protein, 9 aa, Dengue virus
VKATGSASS

SEQ ID NO: 261570 - protein, 9 aa, Dengue virus
ILLMRTSWA

SEQ ID NO: 261571 - protein, 9 aa, Dengue virus
FWNTTIAVS

SEQ ID NO: 261572 - protein, 9 aa, Dengue virus
IAKNKPTLD

SEQ ID NO: 261573 - protein, 9 aa, Dengue virus
STRVPNYNL

SEQ ID NO: 261574 - protein, 9 aa, Dengue virus
WALCEALTL

SEQ ID NO: 261575 - protein, 9 aa, Dengue virus
HRMDIGVPL

SEQ ID NO: 261576 - protein, 9 aa, Dengue virus
YRIKQRGIL

SEQ ID NO: 261577 - protein, 9 aa, Dengue virus
YAQMWALMY

SEQ ID NO: 261578 - protein, 9 aa, Dengue virus
KRFSKGLFS

SEQ ID NO: 261579 - protein, 9 aa, Dengue virus
FTNMEAQLI

SEQ ID NO: 261580 - protein, 9 aa, Dengue virus
YRLKGEARK

SEQ ID NO: 261581 - protein, 9 aa, Dengue virus
WQIEKASLI

SEQ ID NO: 261582 - protein, 9 aa, Dengue virus
VNVSLTAIA

SEQ ID NO: 261583 - protein, 9 aa, Dengue virus
LKRRLRTLI

SEQ ID NO: 261584 - protein, 9 aa, Dengue virus
LILAPTRVV

SEQ ID NO: 261585 - protein, 9 aa, Dengue virus
LLRNDVPMA

SEQ ID NO: 261586 - protein, 9 aa, Dengue virus
LAAIANQAT

SEQ ID NO: 261587 - protein, 9 aa, Dengue virus
WKIEKASFI

SEQ ID NO: 261588 - protein, 9 aa, Dengue virus
YWIESALND

SEQ ID NO: 261589 - protein, 9 aa, Dengue virus
LRTLILAPT

SEQ ID NO: 261590 - protein, 9 aa, Dengue virus
CYVITGRSA

SEQ ID NO: 261591 - protein, 9 aa, Dengue virus
IENTSANLS

SEQ ID NO: 261592 - protein, 9 aa, Dengue virus
YRLRGEARK

SEQ ID NO: 261593 - protein, 9 aa, Dengue virus
YYCAGLKKV

SEQ ID NO: 261594 - protein, 9 aa, Dengue virus
YVSAITQAE

SEQ ID NO: 261595 - protein, 9 aa, Dengue virus
LGRGWPLHR

SEQ ID NO: 261596 - protein, 9 aa, Dengue virus
VSQLAKRFS

SEQ ID NO: 261597 - protein, 9 aa, Dengue virus
IANQAAILM

SEQ ID NO: 261598 - protein, 9 aa, Dengue virus
YGVLFSGVS

SEQ ID NO: 261599 - protein, 9 aa, Dengue virus
LAAIANQAV

SEQ ID NO: 261600 - protein, 9 aa, Dengue virus
FHTMWHVTR

SEQ ID NO: 261601 - protein, 9 aa, Dengue virus
FQADSPKRL

SEQ ID NO: 261602 - protein, 9 aa, Dengue virus
VKLLTKPWD

SEQ ID NO: 261603 - protein, 9 aa, Dengue virus
VWIQDNPNM

SEQ ID NO: 261604 - protein, 9 aa, Dengue virus
WKLEKASFI

SEQ ID NO: 261605 - protein, 9 aa, Dengue virus
SKVDIGVPL

SEQ ID NO: 261606 - protein, 9 aa, Dengue virus
IWYMWLGAR

SEQ ID NO: 261607 - protein, 9 aa, Dengue virus
VKATGSASS

SEQ ID NO: 261608 - protein, 9 aa, Dengue virus
LVTFKNPHA

SEQ ID NO: 261609 - protein, 9 aa, Dengue virus
LKRRLRTLI

SEQ ID NO: 261610 - protein, 9 aa, Dengue virus
SVALTPHSG

SEQ ID NO: 261611 - protein, 9 aa, Dengue virus
FKAGRVIDP

SEQ ID NO: 261612 - protein, 9 aa, Dengue virus
LLKNDVPLA

SEQ ID NO: 261613 - protein, 9 aa, Dengue virus
FLTIPPTAG

SEQ ID NO: 261614 - protein, 9 aa, Dengue virus
LGSQEGAMH

SEQ ID NO: 261615 - protein, 9 aa, Dengue virus
YNLIIMDEA

SEQ ID NO: 261616 - protein, 9 aa, Dengue virus
FGRAKGSRA

SEQ ID NO: 261617 - protein, 9 aa, Dengue virus
YYMATLKNV

SEQ ID NO: 261618 - protein, 9 aa, Dengue virus
IRYQTPAIR

SEQ ID NO: 261619 - protein, 9 aa, Dengue virus
IANQATVLM

SEQ ID NO: 261620 - protein, 9 aa, Dengue virus
IYSDPLALR

SEQ ID NO: 261621 - protein, 9 aa, Dengue virus
VSILLSSLL

SEQ ID NO: 261622 - protein, 9 aa, Dengue virus
FGRAKGSRA

SEQ ID NO: 261623 - protein, 9 aa, Dengue virus
FQADSPSKL

SEQ ID NO: 261624 - protein, 9 aa, Dengue virus
FQPESPKRL

SEQ ID NO: 261625 - protein, 9 aa, Dengue virus
IKKVRTNAA

SEQ ID NO: 261626 - protein, 9 aa, Dengue virus
SVNMVSRML

SEQ ID NO: 261627 - protein, 9 aa, Dengue virus
FTNMEVQLI

SEQ ID NO: 261628 - protein, 9 aa, Dengue virus
KRFSKGLFS

SEQ ID NO: 261629 - protein, 9 aa, Dengue virus
YTALFGGVS

SEQ ID NO: 261630 - protein, 9 aa, Dengue virus
WSIHAHHQW

SEQ ID NO: 261631 - protein, 9 aa, Dengue virus
KRFSRGMLQ

SEQ ID NO: 261632 - protein, 9 aa, Dengue virus
LVSILLSSL

SEQ ID NO: 261633 - protein, 9 aa, Dengue virus
WDVVPTVTQ

SEQ ID NO: 261634 - protein, 9 aa, Dengue virus
FCESLTLAT

SEQ ID NO: 261635 - protein, 9 aa, Dengue virus
LIMKDGRVL

SEQ ID NO: 261636 - protein, 9 aa, Dengue virus
IALDFSPGT

SEQ ID NO: 261637 - protein, 9 aa, Dengue virus
FKLTYQNKV

SEQ ID NO: 261638 - protein, 9 aa, Dengue virus
FCEVLTLAT

SEQ ID NO: 261639 - protein, 9 aa, Dengue virus
SKLMSAAVK

SEQ ID NO: 261640 - protein, 9 aa, Dengue virus
LHPASAWTL

SEQ ID NO: 261641 - protein, 9 aa, Dengue virus
LNTFTNMEA

SEQ ID NO: 261642 - protein, 9 aa, Dengue virus
GLFGKGSLI

SEQ ID NO: 261643 - protein, 9 aa, Dengue virus
LIRCPLSRN

SEQ ID NO: 261644 - protein, 9 aa, Dengue virus
YGMEIRPLK

SEQ ID NO: 261645 - protein, 9 aa, Dengue virus
VRTNAAIGA

SEQ ID NO: 261646 - protein, 9 aa, Dengue virus
LQWIASAIV

SEQ ID NO: 261647 - protein, 9 aa, Dengue virus
HWIAASIIL

SEQ ID NO: 261648 - protein, 9 aa, Dengue virus
LKGLPIRYQ

SEQ ID NO: 261649 - protein, 9 aa, Dengue virus
YNMMGKREK

SEQ ID NO: 261650 - protein, 9 aa, Dengue virus
WSIHASHEW

SEQ ID NO: 261651 - protein, 9 aa, Dengue virus
VLSIPPTAG

SEQ ID NO: 261652 - protein, 9 aa, Dengue virus
YNMMGKREK

SEQ ID NO: 261653 - protein, 9 aa, Dengue virus
VRSNAALGA

SEQ ID NO: 261654 - protein, 9 aa, Dengue virus
FTTNIWLRL

SEQ ID NO: 261655 - protein, 9 aa, Dengue virus
VRSNAALGA

SEQ ID NO: 261656 - protein, 9 aa, Dengue virus
LLMMRTTWA

SEQ ID NO: 261657 - protein, 9 aa, Dengue virus
YAQMWQLMY

SEQ ID NO: 261658 - protein, 9 aa, Dengue virus
ISRMLLNRF

SEQ ID NO: 261659 - protein, 9 aa, Dengue virus
FMALVAFLR

SEQ ID NO: 261660 - protein, 9 aa, Dengue virus
FKAGRVIDP

SEQ ID NO: 261661 - protein, 9 aa, Dengue virus
RLLTKPWDV

SEQ ID NO: 261662 - protein, 9 aa, Dengue virus
LKGLPIRYQ

SEQ ID NO: 261663 - protein, 9 aa, Dengue virus
SVALAPHVG

SEQ ID NO: 261664 - protein, 9 aa, Dengue virus
NIVSSVNMI

SEQ ID NO: 261665 - protein, 9 aa, Dengue virus
WIQDNPNMI

SEQ ID NO: 261666 - protein, 9 aa, Dengue virus
VRSNAAIGA

SEQ ID NO: 261667 - protein, 9 aa, Dengue virus
MRTALTGAT

SEQ ID NO: 261668 - protein, 9 aa, Dengue virus
FEKQLGQIM

SEQ ID NO: 261669 - protein, 9 aa, Dengue virus
TKRYLPAIV

SEQ ID NO: 261670 - protein, 9 aa, Dengue virus
VLKMVEPWL

SEQ ID NO: 261671 - protein, 9 aa, Dengue virus
TLYAVATTF

SEQ ID NO: 261672 - protein, 9 aa, Dengue virus
FQEGTFHTM

SEQ ID NO: 261673 - protein, 9 aa, Dengue virus
YRIKQQGIL

SEQ ID NO: 261674 - protein, 9 aa, Dengue virus
YNMMGKREK

SEQ ID NO: 261675 - protein, 9 aa, Dengue virus
YRGAKRMAI

SEQ ID NO: 261676 - protein, 9 aa, Dengue virus
CYSQVNPLT

SEQ ID NO: 261677 - protein, 9 aa, Dengue virus
PMSTYGWNI

SEQ ID NO: 261678 - protein, 9 aa, Dengue virus
LLILCASQI

SEQ ID NO: 261679 - protein, 9 aa, Dengue virus
FCEALTLAT

SEQ ID NO: 261680 - protein, 9 aa, Dengue virus
ISRMLLNRF

SEQ ID NO: 261681 - protein, 9 aa, Dengue virus
YRIMQRGLF

SEQ ID NO: 261682 - protein, 9 aa, Dengue virus
YGWNIVKLM

SEQ ID NO: 261683 - protein, 9 aa, Dengue virus
LTPMLRHSI

SEQ ID NO: 261684 - protein, 9 aa, Dengue virus
IKRKLRTLI

SEQ ID NO: 261685 - protein, 9 aa, Dengue virus
LTLATGPIT

SEQ ID NO: 261686 - protein, 9 aa, Dengue virus
LIMKDGRVL

SEQ ID NO: 261687 - protein, 9 aa, Dengue virus
TKRYLPAIV

SEQ ID NO: 261688 - protein, 9 aa, Dengue virus
LRLAANAIC

SEQ ID NO: 261689 - protein, 9 aa, Dengue virus
YTALFGGVS

SEQ ID NO: 261690 - protein, 9 aa, Dengue virus
SMINGVVRL

SEQ ID NO: 261691 - protein, 9 aa, Dengue virus
CLGKSYAQM

SEQ ID NO: 261692 - protein, 9 aa, Dengue virus
FLRFLAIPP

SEQ ID NO: 261693 - protein, 9 aa, Dengue virus
LLKNDVPLA

SEQ ID NO: 261694 - protein, 9 aa, Dengue virus
KLMSAAVKD

SEQ ID NO: 261695 - protein, 9 aa, Dengue virus
ILLMRTSWA

SEQ ID NO: 261696 - protein, 9 aa, Dengue virus
YWIESALND

SEQ ID NO: 261697 - protein, 9 aa, Dengue virus
FCSHHFHEL

SEQ ID NO: 261698 - protein, 9 aa, Dengue virus
TWSIHAHHQ

SEQ ID NO: 261699 - protein, 9 aa, Dengue virus
YGMEIRPVS

SEQ ID NO: 261700 - protein, 9 aa, Dengue virus
MGLGRGWPL

SEQ ID NO: 261701 - protein, 9 aa, Dengue virus
TRLLSSTRV

SEQ ID NO: 261702 - protein, 9 aa, Dengue virus
VNVSLTAIA

SEQ ID NO: 261703 - protein, 9 aa, Dengue virus
LVSLLGSSL

SEQ ID NO: 261704 - protein, 9 aa, Dengue virus
LSGRGPLKL

SEQ ID NO: 261705 - protein, 9 aa, Dengue virus
LKGMPIRYQ

SEQ ID NO: 261706 - protein, 9 aa, Dengue virus
IALDFSPGT

SEQ ID NO: 261707 - protein, 9 aa, Dengue virus
VNTTSRLLL

SEQ ID NO: 261708 - protein, 9 aa, Dengue virus
LIGLTSRAT

SEQ ID NO: 261709 - protein, 9 aa, Dengue virus
LILAPTRVV

SEQ ID NO: 261710 - protein, 9 aa, Dengue virus
WLVHRQWFL

SEQ ID NO: 261711 - protein, 9 aa, Dengue virus
YAVATTVLT

SEQ ID NO: 261712 - protein, 9 aa, Dengue virus
FQADSPKKL

SEQ ID NO: 261713 - protein, 9 aa, Dengue virus
FCSHHFHKI

SEQ ID NO: 261714 - protein, 9 aa, Dengue virus
LLSGRGPLK

SEQ ID NO: 261715 - protein, 9 aa, Dengue virus
VVTKSGTYV

SEQ ID NO: 261716 - protein, 9 aa, Dengue virus
KRFSLGLLS

SEQ ID NO: 261717 - protein, 9 aa, Dengue virus
WLSYKVASA

SEQ ID NO: 261718 - protein, 9 aa, Dengue virus
VVKLLTKPW

SEQ ID NO: 261719 - protein, 9 aa, Dengue virus
INKVRSNAA

SEQ ID NO: 261720 - protein, 9 aa, Dengue virus
SVNMISRML

SEQ ID NO: 261721 - protein, 9 aa, Dengue virus
INMLKRVRN

SEQ ID NO: 261722 - protein, 9 aa, Dengue virus
IYRIKQKGI

SEQ ID NO: 261723 - protein, 9 aa, Dengue virus
HRVDLGVPL

SEQ ID NO: 261724 - protein, 9 aa, Dengue virus
SIAARGYIS

SEQ ID NO: 261725 - protein, 9 aa, Dengue virus
WVSGVSGNI

SEQ ID NO: 261726 - protein, 9 aa, Dengue virus
IRSATRMEN

SEQ ID NO: 261727 - protein, 9 aa, Dengue virus
YAVSRGTSK

SEQ ID NO: 261728 - protein, 9 aa, Dengue virus
SLRTTTASG

SEQ ID NO: 261729 - protein, 9 aa, Dengue virus
FMALVAFLR

SEQ ID NO: 261730 - protein, 9 aa, Dengue virus
IRWFVERNL

SEQ ID NO: 261731 - protein, 9 aa, Dengue virus
FLEFEALGF

SEQ ID NO: 261732 - protein, 9 aa, Dengue virus
LVRLQSGVD

SEQ ID NO: 261733 - protein, 9 aa, Dengue virus
TTTVSGKLI

SEQ ID NO: 261734 - protein, 9 aa, Dengue virus
LIGLSSRAT

SEQ ID NO: 261735 - protein, 9 aa, Dengue virus
WFSRGNSFS

SEQ ID NO: 261736 - protein, 9 aa, Dengue virus
FQPESPARL

SEQ ID NO: 261737 - protein, 9 aa, Dengue virus
FQPESPKRL

SEQ ID NO: 261738 - protein, 9 aa, Dengue virus
VVKLLTKPW

SEQ ID NO: 261739 - protein, 9 aa, Dengue virus
RVSTVSQLA

SEQ ID NO: 261740 - protein, 9 aa, Dengue virus
MVSILASAL

SEQ ID NO: 261741 - protein, 9 aa, Dengue virus
LQWIASAIV

SEQ ID NO: 261742 - protein, 9 aa, Dengue virus
LHPASAWTL

SEQ ID NO: 261743 - protein, 9 aa, Dengue virus
WALCESITL

SEQ ID NO: 261744 - protein, 9 aa, Dengue virus
HWFSRGNSL

SEQ ID NO: 261745 - protein, 9 aa, Dengue virus
YVITGTSAD

SEQ ID NO: 261746 - protein, 9 aa, Dengue virus
IRYQTPAIR

SEQ ID NO: 261747 - protein, 9 aa, Dengue virus
LTAIANQAA

SEQ ID NO: 261748 - protein, 9 aa, Dengue virus
FCEVLTLAT

SEQ ID NO: 261749 - protein, 9 aa, Dengue virus
VMAFIAFLR

SEQ ID NO: 261750 - protein, 9 aa, Dengue virus
LLLMRTSWA

SEQ ID NO: 261751 - protein, 9 aa, Dengue virus
VEAGRTLRV

SEQ ID NO: 261752 - protein, 9 aa, Dengue virus
FVIDNVHTR

SEQ ID NO: 261753 - protein, 9 aa, Dengue virus
IYADPMALK

SEQ ID NO: 261754 - protein, 9 aa, Dengue virus
IVSILASSL

SEQ ID NO: 261755 - protein, 9 aa, Dengue virus
RSVALAPHV

SEQ ID NO: 261756 - protein, 9 aa, Dengue virus
ILLMRTTWA

SEQ ID NO: 261757 - protein, 9 aa, Dengue virus
LVRCPLSRN

SEQ ID NO: 261758 - protein, 9 aa, Dengue virus
FHTMWHVTR

SEQ ID NO: 261759 - protein, 9 aa, Dengue virus
MWQLMYFHR

SEQ ID NO: 261760 - protein, 9 aa, Dengue virus
WVSGVSGNI

SEQ ID NO: 261761 - protein, 9 aa, Dengue virus
KRFSLGLLS

SEQ ID NO: 261762 - protein, 9 aa, Dengue virus
LRKSGKRVI

SEQ ID NO: 261763 - protein, 9 aa, Dengue virus
IRYQTTATK

SEQ ID NO: 261764 - protein, 9 aa, Dengue virus
TLYAVATTI

SEQ ID NO: 261765 - protein, 9 aa, Dengue virus
VSQGAGWSL

SEQ ID NO: 261766 - protein, 9 aa, Dengue virus
YVMTGRSAD

SEQ ID NO: 261767 - protein, 9 aa, Dengue virus
YRGAKRMAI

SEQ ID NO: 261768 - protein, 9 aa, Dengue virus
FQADSPKKL

SEQ ID NO: 261769 - protein, 9 aa, Dengue virus
CVTTMAKNK

SEQ ID NO: 261770 - protein, 9 aa, Dengue virus
TMRGAKRMA

SEQ ID NO: 261771 - protein, 9 aa, Dengue virus
MINGVVRLL

SEQ ID NO: 261772 - protein, 9 aa, Dengue virus
MMRTTWALC

SEQ ID NO: 261773 - protein, 9 aa, Dengue virus
YAQMWTLMY

SEQ ID NO: 261774 - protein, 9 aa, Dengue virus
GRTLRVLKM

SEQ ID NO: 261775 - protein, 9 aa, Dengue virus
HRVDLGVPL

SEQ ID NO: 261776 - protein, 9 aa, Dengue virus
IKRKLRTLV

SEQ ID NO: 261777 - protein, 9 aa, Dengue virus
HQWMTTEDM

SEQ ID NO: 261778 - protein, 9 aa, Dengue virus
LHKLGYILR

SEQ ID NO: 261779 - protein, 9 aa, Dengue virus
YKFQPESPA

SEQ ID NO: 261780 - protein, 9 aa, Dengue virus
FCESLTLAT

SEQ ID NO: 261781 - protein, 9 aa, Dengue virus
FQADSPKKL

SEQ ID NO: 261782 - protein, 9 aa, Dengue virus
LILAPTRVV

SEQ ID NO: 261783 - protein, 9 aa, Dengue virus
IENTTANIS

SEQ ID NO: 261784 - protein, 9 aa, Dengue virus
FCSHHFHQL

SEQ ID NO: 261785 - protein, 9 aa, Dengue virus
IRSVTRLEN

SEQ ID NO: 261786 - protein, 9 aa, Dengue virus
CVTTMAKNK

SEQ ID NO: 261787 - protein, 9 aa, Dengue virus
MRLLSPVRV

SEQ ID NO: 261788 - protein, 9 aa, Dengue virus
LLMMRTTWA

SEQ ID NO: 261789 - protein, 9 aa, Dengue virus
VREAIKRKL

SEQ ID NO: 261790 - protein, 9 aa, Dengue virus
LIGLTSRAT

SEQ ID NO: 261791 - protein, 9 aa, Dengue virus
MRGAKRMAI

SEQ ID NO: 261792 - protein, 9 aa, Dengue virus
LLRNDVPLA

SEQ ID NO: 261793 - protein, 9 aa, Dengue virus
TIRVLKMVE

SEQ ID NO: 261794 - protein, 9 aa, Dengue virus
MVNGVVRLL

SEQ ID NO: 261795 - protein, 9 aa, Dengue virus
PVRVPNYNL

SEQ ID NO: 261796 - protein, 9 aa, Dengue virus
AVSMANIFR

SEQ ID NO: 261797 - protein, 9 aa, Dengue virus
IRSTTRLEN

SEQ ID NO: 261798 - protein, 9 aa, Dengue virus
IVREALKRR

SEQ ID NO: 261799 - protein, 9 aa, Dengue virus
YFHRRDLRL

SEQ ID NO: 261800 - protein, 9 aa, Dengue virus
LMSAAVKDQ

SEQ ID NO: 261801 - protein, 9 aa, Dengue virus
LAAIANQAA

SEQ ID NO: 261802 - protein, 9 aa, Dengue virus
IHMENVFHT

SEQ ID NO: 261803 - protein, 9 aa, Dengue virus
LCESITLAT

SEQ ID NO: 261804 - protein, 9 aa, Dengue virus
VSRGSSKLR

SEQ ID NO: 261805 - protein, 9 aa, Dengue virus
TLYAVATTV

SEQ ID NO: 261806 - protein, 9 aa, Dengue virus
YSQVNPTTL

SEQ ID NO: 261807 - protein, 9 aa, Dengue virus
YSQVNPLTL

SEQ ID NO: 261808 - protein, 9 aa, Dengue virus
LLILCASQI

SEQ ID NO: 261809 - protein, 9 aa, Dengue virus
FLRFLAIPP

SEQ ID NO: 261810 - protein, 9 aa, Dengue virus
TLYAVATTI

SEQ ID NO: 261811 - protein, 9 aa, Dengue virus
LLMMRTTWA

SEQ ID NO: 261812 - protein, 9 aa, Dengue virus
MGLGKGWPL

SEQ ID NO: 261813 - protein, 9 aa, Dengue virus
LTAIANQAV

SEQ ID NO: 261814 - protein, 9 aa, Dengue virus
RVIQLSRKT

SEQ ID NO: 261815 - protein, 9 aa, Dengue virus
LTIMDLHPG

SEQ ID NO: 261816 - protein, 9 aa, Dengue virus
IYSDPLALR

SEQ ID NO: 261817 - protein, 9 aa, Dengue virus
IRWIVERGM

SEQ ID NO: 261818 - protein, 9 aa, Dengue virus
WAYHGSYEV

SEQ ID NO: 261819 - protein, 9 aa, Dengue virus
LAAYVMTGR

SEQ ID NO: 261820 - protein, 9 aa, Dengue virus
LTAIANQAA

SEQ ID NO: 261821 - protein, 9 aa, Dengue virus
SVALAPHVG

SEQ ID NO: 261822 - protein, 9 aa, Dengue virus
YMWLGARYL

SEQ ID NO: 261823 - protein, 9 aa, Dengue virus
YMWLGARYL

SEQ ID NO: 261824 - protein, 9 aa, Dengue virus
VRSNAAMGA

SEQ ID NO: 261825 - protein, 9 aa, Dengue virus
FLAIPPTAG

SEQ ID NO: 261826 - protein, 9 aa, Dengue virus
IRSTTRLEN

SEQ ID NO: 261827 - protein, 9 aa, Dengue virus
IKRKLRTLV

SEQ ID NO: 261828 - protein, 9 aa, Dengue virus
WMSAEGAWR

SEQ ID NO: 261829 - protein, 9 aa, Dengue virus
FTNMEAQLI

SEQ ID NO: 261830 - protein, 9 aa, Dengue virus
VVSILASSF

SEQ ID NO: 261831 - protein, 9 aa, Dengue virus
TLRVLKMVE

SEQ ID NO: 261832 - protein, 9 aa, Dengue virus
VKRFSTGLL

SEQ ID NO: 261833 - protein, 9 aa, Dengue virus
IRYQTTAVK

SEQ ID NO: 261834 - protein, 9 aa, Dengue virus
LKCRLRMDK

SEQ ID NO: 261835 - protein, 9 aa, Dengue virus
HRVDLGVPL

SEQ ID NO: 261836 - protein, 9 aa, Dengue virus
ANIFRGSYL

SEQ ID NO: 261837 - protein, 9 aa, Dengue virus
IFVVDNVHT

SEQ ID NO: 261838 - protein, 9 aa, Dengue virus
YLPAMVREA

SEQ ID NO: 261839 - protein, 9 aa, Dengue virus
FQADSPKRL

SEQ ID NO: 261840 - protein, 9 aa, Dengue virus
IVMDEAHFT

SEQ ID NO: 261841 - protein, 9 aa, Dengue virus
FQPESPARV

SEQ ID NO: 261842 - protein, 9 aa, Dengue virus
MRLLSPVRV

SEQ ID NO: 261843 - protein, 9 aa, Dengue virus
MRGAKRMAI

SEQ ID NO: 261844 - protein, 9 aa, Dengue virus
VSILLSSLL

SEQ ID NO: 261845 - protein, 9 aa, Dengue virus
LRLAANAIC

SEQ ID NO: 261846 - protein, 9 aa, Dengue virus
LHRLGYILR

SEQ ID NO: 261847 - protein, 9 aa, Dengue virus
VRSNAAIGA

SEQ ID NO: 261848 - protein, 9 aa, Dengue virus
FQADSPKRL

SEQ ID NO: 261849 - protein, 9 aa, Dengue virus
DLRLASNAI

SEQ ID NO: 261850 - protein, 9 aa, Dengue virus
MFEATARGA

SEQ ID NO: 261851 - protein, 9 aa, Dengue virus
LRKSGKKVI

SEQ ID NO: 261852 - protein, 9 aa, Dengue virus
YRGAKRMAI

SEQ ID NO: 261853 - protein, 9 aa, Dengue virus
LLLMRTSWA

SEQ ID NO: 261854 - protein, 9 aa, Dengue virus
ISYGGGWRL

SEQ ID NO: 261855 - protein, 9 aa, Dengue virus
YWVSCGTGN

SEQ ID NO: 261856 - protein, 9 aa, Dengue virus
FTNMEVQLI

SEQ ID NO: 261857 - protein, 9 aa, Dengue virus
SVAARGYIS

SEQ ID NO: 261858 - protein, 9 aa, Dengue virus
LIGRARISQ

SEQ ID NO: 261859 - protein, 9 aa, Dengue virus
YAQMWTLMY

SEQ ID NO: 261860 - protein, 9 aa, Dengue virus
FLEFEALGF

SEQ ID NO: 261861 - protein, 9 aa, Dengue virus
CYVITGRSA

SEQ ID NO: 261862 - protein, 9 aa, Dengue virus
HKMDLGVPL

SEQ ID NO: 261863 - protein, 9 aa, Dengue virus
DLRLASNAI

SEQ ID NO: 261864 - protein, 9 aa, Dengue virus
LTLATGPIL

SEQ ID NO: 261865 - protein, 9 aa, Dengue virus
LALGCYSQV

SEQ ID NO: 261866 - protein, 9 aa, Dengue virus
FCEALTLAT

SEQ ID NO: 261867 - protein, 9 aa, Dengue virus
SKMDLGVPL

SEQ ID NO: 261868 - protein, 9 aa, Dengue virus
IKRGLRTLI

SEQ ID NO: 261869 - protein, 9 aa, Dengue virus
LIRCPLSRN

SEQ ID NO: 261870 - protein, 9 aa, Dengue virus
TYQNKVVKV

SEQ ID NO: 261871 - protein, 9 aa, Dengue virus
FQPESPARV

SEQ ID NO: 261872 - protein, 9 aa, Dengue virus
SKMDIGVPL

SEQ ID NO: 261873 - protein, 9 aa, Dengue virus
MLQGQGPMK

SEQ ID NO: 261874 - protein, 9 aa, Dengue virus
YISTRVEMG

SEQ ID NO: 261875 - protein, 9 aa, Dengue virus
HWFSRGNSF

SEQ ID NO: 261876 - protein, 9 aa, Dengue virus
FVVDNVHTR

SEQ ID NO: 261877 - protein, 9 aa, Dengue virus
SLRTTTVSG

SEQ ID NO: 261878 - protein, 9 aa, Dengue virus
WFSRENSLS

SEQ ID NO: 261879 - protein, 9 aa, Dengue virus
WSLMYFHRR

SEQ ID NO: 261880 - protein, 9 aa, Dengue virus
IRYQTPAIR

SEQ ID NO: 261881 - protein, 9 aa, Dengue virus
WNTTIAVSM

SEQ ID NO: 261882 - protein, 9 aa, Dengue virus
WNTTIAVSM

SEQ ID NO: 261883 - protein, 9 aa, Dengue virus
YCGGLKNVT

SEQ ID NO: 261884 - protein, 9 aa, Dengue virus
YGWNIVKLM

SEQ ID NO: 261885 - protein, 9 aa, Dengue virus
NTTIAVSTA

SEQ ID NO: 261886 - protein, 9 aa, Dengue virus
VSILASSFL

SEQ ID NO: 261887 - protein, 9 aa, Dengue virus
VLPMVTQIA

SEQ ID NO: 261888 - protein, 9 aa, Dengue virus
IEESRTIRV

SEQ ID NO: 261889 - protein, 9 aa, Dengue virus
LSLAAIANQ

SEQ ID NO: 261890 - protein, 9 aa, Dengue virus
MRTTWALCE

SEQ ID NO: 261891 - protein, 9 aa, Dengue virus
IFVADNVHT

SEQ ID NO: 261892 - protein, 9 aa, Dengue virus
VQLIRQMEA

SEQ ID NO: 261893 - protein, 9 aa, Dengue virus
VVTRSGAYV

SEQ ID NO: 261894 - protein, 9 aa, Dengue virus
IRSATRMEN

SEQ ID NO: 261895 - protein, 9 aa, Dengue virus
FMALVAFLR

SEQ ID NO: 261896 - protein, 9 aa, Dengue virus
MGLDKGWPL

SEQ ID NO: 261897 - protein, 9 aa, Dengue virus
VSRGSSKIR

SEQ ID NO: 261898 - protein, 9 aa, Dengue virus
WIASSIILE

SEQ ID NO: 261899 - protein, 9 aa, Dengue virus
VEAGRTLRV

SEQ ID NO: 261900 - protein, 9 aa, Dengue virus
LLKNDVPLA

SEQ ID NO: 261901 - protein, 9 aa, Dengue virus
VVPMVTQLA

SEQ ID NO: 261902 - protein, 9 aa, Dengue virus
VWLAYKVAA

SEQ ID NO: 261903 - protein, 9 aa, Dengue virus
KRFSRGMLQ

SEQ ID NO: 261904 - protein, 9 aa, Dengue virus
PRWLDARIY

SEQ ID NO: 261905 - protein, 9 aa, Dengue virus
TWSIHAHHQ

SEQ ID NO: 261906 - protein, 9 aa, Dengue virus
WALCEVLTL

SEQ ID NO: 261907 - protein, 9 aa, Dengue virus
LLKNDVPLA

SEQ ID NO: 261908 - protein, 9 aa, Dengue virus
IRRGLRTLI

SEQ ID NO: 261909 - protein, 9 aa, Dengue virus
IVSILASSL

SEQ ID NO: 261910 - protein, 9 aa, Dengue virus
IMKNPTVDG

SEQ ID NO: 261911 - protein, 9 aa, Dengue virus
IVSILASSL

SEQ ID NO: 261912 - protein, 9 aa, Dengue virus
MRLLSPVRV

SEQ ID NO: 261913 - protein, 9 aa, Dengue virus
WVSCGTGNI

SEQ ID NO: 261914 - protein, 9 aa, Dengue virus
VWFVPSIKT

SEQ ID NO: 261915 - protein, 9 aa, Dengue virus
YNLIVMDEA

SEQ ID NO: 261916 - protein, 9 aa, Dengue virus
YYCGGLKNV

SEQ ID NO: 261917 - protein, 9 aa, Dengue virus
TLRVLSLVE

SEQ ID NO: 261918 - protein, 9 aa, Dengue virus
YAGHLKCKV

SEQ ID NO: 261919 - protein, 9 aa, Dengue virus
FQADSPKRL

SEQ ID NO: 261920 - protein, 9 aa, Dengue virus
DLRLASMAI

SEQ ID NO: 261921 - protein, 9 aa, Dengue virus
NIVSSVNMI

SEQ ID NO: 261922 - protein, 9 aa, Dengue virus
IKRGLRTLI

SEQ ID NO: 261923 - protein, 9 aa, Dengue virus
CGIRSTTRL

SEQ ID NO: 261924 - protein, 9 aa, Dengue virus
VTQVLLMRT

SEQ ID NO: 261925 - protein, 9 aa, Dengue virus
ILLMRTTWA

SEQ ID NO: 261926 - protein, 9 aa, Dengue virus
IVSSVNMVS

SEQ ID NO: 261927 - protein, 9 aa, Dengue virus
LSGRGPLKL

SEQ ID NO: 261928 - protein, 9 aa, Dengue virus
LIGLTSRAT

SEQ ID NO: 261929 - protein, 9 aa, Dengue virus
LLILCASQI

SEQ ID NO: 261930 - protein, 9 aa, Dengue virus
LVTFKNPHA

SEQ ID NO: 261931 - protein, 9 aa, Dengue virus
VSQGAGWSL

SEQ ID NO: 261932 - protein, 9 aa, Dengue virus
IVSAVNMTS

SEQ ID NO: 261933 - protein, 9 aa, Dengue virus
LIALNDMGK

SEQ ID NO: 261934 - protein, 9 aa, Dengue virus
IKDSKAVHA

SEQ ID NO: 261935 - protein, 9 aa, Dengue virus
TIRVLKMVE

SEQ ID NO: 261936 - protein, 9 aa, Dengue virus
YGWNLVRLQ

SEQ ID NO: 261937 - protein, 9 aa, Dengue virus
FCEVLTLAT

SEQ ID NO: 261938 - protein, 9 aa, Dengue virus
LLKNDIPMT

SEQ ID NO: 261939 - protein, 9 aa, Dengue virus
VALAPHVGL

SEQ ID NO: 261940 - protein, 9 aa, Dengue virus
IIMDEAHFT

SEQ ID NO: 261941 - protein, 9 aa, Dengue virus
WKIEKASFI

SEQ ID NO: 261942 - protein, 9 aa, Dengue virus
YSQVNPLTL

SEQ ID NO: 261943 - protein, 9 aa, Dengue virus
YRGAKRMAI

SEQ ID NO: 261944 - protein, 9 aa, Dengue virus
VKLHSGVDV

SEQ ID NO: 261945 - protein, 9 aa, Dengue virus
YYMATLKNV

SEQ ID NO: 261946 - protein, 9 aa, Dengue virus
CIKVLNPYM

SEQ ID NO: 261947 - protein, 9 aa, Dengue virus
MGLGKGWPL

SEQ ID NO: 261948 - protein, 9 aa, Dengue virus
VNGVVKLLT

SEQ ID NO: 261949 - protein, 9 aa, Dengue virus
VWIQDNPNM

SEQ ID NO: 261950 - protein, 9 aa, Dengue virus
FCESLTLAT

SEQ ID NO: 261951 - protein, 9 aa, Dengue virus
WHVTRGSVI

SEQ ID NO: 261952 - protein, 9 aa, Dengue virus
FLRVLSIPP

SEQ ID NO: 261953 - protein, 9 aa, Dengue virus
YLPAMVREA

SEQ ID NO: 261954 - protein, 9 aa, Dengue virus
LGKGWPLHR

SEQ ID NO: 261955 - protein, 9 aa, Dengue virus
VALAPHVGM

SEQ ID NO: 261956 - protein, 9 aa, Dengue virus
ISYGGGWRL

SEQ ID NO: 261957 - protein, 9 aa, Dengue virus
FHTMWHVTR

SEQ ID NO: 261958 - protein, 9 aa, Dengue virus
FLNDMGKVR

SEQ ID NO: 261959 - protein, 9 aa, Dengue virus
IANQAAVLM

SEQ ID NO: 261960 - protein, 9 aa, Dengue virus
SLAAIANQA

SEQ ID NO: 261961 - protein, 9 aa, Dengue virus
MYWVSNASG

SEQ ID NO: 261962 - protein, 9 aa, Dengue virus
VKRFSTGLL

SEQ ID NO: 261963 - protein, 9 aa, Dengue virus
MVREAIRRG

SEQ ID NO: 261964 - protein, 9 aa, Dengue virus
QTWMSSEGA

SEQ ID NO: 261965 - protein, 9 aa, Dengue virus
YGMEIRPLK

SEQ ID NO: 261966 - protein, 9 aa, Dengue virus
LRKSGKRVI

SEQ ID NO: 261967 - protein, 9 aa, Dengue virus
RIYADPMAL

SEQ ID NO: 261968 - protein, 9 aa, Dengue virus
YMWLGARFL

SEQ ID NO: 261969 - protein, 9 aa, Dengue virus
YGWNLVKLH

SEQ ID NO: 261970 - protein, 9 aa, Dengue virus
FWNTTIAVS

SEQ ID NO: 261971 - protein, 9 aa, Dengue virus
TKRILPSIV

SEQ ID NO: 261972 - protein, 9 aa, Dengue virus
VIPMVTQMA

SEQ ID NO: 261973 - protein, 9 aa, Dengue virus
YYCGGLKNV

SEQ ID NO: 261974 - protein, 9 aa, Dengue virus
SRTIRVLKM

SEQ ID NO: 261975 - protein, 9 aa, Dengue virus
IENTTANIS

SEQ ID NO: 261976 - protein, 9 aa, Dengue virus
FQPESPKRL

SEQ ID NO: 261977 - protein, 9 aa, Dengue virus
LVRCPLSRN

SEQ ID NO: 261978 - protein, 9 aa, Dengue virus
FCKKVRSNA

SEQ ID NO: 261979 - protein, 9 aa, Dengue virus
WCNATSAWV

SEQ ID NO: 261980 - protein, 9 aa, Dengue virus
VLTLATGPV

SEQ ID NO: 261981 - protein, 9 aa, Dengue virus
YRIMQRGLF

SEQ ID NO: 261982 - protein, 9 aa, Dengue virus
WMTTEDMLS

SEQ ID NO: 261983 - protein, 9 aa, Dengue virus
YAVSRGTSK

SEQ ID NO: 261984 - protein, 9 aa, Dengue virus
IFMTATPPG

SEQ ID NO: 261985 - protein, 9 aa, Dengue virus
LGSQEGAMH

SEQ ID NO: 261986 - protein, 9 aa, Dengue virus
FQADSPSKL

SEQ ID NO: 261987 - protein, 9 aa, Dengue virus
FCSHHFHQL

SEQ ID NO: 261988 - protein, 9 aa, Dengue virus
FGKGSLITC

SEQ ID NO: 261989 - protein, 9 aa, Dengue virus
WALCESITL

SEQ ID NO: 261990 - protein, 9 aa, Dengue virus
LHRLGYILR

SEQ ID NO: 261991 - protein, 9 aa, Dengue virus
RKYLPAIVR

SEQ ID NO: 261992 - protein, 9 aa, Dengue virus
ITPMLRHSI

SEQ ID NO: 261993 - protein, 9 aa, Dengue virus
LVSILLSSL

SEQ ID NO: 261994 - protein, 9 aa, Dengue virus
YQNKVVRVQ

SEQ ID NO: 261995 - protein, 9 aa, Dengue virus
VITGRSADL

SEQ ID NO: 261996 - protein, 9 aa, Dengue virus
LHPASAWTL

SEQ ID NO: 261997 - protein, 9 aa, Dengue virus
YVITGRSAD

SEQ ID NO: 261998 - protein, 9 aa, Dengue virus
WNIVKLHSG

SEQ ID NO: 261999 - protein, 9 aa, Dengue virus
FSGVSWIMK

SEQ ID NO: 262000 - protein, 9 aa, Dengue virus
GHLKCRLKM

SEQ ID NO: 262001 - protein, 9 aa, Dengue virus
FLEFEALGF

SEQ ID NO: 262002 - protein, 9 aa, Dengue virus
TITLLVKLA

SEQ ID NO: 262003 - protein, 9 aa, Dengue virus
ITLATGPLS

SEQ ID NO: 262004 - protein, 9 aa, Dengue virus
IRYQTTAVK

SEQ ID NO: 262005 - protein, 9 aa, Dengue virus
YAQMWALMY

SEQ ID NO: 262006 - protein, 9 aa, Dengue virus
LKRERNRVS

SEQ ID NO: 262007 - protein, 9 aa, Dengue virus
MGLGKGWPL

SEQ ID NO: 262008 - protein, 9 aa, Dengue virus
YNLIIMDEA

SEQ ID NO: 262009 - protein, 9 aa, Dengue virus
IALDFSPGT

SEQ ID NO: 262010 - protein, 9 aa, Dengue virus
GFGVFSTNI

SEQ ID NO: 262011 - protein, 9 aa, Dengue virus
MMRTTWALC

SEQ ID NO: 262012 - protein, 9 aa, Dengue virus
NVSLAAIAN

SEQ ID NO: 262013 - protein, 9 aa, Dengue virus
IVREAIKRK

SEQ ID NO: 262014 - protein, 9 aa, Dengue virus
VTPMLRHTI

SEQ ID NO: 262015 - protein, 9 aa, Dengue virus
MGLGKGWPI

SEQ ID NO: 262016 - protein, 9 aa, Dengue virus
FETTMRGAK

SEQ ID NO: 262017 - protein, 9 aa, Dengue virus
IIMDEAHFT

SEQ ID NO: 262018 - protein, 9 aa, Dengue virus
TKRILPSIV

SEQ ID NO: 262019 - protein, 9 aa, Dengue virus
SVALVPHVG

SEQ ID NO: 262020 - protein, 9 aa, Dengue virus
FRGSYLAGA

SEQ ID NO: 262021 - protein, 9 aa, Dengue virus
IFITDNVHT

SEQ ID NO: 262022 - protein, 9 aa, Dengue virus
TTWSIHAKH

SEQ ID NO: 262023 - protein, 9 aa, Dengue virus
MINGVVKLL

SEQ ID NO: 262024 - protein, 9 aa, Dengue virus
VQLIRQMEA

SEQ ID NO: 262025 - protein, 9 aa, Dengue virus
YAQMWTLMY

SEQ ID NO: 262026 - protein, 9 aa, Dengue virus
YNMMGKREK

SEQ ID NO: 262027 - protein, 9 aa, Dengue virus
FLRFLTIPP

SEQ ID NO: 262028 - protein, 9 aa, Dengue virus
WVSGVSGNI

SEQ ID NO: 262029 - protein, 9 aa, Dengue virus
VVTRSGTYV

SEQ ID NO: 262030 - protein, 9 aa, Dengue virus
ITLATGPLS

SEQ ID NO: 262031 - protein, 9 aa, Dengue virus
FQADSPKRL

SEQ ID NO: 262032 - protein, 9 aa, Dengue virus
IRYQTPAIR

SEQ ID NO: 262033 - protein, 9 aa, Dengue virus
YFHRRDLRL

SEQ ID NO: 262034 - protein, 9 aa, Dengue virus
IRYQTTAVK

SEQ ID NO: 262035 - protein, 9 aa, Dengue virus
YAVATTIVT

SEQ ID NO: 262036 - protein, 9 aa, Dengue virus
LVKLMSGKD

SEQ ID NO: 262037 - protein, 9 aa, Dengue virus
LVTFKTAHA

SEQ ID NO: 262038 - protein, 9 aa, Dengue virus
IVSSVNMIS

SEQ ID NO: 262039 - protein, 9 aa, Dengue virus
YRIKQQGIL

SEQ ID NO: 262040 - protein, 9 aa, Dengue virus
MVTFKVPHA

SEQ ID NO: 262041 - protein, 9 aa, Dengue virus
WNTTIAVSM

SEQ ID NO: 262042 - protein, 9 aa, Dengue virus
LVTFKNPHA

SEQ ID NO: 262043 - protein, 9 aa, Dengue virus
YRGAKRMAI

SEQ ID NO: 262044 - protein, 9 aa, Dengue virus
KFWNTTIAV

SEQ ID NO: 262045 - protein, 9 aa, Dengue virus
FHTMWHVTR

SEQ ID NO: 262046 - protein, 9 aa, Dengue virus
PMSTYGWNL

SEQ ID NO: 262047 - protein, 9 aa, Dengue virus
IVSSVNTIS

SEQ ID NO: 262048 - protein, 9 aa, Dengue virus
FKLTYQNKV

SEQ ID NO: 262049 - protein, 9 aa, Dengue virus
IAKSKPTLD

SEQ ID NO: 262050 - protein, 9 aa, Dengue virus
TVSQLAKRF

SEQ ID NO: 262051 - protein, 9 aa, Dengue virus
FSGVSWIMK

SEQ ID NO: 262052 - protein, 9 aa, Dengue virus
LLILCASQI

SEQ ID NO: 262053 - protein, 9 aa, Dengue virus
VRSNAAIGA

SEQ ID NO: 262054 - protein, 9 aa, Dengue virus
LVSLLGSSL

SEQ ID NO: 262055 - protein, 9 aa, Dengue virus
YLPAIVREA

SEQ ID NO: 262056 - protein, 9 aa, Dengue virus
LKCRLRMDK

SEQ ID NO: 262057 - protein, 9 aa, Dengue virus
FEKQLGQVM

SEQ ID NO: 262058 - protein, 9 aa, Dengue virus
FGKGSLVTC

SEQ ID NO: 262059 - protein, 9 aa, Dengue virus
IFMTATPPG

SEQ ID NO: 262060 - protein, 9 aa, Dengue virus
VEAGRTLRV

SEQ ID NO: 262061 - protein, 9 aa, Dengue virus
IFMTATPPG

SEQ ID NO: 262062 - protein, 9 aa, Dengue virus
IVSSVNMIS

SEQ ID NO: 262063 - protein, 9 aa, Dengue virus
MINGVVRLL

SEQ ID NO: 262064 - protein, 9 aa, Dengue virus
VEAGRTLRV

SEQ ID NO: 262065 - protein, 9 aa, Dengue virus
LIGLTARAT

SEQ ID NO: 262066 - protein, 9 aa, Dengue virus
IIREAIKRK

SEQ ID NO: 262067 - protein, 9 aa, Dengue virus
LVSLLGSSL

SEQ ID NO: 262068 - protein, 9 aa, Dengue virus
FQPESPARL

SEQ ID NO: 262069 - protein, 9 aa, Dengue virus
WYGMEIRPI

SEQ ID NO: 262070 - protein, 9 aa, Dengue virus
LSSLLKNDV

SEQ ID NO: 262071 - protein, 9 aa, Dengue virus
ITLATGPLS

SEQ ID NO: 262072 - protein, 9 aa, Dengue virus
WSIHATHQW

SEQ ID NO: 262073 - protein, 9 aa, Dengue virus
IRYQTPAIR

SEQ ID NO: 262074 - protein, 9 aa, Dengue virus
TRKYLPAII

SEQ ID NO: 262075 - protein, 9 aa, Dengue virus
WCNATSAWV

SEQ ID NO: 262076 - protein, 9 aa, Dengue virus
FQADSPKKL

SEQ ID NO: 262077 - protein, 9 aa, Dengue virus
VIPMVTQMA

SEQ ID NO: 262078 - protein, 9 aa, Dengue virus
MLRHSIENS

SEQ ID NO: 262079 - protein, 9 aa, Dengue virus
IVSILASSL

SEQ ID NO: 262080 - protein, 9 aa, Dengue virus
VITLATGPL

SEQ ID NO: 262081 - protein, 9 aa, Dengue virus
IRYQTTAVK

SEQ ID NO: 262082 - protein, 9 aa, Dengue virus
VKRFSTGLL

SEQ ID NO: 262083 - protein, 9 aa, Dengue virus
YMWLGARYL

SEQ ID NO: 262084 - protein, 9 aa, Dengue virus
IVSAVNMTS

SEQ ID NO: 262085 - protein, 9 aa, Dengue virus
IRYQTTAVK

SEQ ID NO: 262086 - protein, 9 aa, Dengue virus
FLAIPPTAG

SEQ ID NO: 262087 - protein, 9 aa, Dengue virus
YGWNLVRLQ

SEQ ID NO: 262088 - protein, 9 aa, Dengue virus
YRGAKRMAI

SEQ ID NO: 262089 - protein, 9 aa, Dengue virus
ISRMLINRF

SEQ ID NO: 262090 - protein, 9 aa, Dengue virus
AVSRGSAKL

SEQ ID NO: 262091 - protein, 9 aa, Dengue virus
GLFGKGSLL

SEQ ID NO: 262092 - protein, 9 aa, Dengue virus
FKTAHAKKQ

SEQ ID NO: 262093 - protein, 9 aa, Dengue virus
YISTRVEMG

SEQ ID NO: 262094 - protein, 9 aa, Dengue virus
LLRNDVPMA

SEQ ID NO: 262095 - protein, 9 aa, Dengue virus
MGLGKGWPI

SEQ ID NO: 262096 - protein, 9 aa, Dengue virus
WKLARASFI

SEQ ID NO: 262097 - protein, 9 aa, Dengue virus
TRLLSSTRV

SEQ ID NO: 262098 - protein, 9 aa, Dengue virus
TACLGKSYA

SEQ ID NO: 262099 - protein, 9 aa, Dengue virus
WISNGTGNI

SEQ ID NO: 262100 - protein, 9 aa, Dengue virus
IAKNKPTLD

SEQ ID NO: 262101 - protein, 9 aa, Dengue virus
FQADSPKRL

SEQ ID NO: 262102 - protein, 9 aa, Dengue virus
ISKMLLNRF

SEQ ID NO: 262103 - protein, 9 aa, Dengue virus
ISQGAGWSL

SEQ ID NO: 262104 - protein, 9 aa, Dengue virus
WVSCGTGNI

SEQ ID NO: 262105 - protein, 9 aa, Dengue virus
MGLGKGWPI

SEQ ID NO: 262106 - protein, 9 aa, Dengue virus
CVKILNPYM

SEQ ID NO: 262107 - protein, 9 aa, Dengue virus
WMTTEDMLA

SEQ ID NO: 262108 - protein, 9 aa, Dengue virus
TVQQLTKRF

SEQ ID NO: 262109 - protein, 9 aa, Dengue virus
LRLASNAIC

SEQ ID NO: 262110 - protein, 9 aa, Dengue virus
YRIKQQGIL

SEQ ID NO: 262111 - protein, 9 aa, Dengue virus
ITPMLRHTI

SEQ ID NO: 262112 - protein, 9 aa, Dengue virus
VTQVLLMRT

SEQ ID NO: 262113 - protein, 9 aa, Dengue virus
WAYHGSYEV

SEQ ID NO: 262114 - protein, 9 aa, Dengue virus
FLRFLAIPP

SEQ ID NO: 262115 - protein, 9 aa, Dengue virus
WHVTRGAVL

SEQ ID NO: 262116 - protein, 9 aa, Dengue virus
IGKMFETTM

SEQ ID NO: 262117 - protein, 9 aa, Dengue virus
FVVDNVHTR

SEQ ID NO: 262118 - protein, 9 aa, Dengue virus
YQFQPESPA

SEQ ID NO: 262119 - protein, 9 aa, Dengue virus
WMSAEGAWR

SEQ ID NO: 262120 - protein, 9 aa, Dengue virus
LAAIANQAV

SEQ ID NO: 262121 - protein, 9 aa, Dengue virus
FLAIPPTAG

SEQ ID NO: 262122 - protein, 9 aa, Dengue virus
IRYQTTATK

SEQ ID NO: 262123 - protein, 9 aa, Dengue virus
YRIMQRGLF

SEQ ID NO: 262124 - protein, 9 aa, Dengue virus
IFITNNVHT

SEQ ID NO: 262125 - protein, 9 aa, Dengue virus
LAMTDTTPF

SEQ ID NO: 262126 - protein, 9 aa, Dengue virus
LYAVATTFI

SEQ ID NO: 262127 - protein, 9 aa, Dengue virus
HRVDLGVPL

SEQ ID NO: 262128 - protein, 9 aa, Dengue virus
TLRVLSLVE

SEQ ID NO: 262129 - protein, 9 aa, Dengue virus
RKKLRPRWL

SEQ ID NO: 262130 - protein, 9 aa, Dengue virus
IFVIDNVHT

SEQ ID NO: 262131 - protein, 9 aa, Dengue virus
WNIVKLHSG

SEQ ID NO: 262132 - protein, 9 aa, Dengue virus
VSRGSAKLR

SEQ ID NO: 262133 - protein, 9 aa, Dengue virus
LTILLKATL

SEQ ID NO: 262134 - protein, 9 aa, Dengue virus
ATTVLTPML

SEQ ID NO: 262135 - protein, 9 aa, Dengue virus
VILAGPIPV

SEQ ID NO: 262136 - protein, 9 aa, Dengue virus
LRTLILAPT

SEQ ID NO: 262137 - protein, 9 aa, Dengue virus
ILLMRTTWA

SEQ ID NO: 262138 - protein, 9 aa, Dengue virus
FHQLIMKDG

SEQ ID NO: 262139 - protein, 9 aa, Dengue virus
YAQMWSLMY

SEQ ID NO: 262140 - protein, 9 aa, Dengue virus
LHRLGYILR

SEQ ID NO: 262141 - protein, 9 aa, Dengue virus
WCNATSAWV

SEQ ID NO: 262142 - protein, 9 aa, Dengue virus
FHTMWHVTR

SEQ ID NO: 262143 - protein, 9 aa, Dengue virus
FTNMEVQLI

SEQ ID NO: 262144 - protein, 9 aa, Dengue virus
VKATGSASS

SEQ ID NO: 262145 - protein, 9 aa, Dengue virus
LIGLSSRAT

SEQ ID NO: 262146 - protein, 9 aa, Dengue virus
LLLMRTSWA

SEQ ID NO: 262147 - protein, 9 aa, Dengue virus
YISTRVEMG

SEQ ID NO: 262148 - protein, 9 aa, Dengue virus
SKVDIGVPL

SEQ ID NO: 262149 - protein, 9 aa, Dengue virus
LHKLGKCGS

SEQ ID NO: 262150 - protein, 9 aa, Dengue virus
WVSGVSGNI

SEQ ID NO: 262151 - protein, 9 aa, Dengue virus
IENTTANIS

SEQ ID NO: 262152 - protein, 9 aa, Dengue virus
YLEFEALGF

SEQ ID NO: 262153 - protein, 9 aa, Dengue virus
YKFQADSPS

SEQ ID NO: 262154 - protein, 9 aa, Dengue virus
FTNMEVQLI

SEQ ID NO: 262155 - protein, 9 aa, Dengue virus
NTTANISLA

SEQ ID NO: 262156 - protein, 9 aa, Dengue virus
YYCAGLKKV

SEQ ID NO: 262157 - protein, 9 aa, Dengue virus
LRMVLAFIT

SEQ ID NO: 262158 - protein, 9 aa, Dengue virus
VLTLATGPI

SEQ ID NO: 262159 - protein, 9 aa, Dengue virus
VTYSLNTFT

SEQ ID NO: 262160 - protein, 9 aa, Dengue virus
MGLDKGWPL

SEQ ID NO: 262161 - protein, 9 aa, Dengue virus
WMTTEDMLS

SEQ ID NO: 262162 - protein, 9 aa, Dengue virus
ARGYISTRV

SEQ ID NO: 262163 - protein, 9 aa, Dengue virus
LTLATGPVL

SEQ ID NO: 262164 - protein, 9 aa, Dengue virus
VRLQSGVDV

SEQ ID NO: 262165 - protein, 9 aa, Dengue virus
LRTLILAPT

SEQ ID NO: 262166 - protein, 9 aa, Dengue virus
FCSHHFHQL

SEQ ID NO: 262167 - protein, 9 aa, Dengue virus
VVTKSGTYV

SEQ ID NO: 262168 - protein, 9 aa, Dengue virus
VTVASAAQR

SEQ ID NO: 262169 - protein, 9 aa, Dengue virus
YSQIGAGVY

SEQ ID NO: 262170 - protein, 9 aa, Dengue virus
VTYSLNTFT

SEQ ID NO: 262171 - protein, 9 aa, Dengue virus
QRGILGRSQ

SEQ ID NO: 262172 - protein, 9 aa, Dengue virus
LKRVRNRVS

SEQ ID NO: 262173 - protein, 9 aa, Dengue virus
TIENTTANI

SEQ ID NO: 262174 - protein, 9 aa, Dengue virus
LMCHATFTM

SEQ ID NO: 262175 - protein, 9 aa, Dengue virus
VMAFIAFLR

SEQ ID NO: 262176 - protein, 9 aa, Dengue virus
IFVIDNVHT

SEQ ID NO: 262177 - protein, 9 aa, Dengue virus
AVSMANIFR

SEQ ID NO: 262178 - protein, 9 aa, Dengue virus
YMWLGARFL

SEQ ID NO: 262179 - protein, 9 aa, Dengue virus
VTYGLNTFT

SEQ ID NO: 262180 - protein, 9 aa, Dengue virus
IHMENVFHT

SEQ ID NO: 262181 - protein, 9 aa, Dengue virus
LLLMRTSWA

SEQ ID NO: 262182 - protein, 9 aa, Dengue virus
FKEFAAGRR

SEQ ID NO: 262183 - protein, 9 aa, Dengue virus
FNMLKRARN

SEQ ID NO: 262184 - protein, 9 aa, Dengue virus
VVKLLTKPW

SEQ ID NO: 262185 - protein, 9 aa, Dengue virus
WAYHGSYEV

SEQ ID NO: 262186 - protein, 9 aa, Dengue virus
WCNLTSTWV

SEQ ID NO: 262187 - protein, 9 aa, Dengue virus
FGRAKGSRA

SEQ ID NO: 262188 - protein, 9 aa, Dengue virus
YRILQRGLL

SEQ ID NO: 262189 - protein, 9 aa, Dengue virus
YISTRVGMG

SEQ ID NO: 262190 - protein, 9 aa, Dengue virus
TANISLTAI

SEQ ID NO: 262191 - protein, 9 aa, Dengue virus
LKGMPIRYQ

SEQ ID NO: 262192 - protein, 9 aa, Dengue virus
LSGRGPLKL

SEQ ID NO: 262193 - protein, 9 aa, Dengue virus
VMAFIAFLR

SEQ ID NO: 262194 - protein, 9 aa, Dengue virus
FKLTYQNKV

SEQ ID NO: 262195 - protein, 9 aa, Dengue virus
LLKNDVPLA

SEQ ID NO: 262196 - protein, 9 aa, Dengue virus
VKLMSGKDV

SEQ ID NO: 262197 - protein, 9 aa, Dengue virus
DLRLASNAI

SEQ ID NO: 262198 - protein, 9 aa, Dengue virus
YSQVNPTTL

SEQ ID NO: 262199 - protein, 9 aa, Dengue virus
LTLATGPVS

SEQ ID NO: 262200 - protein, 9 aa, Dengue virus
IRSTTRLEN

SEQ ID NO: 262201 - protein, 9 aa, Dengue virus
SMVNGVVRL

SEQ ID NO: 262202 - protein, 9 aa, Dengue virus
TTTASGKLI

SEQ ID NO: 262203 - protein, 9 aa, Dengue virus
WLAHKVASE

SEQ ID NO: 262204 - protein, 9 aa, Dengue virus
YFHRRDLRL

SEQ ID NO: 262205 - protein, 9 aa, Dengue virus
AVSRGTAKL

SEQ ID NO: 262206 - protein, 9 aa, Dengue virus
VKLHSGVDV

SEQ ID NO: 262207 - protein, 9 aa, Dengue virus
FCSHHFHQL

SEQ ID NO: 262208 - protein, 9 aa, Dengue virus
VSRGTAKLQ

SEQ ID NO: 262209 - protein, 9 aa, Dengue virus
YFHRRDLRL

SEQ ID NO: 262210 - protein, 9 aa, Dengue virus
LVSLLGSSL

SEQ ID NO: 262211 - protein, 9 aa, Dengue virus
RKKLRPRWL

SEQ ID NO: 262212 - protein, 9 aa, Dengue virus
IEAGRTLRV

SEQ ID NO: 262213 - protein, 9 aa, Dengue virus
FITPMLRHS

SEQ ID NO: 262214 - protein, 9 aa, Dengue virus
CYSQVNPIT

SEQ ID NO: 262215 - protein, 9 aa, Dengue virus
CYVITGRSA

SEQ ID NO: 262216 - protein, 9 aa, Dengue virus
LLRNDVPLA

SEQ ID NO: 262217 - protein, 9 aa, Dengue virus
SRLLLNRFT

SEQ ID NO: 262218 - protein, 9 aa, Dengue virus
FKTAHAKKQ

SEQ ID NO: 262219 - protein, 9 aa, Dengue virus
IVSAVNMTS

SEQ ID NO: 262220 - protein, 9 aa, Dengue virus
FGIFTTNIW

SEQ ID NO: 262221 - protein, 9 aa, Dengue virus
LRLAANAIC

SEQ ID NO: 262222 - protein, 9 aa, Dengue virus
FITFLRVLS

SEQ ID NO: 262223 - protein, 9 aa, Dengue virus
YGWNLVKLM

SEQ ID NO: 262224 - protein, 9 aa, Dengue virus
VRSNAALGA

SEQ ID NO: 262225 - protein, 9 aa, Dengue virus
AYVMTGRSA

SEQ ID NO: 262226 - protein, 9 aa, Dengue virus
FTNMEAQLI

SEQ ID NO: 262227 - protein, 9 aa, Dengue virus
FQADSPKRL

SEQ ID NO: 262228 - protein, 9 aa, Dengue virus
MRLLSPVRV

SEQ ID NO: 262229 - protein, 9 aa, Dengue virus
YRILQRGLL

SEQ ID NO: 262230 - protein, 9 aa, Dengue virus
VVKLLTKPW

SEQ ID NO: 262231 - protein, 9 aa, Dengue virus
TACLGKAYA

SEQ ID NO: 262232 - protein, 9 aa, Dengue virus
TFITPMMRH

SEQ ID NO: 262233 - protein, 9 aa, Dengue virus
TLYAVATTI

SEQ ID NO: 262234 - protein, 9 aa, Dengue virus
LRHSIENSS

SEQ ID NO: 262235 - protein, 9 aa, Dengue virus
MVSILASAL

SEQ ID NO: 262236 - protein, 9 aa, Dengue virus
FQPESPARL

SEQ ID NO: 262237 - protein, 9 aa, Dengue virus
FCSHHFHEL

SEQ ID NO: 262238 - protein, 9 aa, Dengue virus
LTAIANQAT

SEQ ID NO: 262239 - protein, 9 aa, Dengue virus
FTNMEAQLI

SEQ ID NO: 262240 - protein, 9 aa, Dengue virus
WLDARVYSD

SEQ ID NO: 262241 - protein, 9 aa, Dengue virus
RLLTKPWDV

SEQ ID NO: 262242 - protein, 9 aa, Dengue virus
VALTPHSGM

SEQ ID NO: 262243 - protein, 9 aa, Dengue virus
FQADSPKRL

SEQ ID NO: 262244 - protein, 9 aa, Dengue virus
LAAIANQAT

SEQ ID NO: 262245 - protein, 9 aa, Dengue virus
MFKKKNLTI

SEQ ID NO: 262246 - protein, 9 aa, Dengue virus
SKMLLNRFT

SEQ ID NO: 262247 - protein, 9 aa, Dengue virus
WAFCEALTL

SEQ ID NO: 262248 - protein, 9 aa, Dengue virus
YWIESALND

SEQ ID NO: 262249 - protein, 9 aa, Dengue virus
VTQVLLMRT

SEQ ID NO: 262250 - protein, 9 aa, Dengue virus
AVSRGSAKL

SEQ ID NO: 262251 - protein, 9 aa, Dengue virus
LRPASAWTL

SEQ ID NO: 262252 - protein, 9 aa, Dengue virus
YWVSCGTGN

SEQ ID NO: 262253 - protein, 9 aa, Dengue virus
HRVDLGVPL

SEQ ID NO: 262254 - protein, 9 aa, Dengue virus
VRSNAAIGA

SEQ ID NO: 262255 - protein, 9 aa, Dengue virus
VRSTTRLEN

SEQ ID NO: 262256 - protein, 9 aa, Dengue virus
WKLARASFI

SEQ ID NO: 262257 - protein, 9 aa, Dengue virus
MGLGRGWPL

SEQ ID NO: 262258 - protein, 9 aa, Dengue virus
YAIIGPGLQ

SEQ ID NO: 262259 - protein, 9 aa, Dengue virus
YNLIIMDEA

SEQ ID NO: 262260 - protein, 9 aa, Dengue virus
FQADSPKRL

SEQ ID NO: 262261 - protein, 9 aa, Dengue virus
LSSLLRNDV

SEQ ID NO: 262262 - protein, 9 aa, Dengue virus
FCSHHFHKI

SEQ ID NO: 262263 - protein, 9 aa, Dengue virus
SIENSSVNV

SEQ ID NO: 262264 - protein, 9 aa, Dengue virus
FVVDNVHTR

SEQ ID NO: 262265 - protein, 9 aa, Dengue virus
CYSQVNPLT

SEQ ID NO: 262266 - protein, 9 aa, Dengue virus
SVNTTSRLL

SEQ ID NO: 262267 - protein, 9 aa, Dengue virus
IFMKDGREI

SEQ ID NO: 262268 - protein, 9 aa, Dengue virus
YVITGTSAD

SEQ ID NO: 262269 - protein, 9 aa, Dengue virus
IFVTDNVHT

SEQ ID NO: 262270 - protein, 9 aa, Dengue virus
VKRFSTGLL

SEQ ID NO: 262271 - protein, 9 aa, Dengue virus
WISNGTGNI

SEQ ID NO: 262272 - protein, 9 aa, Dengue virus
LRGLPIRYQ

SEQ ID NO: 262273 - protein, 9 aa, Dengue virus
YRILQRGLL

SEQ ID NO: 262274 - protein, 9 aa, Dengue virus
LRWIVERGM

SEQ ID NO: 262275 - protein, 9 aa, Dengue virus
LMRTSWAFC

SEQ ID NO: 262276 - protein, 9 aa, Dengue virus
IHMENVFHT

SEQ ID NO: 262277 - protein, 9 aa, Dengue virus
YQFQPESPA

SEQ ID NO: 262278 - protein, 9 aa, Dengue virus
FHRRDLRLA

SEQ ID NO: 262279 - protein, 9 aa, Dengue virus
YMATLKNVR

SEQ ID NO: 262280 - protein, 9 aa, Dengue virus
LKGMPIRYQ

SEQ ID NO: 262281 - protein, 9 aa, Dengue virus
FKLTYQNKV

SEQ ID NO: 262282 - protein, 9 aa, Dengue virus
VWFVPSIKT

SEQ ID NO: 262283 - protein, 9 aa, Dengue virus
YAQMWTLMY

SEQ ID NO: 262284 - protein, 9 aa, Dengue virus
FHELIMKDG

SEQ ID NO: 262285 - protein, 9 aa, Dengue virus
YWIESALND

SEQ ID NO: 262286 - protein, 9 aa, Dengue virus
FKAERVIDP

SEQ ID NO: 262287 - protein, 9 aa, Dengue virus
YTALFGGVS

SEQ ID NO: 262288 - protein, 9 aa, Dengue virus
LTILLKATL

SEQ ID NO: 262289 - protein, 9 aa, Dengue virus
VNGVVRLLT

SEQ ID NO: 262290 - protein, 9 aa, Dengue virus
FLEFEALGF

SEQ ID NO: 262291 - protein, 9 aa, Dengue virus
LTIMDLHPG

SEQ ID NO: 262292 - protein, 9 aa, Dengue virus
MLKVWNRVW

SEQ ID NO: 262293 - protein, 9 aa, Dengue virus
LIGLTSRAT

SEQ ID NO: 262294 - protein, 9 aa, Dengue virus
IENSTANVS

SEQ ID NO: 262295 - protein, 9 aa, Dengue virus
ISRMLINRF

SEQ ID NO: 262296 - protein, 9 aa, Dengue virus
FLAIPPTAG

SEQ ID NO: 262297 - protein, 9 aa, Dengue virus
WLAHKVAAE

SEQ ID NO: 262298 - protein, 9 aa, Dengue virus
SVALAPHVG

SEQ ID NO: 262299 - protein, 9 aa, Dengue virus
IVSAVNMTS

SEQ ID NO: 262300 - protein, 9 aa, Dengue virus
LLAMGCYSQ

SEQ ID NO: 262301 - protein, 9 aa, Dengue virus
YLPAIVREA

SEQ ID NO: 262302 - protein, 9 aa, Dengue virus
FCEVLTLAT

SEQ ID NO: 262303 - protein, 9 aa, Dengue virus
VVTTSGTYV

SEQ ID NO: 262304 - protein, 9 aa, Dengue virus
FHTMWHVTR

SEQ ID NO: 262305 - protein, 9 aa, Dengue virus
IEEGRTLRV

SEQ ID NO: 262306 - protein, 9 aa, Dengue virus
YRGAKRMAI

SEQ ID NO: 262307 - protein, 9 aa, Dengue virus
KRFSLGLLS

SEQ ID NO: 262308 - protein, 9 aa, Dengue virus
FSTGLLNGK

SEQ ID NO: 262309 - protein, 9 aa, Dengue virus
IFVADNVHT

SEQ ID NO: 262310 - protein, 9 aa, Dengue virus
SIENSSVNV

SEQ ID NO: 262311 - protein, 9 aa, Dengue virus
LKRRLRTLI

SEQ ID NO: 262312 - protein, 9 aa, Dengue virus
YLPAIIREA

SEQ ID NO: 262313 - protein, 9 aa, Dengue virus
YVITGTSAD

SEQ ID NO: 262314 - protein, 9 aa, Dengue virus
WCNATSAWV

SEQ ID NO: 262315 - protein, 9 aa, Dengue virus
FCSHHFHEL

SEQ ID NO: 262316 - protein, 9 aa, Dengue virus
LHPASAWTL

SEQ ID NO: 262317 - protein, 9 aa, Dengue virus
LRKSGKKVI

SEQ ID NO: 262318 - protein, 9 aa, Dengue virus
RMAILGDTA

SEQ ID NO: 262319 - protein, 9 aa, Dengue virus
YYCAGLKKV

SEQ ID NO: 262320 - protein, 9 aa, Dengue virus
IMKNPTVDG

SEQ ID NO: 262321 - protein, 9 aa, Dengue virus
AVSRGSAKL

SEQ ID NO: 262322 - protein, 9 aa, Dengue virus
SVAARGYIS

SEQ ID NO: 262323 - protein, 9 aa, Dengue virus
HRMDIGVPL

SEQ ID NO: 262324 - protein, 9 aa, Dengue virus
MLVRNPLSR

SEQ ID NO: 262325 - protein, 9 aa, Dengue virus
IFRGSYLAG

SEQ ID NO: 262326 - protein, 9 aa, Dengue virus
VNMTSKMLL

SEQ ID NO: 262327 - protein, 9 aa, Dengue virus
VYNMMGKRE

SEQ ID NO: 262328 - protein, 9 aa, Dengue virus
MGLGKGWPI

SEQ ID NO: 262329 - protein, 9 aa, Dengue virus
SIAARGYIS

SEQ ID NO: 262330 - protein, 9 aa, Dengue virus
IKRKLRTLV

SEQ ID NO: 262331 - protein, 9 aa, Dengue virus
FCSHHFHKI

SEQ ID NO: 262332 - protein, 9 aa, Dengue virus
LQGQGPMKM

SEQ ID NO: 262333 - protein, 9 aa, Dengue virus
AVNMTSKML

SEQ ID NO: 262334 - protein, 9 aa, Dengue virus
WALCESITL

SEQ ID NO: 262335 - protein, 9 aa, Dengue virus
RVYSDPLAL

SEQ ID NO: 262336 - protein, 9 aa, Dengue virus
YKFQPESPS

SEQ ID NO: 262337 - protein, 9 aa, Dengue virus
YRIKQRGIL

SEQ ID NO: 262338 - protein, 9 aa, Dengue virus
LKRVRNRVS

SEQ ID NO: 262339 - protein, 9 aa, Dengue virus
LTAIANQAV

SEQ ID NO: 262340 - protein, 9 aa, Dengue virus
KLLTKPWDV

SEQ ID NO: 262341 - protein, 9 aa, Dengue virus
FLRFLAIPP

SEQ ID NO: 262342 - protein, 9 aa, Dengue virus
YRIMQRGLF

SEQ ID NO: 262343 - protein, 9 aa, Dengue virus
FHKIFMKDG

SEQ ID NO: 262344 - protein, 9 aa, Dengue virus
TWSIHAKHQ

SEQ ID NO: 262345 - protein, 9 aa, Dengue virus
IFITNNVHT

SEQ ID NO: 262346 - protein, 9 aa, Dengue virus
LILAPTRVV

SEQ ID NO: 262347 - protein, 9 aa, Dengue virus
ANIFRGSYL

SEQ ID NO: 262348 - protein, 9 aa, Dengue virus
HRMDLGVPL

SEQ ID NO: 262349 - protein, 9 aa, Dengue virus
WVSGATGNI

SEQ ID NO: 262350 - protein, 9 aa, Dengue virus
FGKAKGSRA

SEQ ID NO: 262351 - protein, 9 aa, Dengue virus
LRKSGKRVI

SEQ ID NO: 262352 - protein, 9 aa, Dengue virus
NRVSTGSQL

SEQ ID NO: 262353 - protein, 9 aa, Dengue virus
VTHSSAAQR

SEQ ID NO: 262354 - protein, 9 aa, Dengue virus
LQWIVERGM

SEQ ID NO: 262355 - protein, 9 aa, Dengue virus
YGWNIVKLH

SEQ ID NO: 262356 - protein, 9 aa, Dengue virus
IEESRTIRV

SEQ ID NO: 262357 - protein, 9 aa, Dengue virus
FTSKVRSNA

SEQ ID NO: 262358 - protein, 9 aa, Dengue virus
TTWSIHAKH

SEQ ID NO: 262359 - protein, 9 aa, Dengue virus
LLNGKGPLR

SEQ ID NO: 262360 - protein, 9 aa, Dengue virus
YKFQPESPS

SEQ ID NO: 262361 - protein, 9 aa, Dengue virus
GFGIFTTNI

SEQ ID NO: 262362 - protein, 9 aa, Dengue virus
VLTLATGPI

SEQ ID NO: 262363 - protein, 9 aa, Dengue virus
LKGMPIRYQ

SEQ ID NO: 262364 - protein, 9 aa, Dengue virus
VWFVPSIKA

SEQ ID NO: 262365 - protein, 9 aa, Dengue virus
FTNMEVQLI

SEQ ID NO: 262366 - protein, 9 aa, Dengue virus
VWFVPSIKS

SEQ ID NO: 262367 - protein, 9 aa, Dengue virus
YTALFSGVS

SEQ ID NO: 262368 - protein, 9 aa, Dengue virus
WALMYFHRR

SEQ ID NO: 262369 - protein, 9 aa, Dengue virus
LLRNDVPLA

SEQ ID NO: 262370 - protein, 9 aa, Dengue virus
LTAIANQAA

SEQ ID NO: 262371 - protein, 9 aa, Dengue virus
PMATYGWNL

SEQ ID NO: 262372 - protein, 9 aa, Dengue virus
WKIEKASFI

SEQ ID NO: 262373 - protein, 9 aa, Dengue virus
YLPAIVREA

SEQ ID NO: 262374 - protein, 9 aa, Dengue virus
SKLMSAAIK

SEQ ID NO: 262375 - protein, 9 aa, Dengue virus
LVMKDGRKL

SEQ ID NO: 262376 - protein, 9 aa, Dengue virus
FRGSYLAGA

SEQ ID NO: 262377 - protein, 9 aa, Dengue virus
MVTQLAMTD

SEQ ID NO: 262378 - protein, 9 aa, Dengue virus
YAQMWSLMY

SEQ ID NO: 262379 - protein, 9 aa, Dengue virus
IRYQTPAIR

SEQ ID NO: 262380 - protein, 9 aa, Dengue virus
IYSDPLALR

SEQ ID NO: 262381 - protein, 9 aa, Dengue virus
WKLEKASFI

SEQ ID NO: 262382 - protein, 9 aa, Dengue virus
FEKQLGQIM

SEQ ID NO: 262383 - protein, 9 aa, Dengue virus
FGMFTTNIW

SEQ ID NO: 262384 - protein, 9 aa, Dengue virus
HRMDIGVPL

SEQ ID NO: 262385 - protein, 9 aa, Dengue virus
HWFSRGNSL

SEQ ID NO: 262386 - protein, 9 aa, Dengue virus
ICGIRSTTR

SEQ ID NO: 262387 - protein, 9 aa, Dengue virus
LRGLPIRYQ

SEQ ID NO: 262388 - protein, 9 aa, Dengue virus
FRAERVIDP

SEQ ID NO: 262389 - protein, 9 aa, Dengue virus
YWIESSKNQ

SEQ ID NO: 262390 - protein, 9 aa, Dengue virus
YYCGGLKNV

SEQ ID NO: 262391 - protein, 9 aa, Dengue virus
YLPAIVREA

SEQ ID NO: 262392 - protein, 9 aa, Dengue virus
YRLRGEARK

SEQ ID NO: 262393 - protein, 9 aa, Dengue virus
YFHRRDLRL

SEQ ID NO: 262394 - protein, 9 aa, Dengue virus
YAVATTIVT

SEQ ID NO: 262395 - protein, 9 aa, Dengue virus
IKRGLRTLI

SEQ ID NO: 262396 - protein, 9 aa, Dengue virus
IALDFSPGT

SEQ ID NO: 262397 - protein, 9 aa, Dengue virus
FQADSPKRL

SEQ ID NO: 262398 - protein, 9 aa, Dengue virus
YNLIVMDEA

SEQ ID NO: 262399 - protein, 9 aa, Dengue virus
LAIGCYSQV

SEQ ID NO: 262400 - protein, 9 aa, Dengue virus
IREAIKRKL

SEQ ID NO: 262401 - protein, 9 aa, Dengue virus
VVTTSGTYV

SEQ ID NO: 262402 - protein, 9 aa, Dengue virus
IEAGRTLRV

SEQ ID NO: 262403 - protein, 9 aa, Dengue virus
NISLTAIAN

SEQ ID NO: 262404 - protein, 9 aa, Dengue virus
AVSRGSSKL

SEQ ID NO: 262405 - protein, 9 aa, Dengue virus
LIGLSSRAT

SEQ ID NO: 262406 - protein, 9 aa, Dengue virus
YSQVNPITL

SEQ ID NO: 262407 - protein, 9 aa, Dengue virus
LQWIASAIV

SEQ ID NO: 262408 - protein, 9 aa, Dengue virus
YFHRRDLRL

SEQ ID NO: 262409 - protein, 9 aa, Dengue virus
FWNTTIAVS

SEQ ID NO: 262410 - protein, 9 aa, Dengue virus
WIASAIVLE

SEQ ID NO: 262411 - protein, 9 aa, Dengue virus
IENSTANVS

SEQ ID NO: 262412 - protein, 9 aa, Dengue virus
VVKLLTKPW

SEQ ID NO: 262413 - protein, 9 aa, Dengue virus
PLKLFMAFV

SEQ ID NO: 262414 - protein, 9 aa, Dengue virus
VNVSLTAIA

SEQ ID NO: 262415 - protein, 9 aa, Dengue virus
PLRMVLAFI

SEQ ID NO: 262416 - protein, 9 aa, Dengue virus
FCKKVRSNA

SEQ ID NO: 262417 - protein, 9 aa, Dengue virus
MINGVVKLL

SEQ ID NO: 262418 - protein, 9 aa, Dengue virus
LTLATGPIL

SEQ ID NO: 262419 - protein, 9 aa, Dengue virus
LRMVLAFIT

SEQ ID NO: 262420 - protein, 9 aa, Dengue virus
LTAIANQAV

SEQ ID NO: 262421 - protein, 9 aa, Dengue virus
IKRGLRTLI

SEQ ID NO: 262422 - protein, 9 aa, Dengue virus
YISTRVEMG

SEQ ID NO: 262423 - protein, 9 aa, Dengue virus
LSGRGPLKL

SEQ ID NO: 262424 - protein, 9 aa, Dengue virus
FITPMMRHT

SEQ ID NO: 262425 - protein, 9 aa, Dengue virus
IANQAAILM

SEQ ID NO: 262426 - protein, 9 aa, Dengue virus
YLAGAGLLF

SEQ ID NO: 262427 - protein, 9 aa, Dengue virus
YCGGLKNVK

SEQ ID NO: 262428 - protein, 9 aa, Dengue virus
SRMLLNRFT

SEQ ID NO: 262429 - protein, 9 aa, Dengue virus
LTAIANQAA

SEQ ID NO: 262430 - protein, 9 aa, Dengue virus
CVTTMAKNK

SEQ ID NO: 262431 - protein, 9 aa, Dengue virus
WMTTEDMLA

SEQ ID NO: 262432 - protein, 9 aa, Dengue virus
YLPAIVREA

SEQ ID NO: 262433 - protein, 9 aa, Dengue virus
IYSDPLALR

SEQ ID NO: 262434 - protein, 9 aa, Dengue virus
GCYSQVNPL

SEQ ID NO: 262435 - protein, 9 aa, Dengue virus
FTNMEAQLI

SEQ ID NO: 262436 - protein, 9 aa, Dengue virus
LKRRLRTLI

SEQ ID NO: 262437 - protein, 9 aa, Dengue virus
LSLAAIANQ

SEQ ID NO: 262438 - protein, 9 aa, Dengue virus
LAAIANQAV

SEQ ID NO: 262439 - protein, 9 aa, Dengue virus
YKFQPESPA

SEQ ID NO: 262440 - protein, 9 aa, Dengue virus
IEEGRTLRV

SEQ ID NO: 262441 - protein, 9 aa, Dengue virus
YRIMQRGLF

SEQ ID NO: 262442 - protein, 9 aa, Dengue virus
FRGSYLAGA

SEQ ID NO: 262443 - protein, 9 aa, Dengue virus
KRKLRTLIL

SEQ ID NO: 262444 - protein, 9 aa, Dengue virus
PFCSHHFHK

SEQ ID NO: 262445 - protein, 9 aa, Dengue virus
VALAPHVGL

SEQ ID NO: 262446 - protein, 9 aa, Dengue virus
IRYQTPAVK

SEQ ID NO: 262447 - protein, 9 aa, Dengue virus
VKRFSSELL

SEQ ID NO: 262448 - protein, 9 aa, Dengue virus
FLRFLTIPP

SEQ ID NO: 262449 - protein, 9 aa, Dengue virus
LGRGWPLHR

SEQ ID NO: 262450 - protein, 9 aa, Dengue virus
LVTFKNPHA

SEQ ID NO: 262451 - protein, 9 aa, Dengue virus
CHATFTTRL

SEQ ID NO: 262452 - protein, 9 aa, Dengue virus
FCKKVRSNA

SEQ ID NO: 262453 - protein, 9 aa, Dengue virus
VWFVPSIKA

SEQ ID NO: 262454 - protein, 9 aa, Dengue virus
AVSRGSAKL

SEQ ID NO: 262455 - protein, 9 aa, Dengue virus
AKRFSRGML

SEQ ID NO: 262456 - protein, 9 aa, Dengue virus
IVASVNTTS

SEQ ID NO: 262457 - protein, 9 aa, Dengue virus
YISTRVGMG

SEQ ID NO: 262458 - protein, 9 aa, Dengue virus
IRYQTPAVK

SEQ ID NO: 262459 - protein, 9 aa, Dengue virus
LILAPTRVV

SEQ ID NO: 262460 - protein, 9 aa, Dengue virus
WKIEKASFI

SEQ ID NO: 262461 - protein, 9 aa, Dengue virus
NIVSSVNMI

SEQ ID NO: 262462 - protein, 9 aa, Dengue virus
YKFQPESPA

SEQ ID NO: 262463 - protein, 9 aa, Dengue virus
YISTRVGMG

SEQ ID NO: 262464 - protein, 9 aa, Dengue virus
LFSGVSWMI

SEQ ID NO: 262465 - protein, 9 aa, Dengue virus
FGKGSLITC

SEQ ID NO: 262466 - protein, 9 aa, Dengue virus
LTLATGPIT

SEQ ID NO: 262467 - protein, 9 aa, Dengue virus
AVSRGSAKL

SEQ ID NO: 262468 - protein, 9 aa, Dengue virus
FCKKVRSNA

SEQ ID NO: 262469 - protein, 9 aa, Dengue virus
CLRKSGKKV

SEQ ID NO: 262470 - protein, 9 aa, Dengue virus
YAIIGPGLQ

SEQ ID NO: 262471 - protein, 9 aa, Dengue virus
KCRLKMDKL

SEQ ID NO: 262472 - protein, 9 aa, Dengue virus
WFSRENSLS

SEQ ID NO: 262473 - protein, 9 aa, Dengue virus
GRTLRVLSL

SEQ ID NO: 262474 - protein, 9 aa, Dengue virus
LVKLMSGKD

SEQ ID NO: 262475 - protein, 9 aa, Dengue virus
LILAPTRVV

SEQ ID NO: 262476 - protein, 9 aa, Dengue virus
IFVVDNVHT

SEQ ID NO: 262477 - protein, 9 aa, Dengue virus
HRLMSAAIK

SEQ ID NO: 262478 - protein, 9 aa, Dengue virus
MGLGRGWPL

SEQ ID NO: 262479 - protein, 9 aa, Dengue virus
IVSSVNTIS

SEQ ID NO: 262480 - protein, 9 aa, Dengue virus
RQWFLNLPL

SEQ ID NO: 262481 - protein, 9 aa, Dengue virus
GHLKCRLKM

SEQ ID NO: 262482 - protein, 9 aa, Dengue virus
LRKSGKRVI

SEQ ID NO: 262483 - protein, 9 aa, Dengue virus
VVKLLTKPW

SEQ ID NO: 262484 - protein, 9 aa, Dengue virus
LVRCPLSRN

SEQ ID NO: 262485 - protein, 9 aa, Dengue virus
LAAIANQAV

SEQ ID NO: 262486 - protein, 9 aa, Dengue virus
LTIMDLHPG

SEQ ID NO: 262487 - protein, 9 aa, Dengue virus
LISYGGGWR

SEQ ID NO: 262488 - protein, 9 aa, Dengue virus
CIKILNPYM

SEQ ID NO: 262489 - protein, 9 aa, Dengue virus
WHVTRGAVL

SEQ ID NO: 262490 - protein, 9 aa, Dengue virus
TACLGKAYA

SEQ ID NO: 262491 - protein, 9 aa, Dengue virus
WSIHASHEW

SEQ ID NO: 262492 - protein, 9 aa, Dengue virus
WVSNASGNI

SEQ ID NO: 262493 - protein, 9 aa, Dengue virus
WMTTEDMLT

SEQ ID NO: 262494 - protein, 9 aa, Dengue virus
VVRLLTKPW

SEQ ID NO: 262495 - protein, 9 aa, Dengue virus
VLTLATGPV

SEQ ID NO: 262496 - protein, 9 aa, Dengue virus
LTAIANQAA

SEQ ID NO: 262497 - protein, 9 aa, Dengue virus
YSQVNPTTL

SEQ ID NO: 262498 - protein, 9 aa, Dengue virus
LTLATGPVL

SEQ ID NO: 262499 - protein, 9 aa, Dengue virus
IVREAIKRK

SEQ ID NO: 262500 - protein, 9 aa, Dengue virus
YSQVNPITL

SEQ ID NO: 262501 - protein, 9 aa, Dengue virus
FKEFASGRK

SEQ ID NO: 262502 - protein, 9 aa, Dengue virus
LIGLTSRAT

SEQ ID NO: 262503 - protein, 9 aa, Dengue virus
VNGVVKLLT

SEQ ID NO: 262504 - protein, 9 aa, Dengue virus
LTLATGPIT

SEQ ID NO: 262505 - protein, 9 aa, Dengue virus
FKTAHAKKQ

SEQ ID NO: 262506 - protein, 9 aa, Dengue virus
ISKMLINRF

SEQ ID NO: 262507 - protein, 9 aa, Dengue virus
LVSLLGSSL

SEQ ID NO: 262508 - protein, 9 aa, Dengue virus
FHTMWHVTR

SEQ ID NO: 262509 - protein, 9 aa, Dengue virus
LAAIANQAA

SEQ ID NO: 262510 - protein, 9 aa, Dengue virus
IAVSTANIF

SEQ ID NO: 262511 - protein, 9 aa, Dengue virus
SVALVPHVG

SEQ ID NO: 262512 - protein, 9 aa, Dengue virus
LLLMRTSWA

SEQ ID NO: 262513 - protein, 9 aa, Dengue virus
TRKYLPAII

SEQ ID NO: 262514 - protein, 9 aa, Dengue virus
LYGNGVVTR

SEQ ID NO: 262515 - protein, 9 aa, Dengue virus
WIASAIILE

SEQ ID NO: 262516 - protein, 9 aa, Dengue virus
FGKAKGSRA

SEQ ID NO: 262517 - protein, 9 aa, Dengue virus
IKKVRTNAA

SEQ ID NO: 262518 - protein, 9 aa, Dengue virus
YVITGRSAD

SEQ ID NO: 262519 - protein, 9 aa, Dengue virus
FKNAHAKRQ

SEQ ID NO: 262520 - protein, 9 aa, Dengue virus
HRVDLGVPL

SEQ ID NO: 262521 - protein, 9 aa, Dengue virus
IRYQTPAIR

SEQ ID NO: 262522 - protein, 9 aa, Dengue virus
LSGRGPLKL

SEQ ID NO: 262523 - protein, 9 aa, Dengue virus
LTAIANQAV

SEQ ID NO: 262524 - protein, 9 aa, Dengue virus
WVSGVSGNI

SEQ ID NO: 262525 - protein, 9 aa, Dengue virus
VMAFIAFLR

SEQ ID NO: 262526 - protein, 9 aa, Dengue virus
LLKNDVPLA

SEQ ID NO: 262527 - protein, 9 aa, Dengue virus
YLEFEALGF

SEQ ID NO: 262528 - protein, 9 aa, Dengue virus
LIGLSSRAT

SEQ ID NO: 262529 - protein, 9 aa, Dengue virus
SLRTTTVSG

SEQ ID NO: 262530 - protein, 9 aa, Dengue virus
TRKYLPAIV

SEQ ID NO: 262531 - protein, 9 aa, Dengue virus
RIKQKGIFG

SEQ ID NO: 262532 - protein, 9 aa, Dengue virus
MGLGKGWPI

SEQ ID NO: 262533 - protein, 9 aa, Dengue virus
QDNQLAYVV

SEQ ID NO: 262534 - protein, 9 aa, Dengue virus
VEAGRTLRV

SEQ ID NO: 262535 - protein, 9 aa, Dengue virus
IFRGSYLAG

SEQ ID NO: 262536 - protein, 9 aa, Dengue virus
FVIDNVHTR

SEQ ID NO: 262537 - protein, 9 aa, Dengue virus
IVSILASSL

SEQ ID NO: 262538 - protein, 9 aa, Dengue virus
AVSRGSSKI

SEQ ID NO: 262539 - protein, 9 aa, Dengue virus
WISNGTGNI

SEQ ID NO: 262540 - protein, 9 aa, Dengue virus
GSYLAGAGL

SEQ ID NO: 262541 - protein, 9 aa, Dengue virus
FLAIPPTAG

SEQ ID NO: 262542 - protein, 9 aa, Dengue virus
TTTASGKLV

SEQ ID NO: 262543 - protein, 9 aa, Dengue virus
VQLIRQMEA

SEQ ID NO: 262544 - protein, 9 aa, Dengue virus
LTKRFSLGL

SEQ ID NO: 262545 - protein, 9 aa, Dengue virus
LKGMPIRYQ

SEQ ID NO: 262546 - protein, 9 aa, Dengue virus
ATTIVTPML

SEQ ID NO: 262547 - protein, 9 aa, Dengue virus
LTPMLRHSI

SEQ ID NO: 262548 - protein, 9 aa, Dengue virus
VVPMVTQLA

SEQ ID NO: 262549 - protein, 9 aa, Dengue virus
IVSSVNMVS

SEQ ID NO: 262550 - protein, 9 aa, Dengue virus
LRTLILAPT

SEQ ID NO: 262551 - protein, 9 aa, Dengue virus
FHTMWHVTR

SEQ ID NO: 262552 - protein, 9 aa, Dengue virus
LQWIASAIV

SEQ ID NO: 262553 - protein, 9 aa, Dengue virus
VVRLLTKPW

SEQ ID NO: 262554 - protein, 9 aa, Dengue virus
FCEVLTLAT

SEQ ID NO: 262555 - protein, 9 aa, Dengue virus
IVKLHSGKD

SEQ ID NO: 262556 - protein, 9 aa, Dengue virus
TTWSIHAKH

SEQ ID NO: 262557 - protein, 9 aa, Dengue virus
LKGLPIRYQ

SEQ ID NO: 262558 - protein, 9 aa, Dengue virus
MYWISNGTG

SEQ ID NO: 262559 - protein, 9 aa, Dengue virus
WKLEKASFI

SEQ ID NO: 262560 - protein, 9 aa, Dengue virus
FHTMWHVTR

SEQ ID NO: 262561 - protein, 9 aa, Dengue virus
LIGLSSRAT

SEQ ID NO: 262562 - protein, 9 aa, Dengue virus
YVITGTSAD

SEQ ID NO: 262563 - protein, 9 aa, Dengue virus
MYWISNGTG

SEQ ID NO: 262564 - protein, 9 aa, Dengue virus
WALCESITL

SEQ ID NO: 262565 - protein, 9 aa, Dengue virus
WAFCEALTL

SEQ ID NO: 262566 - protein, 9 aa, Dengue virus
YAQMWSLMY

SEQ ID NO: 262567 - protein, 9 aa, Dengue virus
FMGHLKCRL

SEQ ID NO: 262568 - protein, 9 aa, Dengue virus
IYADPMALK

SEQ ID NO: 262569 - protein, 9 aa, Dengue virus
WAYHGSYEV

SEQ ID NO: 262570 - protein, 9 aa, Dengue virus
LKRVRNRVS

SEQ ID NO: 262571 - protein, 9 aa, Dengue virus
FLNDMGKVR

SEQ ID NO: 262572 - protein, 9 aa, Dengue virus
IFVADNVHT

SEQ ID NO: 262573 - protein, 9 aa, Dengue virus
YGWNIVKLH

SEQ ID NO: 262574 - protein, 9 aa, Dengue virus
YFHRRDLRL

SEQ ID NO: 262575 - protein, 9 aa, Dengue virus
IFRKRRLTI

SEQ ID NO: 262576 - protein, 9 aa, Dengue virus
SKMDLGVPL

SEQ ID NO: 262577 - protein, 9 aa, Dengue virus
ILLMRTTWA

SEQ ID NO: 262578 - protein, 9 aa, Dengue virus
TFITPMLRH

SEQ ID NO: 262579 - protein, 9 aa, Dengue virus
WKLEKASFI

SEQ ID NO: 262580 - protein, 9 aa, Dengue virus
TKRILPSIV

SEQ ID NO: 262581 - protein, 9 aa, Dengue virus
TTTASGKLI

SEQ ID NO: 262582 - protein, 9 aa, Dengue virus
FHTMWHVTR

SEQ ID NO: 262583 - protein, 9 aa, Dengue virus
LVSILLSSL

SEQ ID NO: 262584 - protein, 9 aa, Dengue virus
LTLATGPVL

SEQ ID NO: 262585 - protein, 9 aa, Dengue virus
LLKNDVPLA

SEQ ID NO: 262586 - protein, 9 aa, Dengue virus
IAVSMANIF

SEQ ID NO: 262587 - protein, 9 aa, Dengue virus
FLTIPPTAG

SEQ ID NO: 262588 - protein, 9 aa, Dengue virus
VKRFSTGLL

SEQ ID NO: 262589 - protein, 9 aa, Dengue virus
SVALAPHVG

SEQ ID NO: 262590 - protein, 9 aa, Dengue virus
VWFVPSIKA

SEQ ID NO: 262591 - protein, 9 aa, Dengue virus
HHFHKIFMK

SEQ ID NO: 262592 - protein, 9 aa, Dengue virus
YAVATTVLT

SEQ ID NO: 262593 - protein, 9 aa, Dengue virus
YVITGTSAD

SEQ ID NO: 262594 - protein, 9 aa, Dengue virus
WAFCEVLTL

SEQ ID NO: 262595 - protein, 9 aa, Dengue virus
YTALFSGVS

SEQ ID NO: 262596 - protein, 9 aa, Dengue virus
MVREAIRRG

SEQ ID NO: 262597 - protein, 9 aa, Dengue virus
TTTVSGKLI

SEQ ID NO: 262598 - protein, 9 aa, Dengue virus
TRKYLPAII

SEQ ID NO: 262599 - protein, 9 aa, Dengue virus
SLRTTTVTG

SEQ ID NO: 262600 - protein, 9 aa, Dengue virus
FGRAKGSRA

SEQ ID NO: 262601 - protein, 9 aa, Dengue virus
AVSRGSAKL

SEQ ID NO: 262602 - protein, 9 aa, Dengue virus
TMRGAKRMA

SEQ ID NO: 262603 - protein, 9 aa, Dengue virus
TLYAVATTV

SEQ ID NO: 262604 - protein, 9 aa, Dengue virus
VVTTSGTYV

SEQ ID NO: 262605 - protein, 9 aa, Dengue virus
TQVLLMRTT

SEQ ID NO: 262606 - protein, 9 aa, Dengue virus
MVTFKVPHA

SEQ ID NO: 262607 - protein, 9 aa, Dengue virus
WLAHKVAAE

SEQ ID NO: 262608 - protein, 9 aa, Dengue virus
FWNTTIAVS

SEQ ID NO: 262609 - protein, 9 aa, Dengue virus
HWFSRGNSL

SEQ ID NO: 262610 - protein, 9 aa, Dengue virus
IRSTTRLEN

SEQ ID NO: 262611 - protein, 9 aa, Dengue virus
FVIDNVHTR

SEQ ID NO: 262612 - protein, 9 aa, Dengue virus
VTPMLRHTI

SEQ ID NO: 262613 - protein, 9 aa, Dengue virus
LTLATGPIT

SEQ ID NO: 262614 - protein, 9 aa, Dengue virus
LIMKDGRSL

SEQ ID NO: 262615 - protein, 9 aa, Dengue virus
WLVHRQWFL

SEQ ID NO: 262616 - protein, 9 aa, Dengue virus
LKRVRNRVS

SEQ ID NO: 262617 - protein, 9 aa, Dengue virus
HRMDLGVPL

SEQ ID NO: 262618 - protein, 9 aa, Dengue virus
LILAPTRVV

SEQ ID NO: 262619 - protein, 9 aa, Dengue virus
ISQGAGWSL

SEQ ID NO: 262620 - protein, 9 aa, Dengue virus
YISTRVEMG

SEQ ID NO: 262621 - protein, 9 aa, Dengue virus
IFITNNVHT

SEQ ID NO: 262622 - protein, 9 aa, Dengue virus
SVALVPHVG

SEQ ID NO: 262623 - protein, 9 aa, Dengue virus
FQPESPSRL

SEQ ID NO: 262624 - protein, 9 aa, Dengue virus
YLAGAGLAF

SEQ ID NO: 262625 - protein, 9 aa, Dengue virus
VMAFIAFLR

SEQ ID NO: 262626 - protein, 9 aa, Dengue virus
FTNMEVQLI

SEQ ID NO: 262627 - protein, 9 aa, Dengue virus
LMRTSWAFC

SEQ ID NO: 262628 - protein, 9 aa, Dengue virus
LGRGWPIHR

SEQ ID NO: 262629 - protein, 9 aa, Dengue virus
LILAPTRVV

SEQ ID NO: 262630 - protein, 9 aa, Dengue virus
FQADSPKRL

SEQ ID NO: 262631 - protein, 9 aa, Dengue virus
ISLAAIANQ

SEQ ID NO: 262632 - protein, 9 aa, Dengue virus
MGLDKGWPL

SEQ ID NO: 262633 - protein, 9 aa, Dengue virus
YVSAIAQAK

SEQ ID NO: 262634 - protein, 9 aa, Dengue virus
FTNMEVQLI

SEQ ID NO: 262635 - protein, 9 aa, Dengue virus
LVTFKNPHA

SEQ ID NO: 262636 - protein, 9 aa, Dengue virus
VRSNAALGA

SEQ ID NO: 262637 - protein, 9 aa, Dengue virus
TYGLNTFTN

SEQ ID NO: 262638 - protein, 9 aa, Dengue virus
LIMKDGRVL

SEQ ID NO: 262639 - protein, 9 aa, Dengue virus
YGMEIRPLK

SEQ ID NO: 262640 - protein, 9 aa, Dengue virus
LGKSYAQMW

SEQ ID NO: 262641 - protein, 9 aa, Dengue virus
VLTLATGPV

SEQ ID NO: 262642 - protein, 9 aa, Dengue virus
LQGQGPMKM

SEQ ID NO: 262643 - protein, 9 aa, Dengue virus
YNHALNELP

SEQ ID NO: 262644 - protein, 9 aa, Dengue virus
YTTMFGGVS

SEQ ID NO: 262645 - protein, 9 aa, Dengue virus
YAIIGPGLQ

SEQ ID NO: 262646 - protein, 9 aa, Dengue virus
VTYSLNTFT

SEQ ID NO: 262647 - protein, 9 aa, Dengue virus
FRAERVIDP

SEQ ID NO: 262648 - protein, 9 aa, Dengue virus
LMSAAVKDQ

SEQ ID NO: 262649 - protein, 9 aa, Dengue virus
SVNMISRML

SEQ ID NO: 262650 - protein, 9 aa, Dengue virus
FSGQGPMKL

SEQ ID NO: 262651 - protein, 9 aa, Dengue virus
YAVSRGTSK

SEQ ID NO: 262652 - protein, 9 aa, Dengue virus
VNGVVRLLT

SEQ ID NO: 262653 - protein, 9 aa, Dengue virus
FGMFTTNIW

SEQ ID NO: 262654 - protein, 9 aa, Dengue virus
TWSIHAKHQ

SEQ ID NO: 262655 - protein, 9 aa, Dengue virus
KFWNTTIAV

SEQ ID NO: 262656 - protein, 9 aa, Dengue virus
YGWNLVKLM

SEQ ID NO: 262657 - protein, 9 aa, Dengue virus
YVITGTSAD

SEQ ID NO: 262658 - protein, 9 aa, Dengue virus
YKFQADSPS

SEQ ID NO: 262659 - protein, 9 aa, Dengue virus
SKMLLNRFT

SEQ ID NO: 262660 - protein, 9 aa, Dengue virus
VQQLTKRFS

SEQ ID NO: 262661 - protein, 9 aa, Dengue virus
IRYQTPAIR

SEQ ID NO: 262662 - protein, 9 aa, Dengue virus
TFITPMMRH

SEQ ID NO: 262663 - protein, 9 aa, Dengue virus
FVADNVHTR

SEQ ID NO: 262664 - protein, 9 aa, Dengue virus
VSRGTAKLQ

SEQ ID NO: 262665 - protein, 9 aa, Dengue virus
YRILQRGLL

SEQ ID NO: 262666 - protein, 9 aa, Dengue virus
LTAIANQAA

SEQ ID NO: 262667 - protein, 9 aa, Dengue virus
FLRFLAIPP

SEQ ID NO: 262668 - protein, 9 aa, Dengue virus
FVIDNVHTR

SEQ ID NO: 262669 - protein, 9 aa, Dengue virus
NRVSTPQGL

SEQ ID NO: 262670 - protein, 9 aa, Dengue virus
IEESRTIRV

SEQ ID NO: 262671 - protein, 9 aa, Dengue virus
WSIHATHQW

SEQ ID NO: 262672 - protein, 9 aa, Dengue virus
LTAIANQAA

SEQ ID NO: 262673 - protein, 9 aa, Dengue virus
VRSNAALGA

SEQ ID NO: 262674 - protein, 9 aa, Dengue virus
YAQMWSLMY

SEQ ID NO: 262675 - protein, 9 aa, Dengue virus
CHATFTMRL

SEQ ID NO: 262676 - protein, 9 aa, Dengue virus
ILLMRTSWA

SEQ ID NO: 262677 - protein, 9 aa, Dengue virus
FTSKVRSNA

SEQ ID NO: 262678 - protein, 9 aa, Dengue virus
FTSKVRSNA

SEQ ID NO: 262679 - protein, 9 aa, Dengue virus
LLRNDVPLA

SEQ ID NO: 262680 - protein, 9 aa, Dengue virus
VWLAHKVAA

SEQ ID NO: 262681 - protein, 9 aa, Dengue virus
TLYAVATTI

SEQ ID NO: 262682 - protein, 9 aa, Dengue virus
YISTRVEMG

SEQ ID NO: 262683 - protein, 9 aa, Dengue virus
IRYQTTAVK

SEQ ID NO: 262684 - protein, 9 aa, Dengue virus
FWNTTIAVS

SEQ ID NO: 262685 - protein, 9 aa, Dengue virus
FMTATPPGS

SEQ ID NO: 262686 - protein, 9 aa, Dengue virus
YRIKQRGIL

SEQ ID NO: 262687 - protein, 9 aa, Dengue virus
FLRFLAIPP

SEQ ID NO: 262688 - protein, 9 aa, Dengue virus
FQADSPKRL

SEQ ID NO: 262689 - protein, 9 aa, Dengue virus
VRSNAALGA

SEQ ID NO: 262690 - protein, 9 aa, Dengue virus
IFVIDNVHT

SEQ ID NO: 262691 - protein, 9 aa, Dengue virus
SKMLLNRFT

SEQ ID NO: 262692 - protein, 9 aa, Dengue virus
SYAQMWALM

SEQ ID NO: 262693 - protein, 9 aa, Dengue virus
FGMFSTNIW

SEQ ID NO: 262694 - protein, 9 aa, Dengue virus
QTWMSSEGA

SEQ ID NO: 262695 - protein, 9 aa, Dengue virus
GFGIFTTNI

SEQ ID NO: 262696 - protein, 9 aa, Dengue virus
VVRLLTKPW

SEQ ID NO: 262697 - protein, 9 aa, Dengue virus
ITLATGPLS

SEQ ID NO: 262698 - protein, 9 aa, Dengue virus
MINGVVKLL

SEQ ID NO: 262699 - protein, 9 aa, Dengue virus
YNMMGKREK

SEQ ID NO: 262700 - protein, 9 aa, Dengue virus
YNMMGKREK

SEQ ID NO: 262701 - protein, 9 aa, Dengue virus
WLAYKVASE

SEQ ID NO: 262702 - protein, 9 aa, Dengue virus
VSILLSSLL

SEQ ID NO: 262703 - protein, 9 aa, Dengue virus
LAFITFLRV

SEQ ID NO: 262704 - protein, 9 aa, Dengue virus
LRPASAWTL

SEQ ID NO: 262705 - protein, 9 aa, Dengue virus
FRAERVIDP

SEQ ID NO: 262706 - protein, 9 aa, Dengue virus
WTLYAVATT

SEQ ID NO: 262707 - protein, 9 aa, Dengue virus
WAFCEVLTL

SEQ ID NO: 262708 - protein, 9 aa, Dengue virus
WKLEKASFI

SEQ ID NO: 262709 - protein, 9 aa, Dengue virus
MGLGKGWPL

SEQ ID NO: 262710 - protein, 9 aa, Dengue virus
LSSLLRNDV

SEQ ID NO: 262711 - protein, 9 aa, Dengue virus
IYSDPLALR

SEQ ID NO: 262712 - protein, 9 aa, Dengue virus
SKMDIGVPL

SEQ ID NO: 262713 - protein, 9 aa, Dengue virus
VWLAYKVAS

SEQ ID NO: 262714 - protein, 9 aa, Dengue virus
ATTFITPML

SEQ ID NO: 262715 - protein, 9 aa, Dengue virus
VVPMVTQLA

SEQ ID NO: 262716 - protein, 9 aa, Dengue virus
IANQATVLM

SEQ ID NO: 262717 - protein, 9 aa, Dengue virus
VSILLSSLL

SEQ ID NO: 262718 - protein, 9 aa, Dengue virus
NSTANVSLA

SEQ ID NO: 262719 - protein, 9 aa, Dengue virus
LMCHATFTT

SEQ ID NO: 262720 - protein, 9 aa, Dengue virus
WFSRENSLS

SEQ ID NO: 262721 - protein, 9 aa, Dengue virus
LLLMRTSWA

SEQ ID NO: 262722 - protein, 9 aa, Dengue virus
WHVTRGAVL

SEQ ID NO: 262723 - protein, 9 aa, Dengue virus
FQEGTFHTM

SEQ ID NO: 262724 - protein, 9 aa, Dengue virus
IVASVNTTS

SEQ ID NO: 262725 - protein, 9 aa, Dengue virus
DLRLASNAI

SEQ ID NO: 262726 - protein, 9 aa, Dengue virus
WNLVKLYSG

SEQ ID NO: 262727 - protein, 9 aa, Dengue virus
VVTTSGTYV

SEQ ID NO: 262728 - protein, 9 aa, Dengue virus
YVMTGRSAD

SEQ ID NO: 262729 - protein, 9 aa, Dengue virus
FLRVLSIPP

SEQ ID NO: 262730 - protein, 9 aa, Dengue virus
WKIEKASFI

SEQ ID NO: 262731 - protein, 9 aa, Dengue virus
PLKLFMALV

SEQ ID NO: 262732 - protein, 9 aa, Dengue virus
IAMTDTTPF

SEQ ID NO: 262733 - protein, 9 aa, Dengue virus
FCEALTLAT

SEQ ID NO: 262734 - protein, 9 aa, Dengue virus
VRSNAAIGA

SEQ ID NO: 262735 - protein, 9 aa, Dengue virus
MGLGKGWPI

SEQ ID NO: 262736 - protein, 9 aa, Dengue virus
FKEFAAGRK

SEQ ID NO: 262737 - protein, 9 aa, Dengue virus
WSLMYFHRR

SEQ ID NO: 262738 - protein, 9 aa, Dengue virus
AVSRGSAKL

SEQ ID NO: 262739 - protein, 9 aa, Dengue virus
FEKQLGQVM

SEQ ID NO: 262740 - protein, 9 aa, Dengue virus
VSQGAGWSL

SEQ ID NO: 262741 - protein, 9 aa, Dengue virus
WAYHGSYEV

SEQ ID NO: 262742 - protein, 9 aa, Dengue virus
YLAGAGLLF

SEQ ID NO: 262743 - protein, 9 aa, Dengue virus
WDVVPTVTQ

SEQ ID NO: 262744 - protein, 9 aa, Dengue virus
VWFVPSIKS

SEQ ID NO: 262745 - protein, 9 aa, Dengue virus
HWFSRGNSL

SEQ ID NO: 262746 - protein, 9 aa, Dengue virus
LMCHATFTM

SEQ ID NO: 262747 - protein, 9 aa, Dengue virus
AYKVASEGI

SEQ ID NO: 262748 - protein, 9 aa, Dengue virus
LRLASNAIC

SEQ ID NO: 262749 - protein, 9 aa, Dengue virus
YGMEIRPLK

SEQ ID NO: 262750 - protein, 9 aa, Dengue virus
LTIMDLHPG

SEQ ID NO: 262751 - protein, 9 aa, Dengue virus
LRWIVERGM

SEQ ID NO: 262752 - protein, 9 aa, Dengue virus
IKRKLRTLI

SEQ ID NO: 262753 - protein, 9 aa, Dengue virus
WLSYKVASA

SEQ ID NO: 262754 - protein, 9 aa, Dengue virus
LVTFKTAHA

SEQ ID NO: 262755 - protein, 9 aa, Dengue virus
WAYHGSYEV

SEQ ID NO: 262756 - protein, 9 aa, Dengue virus
IRYQTTAVK

SEQ ID NO: 262757 - protein, 9 aa, Dengue virus
LVRLQSGVD

SEQ ID NO: 262758 - protein, 9 aa, Dengue virus
TILIRTGLL

SEQ ID NO: 262759 - protein, 9 aa, Dengue virus
SRTIRVLSL

SEQ ID NO: 262760 - protein, 9 aa, Dengue virus
IHATHQWMT

SEQ ID NO: 262761 - protein, 9 aa, Dengue virus
VTRLENIMW

SEQ ID NO: 262762 - protein, 9 aa, Dengue virus
IANQAAILM

SEQ ID NO: 262763 - protein, 9 aa, Dengue virus
QRGILGRSQ

SEQ ID NO: 262764 - protein, 9 aa, Dengue virus
HQWMTTEDM

SEQ ID NO: 262765 - protein, 9 aa, Dengue virus
PQWIAASII

SEQ ID NO: 262766 - protein, 9 aa, Dengue virus
MLVRNPLSR

SEQ ID NO: 262767 - protein, 9 aa, Dengue virus
IVREAIKRG

SEQ ID NO: 262768 - protein, 9 aa, Dengue virus
VCGIRSATR

SEQ ID NO: 262769 - protein, 9 aa, Dengue virus
LTLATGPIT

SEQ ID NO: 262770 - protein, 9 aa, Dengue virus
FGMFTTNIW

SEQ ID NO: 262771 - protein, 9 aa, Dengue virus
PVRVPNYNL

SEQ ID NO: 262772 - protein, 9 aa, Dengue virus
SYAQMWQLM

SEQ ID NO: 262773 - protein, 9 aa, Dengue virus
FKAERVIDP

SEQ ID NO: 262774 - protein, 9 aa, Dengue virus
LLRNDVPLA

SEQ ID NO: 262775 - protein, 9 aa, Dengue virus
YKFQPESPA

SEQ ID NO: 262776 - protein, 9 aa, Dengue virus
IVASVNTTS

SEQ ID NO: 262777 - protein, 9 aa, Dengue virus
LIGLSSRAT

SEQ ID NO: 262778 - protein, 9 aa, Dengue virus
MRTTWAFCE

SEQ ID NO: 262779 - protein, 9 aa, Dengue virus
LRTTTASGK

SEQ ID NO: 262780 - protein, 9 aa, Dengue virus
TFITPMMRH

SEQ ID NO: 262781 - protein, 9 aa, Dengue virus
VRSNAAIGA

SEQ ID NO: 262782 - protein, 9 aa, Dengue virus
FLEFEALGF

SEQ ID NO: 262783 - protein, 9 aa, Dengue virus
YKFQPESPA

SEQ ID NO: 262784 - protein, 9 aa, Dengue virus
VTYSLNTFT

SEQ ID NO: 262785 - protein, 9 aa, Dengue virus
TTRLENLLW

SEQ ID NO: 262786 - protein, 9 aa, Dengue virus
FQADSPKKL

SEQ ID NO: 262787 - protein, 9 aa, Dengue virus
FLAIPPTAG

SEQ ID NO: 262788 - protein, 9 aa, Dengue virus
FTNMEAQLI

SEQ ID NO: 262789 - protein, 9 aa, Dengue virus
WMTTEDMLS

SEQ ID NO: 262790 - protein, 9 aa, Dengue virus
LIGLTSRAT

SEQ ID NO: 262791 - protein, 9 aa, Dengue virus
NTTIAVSTA

SEQ ID NO: 262792 - protein, 9 aa, Dengue virus
MGLGRGWPL

SEQ ID NO: 262793 - protein, 9 aa, Dengue virus
LLSSTRVPN

SEQ ID NO: 262794 - protein, 9 aa, Dengue virus
VIPMVTQMA

SEQ ID NO: 262795 - protein, 9 aa, Dengue virus
FQADSPSKL

SEQ ID NO: 262796 - protein, 9 aa, Dengue virus
KFWNTTIAV

SEQ ID NO: 262797 - protein, 9 aa, Dengue virus
MGLGKGWPL

SEQ ID NO: 262798 - protein, 9 aa, Dengue virus
LSGRGPLKL

SEQ ID NO: 262799 - protein, 9 aa, Dengue virus
LRMVLAFIT

SEQ ID NO: 262800 - protein, 9 aa, Dengue virus
DLRLASMAI

SEQ ID NO: 262801 - protein, 9 aa, Dengue virus
WKMERASFI

SEQ ID NO: 262802 - protein, 9 aa, Dengue virus
CYSQVNPLT

SEQ ID NO: 262803 - protein, 9 aa, Dengue virus
LILCTGQLL

SEQ ID NO: 262804 - protein, 9 aa, Dengue virus
LTIMDLHPG

SEQ ID NO: 262805 - protein, 9 aa, Dengue virus
MFEATARGA

SEQ ID NO: 262806 - protein, 9 aa, Dengue virus
TVLTPMLRH

SEQ ID NO: 262807 - protein, 9 aa, Dengue virus
YMWLGARFL

SEQ ID NO: 262808 - protein, 9 aa, Dengue virus
FMALVAFLR

SEQ ID NO: 262809 - protein, 9 aa, Dengue virus
LHKLGYILR

SEQ ID NO: 262810 - protein, 9 aa, Dengue virus
VVTTSGTYV

SEQ ID NO: 262811 - protein, 9 aa, Dengue virus
VVSILASSF

SEQ ID NO: 262812 - protein, 9 aa, Dengue virus
YVMTGRSAD

SEQ ID NO: 262813 - protein, 9 aa, Dengue virus
TLYAVATTV

SEQ ID NO: 262814 - protein, 9 aa, Dengue virus
LTKRFSLGL

SEQ ID NO: 262815 - protein, 9 aa, Dengue virus
FLAIPPTAG

SEQ ID NO: 262816 - protein, 9 aa, Dengue virus
CVGISSRDF

SEQ ID NO: 262817 - protein, 9 aa, Dengue virus
IRYQTTATK

SEQ ID NO: 262818 - protein, 9 aa, Dengue virus
SVALAPHVG

SEQ ID NO: 262819 - protein, 9 aa, Dengue virus
IKDSKAVHA

SEQ ID NO: 262820 - protein, 9 aa, Dengue virus
LAAIANQAT

SEQ ID NO: 262821 - protein, 9 aa, Dengue virus
WIAASIILE

SEQ ID NO: 262822 - protein, 9 aa, Dengue virus
LRWFVERNL

SEQ ID NO: 262823 - protein, 9 aa, Dengue virus
FHTMWHVTR

SEQ ID NO: 262824 - protein, 9 aa, Dengue virus
YSQVNPITL

SEQ ID NO: 262825 - protein, 9 aa, Dengue virus
LMCHATFTM

SEQ ID NO: 262826 - protein, 9 aa, Dengue virus
YYMATLKNV

SEQ ID NO: 262827 - protein, 9 aa, Dengue virus
ATTIITPML

SEQ ID NO: 262828 - protein, 9 aa, Dengue virus
SKLMSAAVK

SEQ ID NO: 262829 - protein, 9 aa, Dengue virus
VVSILASSF

SEQ ID NO: 262830 - protein, 9 aa, Dengue virus
WALCESITL

SEQ ID NO: 262831 - protein, 9 aa, Dengue virus
TKRILPSIV

SEQ ID NO: 262832 - protein, 9 aa, Dengue virus
SVALVPHVG

SEQ ID NO: 262833 - protein, 9 aa, Dengue virus
PVRVPNYNM

SEQ ID NO: 262834 - protein, 9 aa, Dengue virus
YMATLKNVR

SEQ ID NO: 262835 - protein, 9 aa, Dengue virus
ISQGAGWSL

SEQ ID NO: 262836 - protein, 9 aa, Dengue virus
KMLEATAKG

SEQ ID NO: 262837 - protein, 9 aa, Dengue virus
IACYVITGR

SEQ ID NO: 262838 - protein, 9 aa, Dengue virus
VVTTSGTYV

SEQ ID NO: 262839 - protein, 9 aa, Dengue virus
LKGLPIRYQ

SEQ ID NO: 262840 - protein, 9 aa, Dengue virus
KRFSLGLLS

SEQ ID NO: 262841 - protein, 9 aa, Dengue virus
VRSNAAMGA

SEQ ID NO: 262842 - protein, 9 aa, Dengue virus
NRVSTVQQL

SEQ ID NO: 262843 - protein, 9 aa, Dengue virus
WMTTEDMLK

SEQ ID NO: 262844 - protein, 9 aa, Dengue virus
LTKRFSLGL

SEQ ID NO: 262845 - protein, 9 aa, Dengue virus
FGIFTTNIW

SEQ ID NO: 262846 - protein, 9 aa, Dengue virus
FSTNIWLKL

SEQ ID NO: 262847 - protein, 9 aa, Dengue virus
WHVTRGAVL

SEQ ID NO: 262848 - protein, 9 aa, Dengue virus
IFVIDNVHT

SEQ ID NO: 262849 - protein, 9 aa, Dengue virus
FLAIPPTAG

SEQ ID NO: 262850 - protein, 9 aa, Dengue virus
SAAIKDSKA

SEQ ID NO: 262851 - protein, 9 aa, Dengue virus
MGLGRGWPI

SEQ ID NO: 262852 - protein, 9 aa, Dengue virus
WKIEKASFI

SEQ ID NO: 262853 - protein, 9 aa, Dengue virus
VTRLENIMW

SEQ ID NO: 262854 - protein, 9 aa, Dengue virus
FWNTTIAVS

SEQ ID NO: 262855 - protein, 9 aa, Dengue virus
SVNTISKML

SEQ ID NO: 262856 - protein, 9 aa, Dengue virus
MAMTDTTPF

SEQ ID NO: 262857 - protein, 9 aa, Dengue virus
MYWVSGATG

SEQ ID NO: 262858 - protein, 9 aa, Dengue virus
NVSLTAIAN

SEQ ID NO: 262859 - protein, 9 aa, Dengue virus
VRSNAALGA

SEQ ID NO: 262860 - protein, 9 aa, Dengue virus
IENTSANLS

SEQ ID NO: 262861 - protein, 9 aa, Dengue virus
IEEGRTLRV

SEQ ID NO: 262862 - protein, 9 aa, Dengue virus
FHTMWHVTR

SEQ ID NO: 262863 - protein, 9 aa, Dengue virus
WMTTEDMLT

SEQ ID NO: 262864 - protein, 9 aa, Dengue virus
LNTFTNMEV

SEQ ID NO: 262865 - protein, 9 aa, Dengue virus
IEESRTIRV

SEQ ID NO: 262866 - protein, 9 aa, Dengue virus
YTTMFGGVS

SEQ ID NO: 262867 - protein, 9 aa, Dengue virus
LVRCPLSRN

SEQ ID NO: 262868 - protein, 9 aa, Dengue virus
SVALVPHVG

SEQ ID NO: 262869 - protein, 9 aa, Dengue virus
WVSGATGNI

SEQ ID NO: 262870 - protein, 9 aa, Dengue virus
VVRLLTKPW

SEQ ID NO: 262871 - protein, 9 aa, Dengue virus
FLAIPPTAG

SEQ ID NO: 262872 - protein, 9 aa, Dengue virus
LRGLPIRYQ

SEQ ID NO: 262873 - protein, 9 aa, Dengue virus
VWLAYKVAA

SEQ ID NO: 262874 - protein, 9 aa, Dengue virus
GFGMFSTNI

SEQ ID NO: 262875 - protein, 9 aa, Dengue virus
YAVATTFIT

SEQ ID NO: 262876 - protein, 9 aa, Dengue virus
VWFVPSIKA

SEQ ID NO: 262877 - protein, 9 aa, Dengue virus
LLKNDIPMT

SEQ ID NO: 262878 - protein, 9 aa, Dengue virus
IAVSTANIF

SEQ ID NO: 262879 - protein, 9 aa, Dengue virus
VMAFIAFLR

SEQ ID NO: 262880 - protein, 9 aa, Dengue virus
WCNATSAWV

SEQ ID NO: 262881 - protein, 9 aa, Dengue virus
IYSDPLALR

SEQ ID NO: 262882 - protein, 9 aa, Dengue virus
TKRYLPAIV

SEQ ID NO: 262883 - protein, 9 aa, Dengue virus
FNMLKRERN

SEQ ID NO: 262884 - protein, 9 aa, Dengue virus
FQADSPSKL

SEQ ID NO: 262885 - protein, 9 aa, Dengue virus
WKMERASFI

SEQ ID NO: 262886 - protein, 9 aa, Dengue virus
VWFVPSIKS

SEQ ID NO: 262887 - protein, 9 aa, Dengue virus
MINGVVKLL

SEQ ID NO: 262888 - protein, 9 aa, Dengue virus
ISRMLINRF

SEQ ID NO: 262889 - protein, 9 aa, Dengue virus
YRLKGEARK

SEQ ID NO: 262890 - protein, 9 aa, Dengue virus
IVSILASSL

SEQ ID NO: 262891 - protein, 9 aa, Dengue virus
IAMTDTTPF

SEQ ID NO: 262892 - protein, 9 aa, Dengue virus
MYWVSNASG

SEQ ID NO: 262893 - protein, 9 aa, Dengue virus
WVSGATGNI

SEQ ID NO: 262894 - protein, 9 aa, Dengue virus
FRAERVIDP

SEQ ID NO: 262895 - protein, 9 aa, Dengue virus
VWFVPSIKA

SEQ ID NO: 262896 - protein, 9 aa, Dengue virus
LVSLLGSSL

SEQ ID NO: 262897 - protein, 9 aa, Dengue virus
GSYLAGAGL

SEQ ID NO: 262898 - protein, 9 aa, Dengue virus
IFVIDNVHT

SEQ ID NO: 262899 - protein, 9 aa, Dengue virus
WCNLTSTWV

SEQ ID NO: 262900 - protein, 9 aa, Dengue virus
PHWIAASII

SEQ ID NO: 262901 - protein, 9 aa, Dengue virus
TFITPMMRH

SEQ ID NO: 262902 - protein, 9 aa, Dengue virus
WMTTEDMLA

SEQ ID NO: 262903 - protein, 9 aa, Dengue virus
VQQLTKRFS

SEQ ID NO: 262904 - protein, 9 aa, Dengue virus
WCNATSTWV

SEQ ID NO: 262905 - protein, 9 aa, Dengue virus
FHKIFMKDG

SEQ ID NO: 262906 - protein, 9 aa, Dengue virus
LSGRGPLKL

SEQ ID NO: 262907 - protein, 9 aa, Dengue virus
WQLMYFHRR

SEQ ID NO: 262908 - protein, 9 aa, Dengue virus
VALAPHVGM

SEQ ID NO: 262909 - protein, 9 aa, Dengue virus
PIRVPNYNL

SEQ ID NO: 262910 - protein, 9 aa, Dengue virus
IMKNPTVDG

SEQ ID NO: 262911 - protein, 9 aa, Dengue virus
ISQGAGWSL

SEQ ID NO: 262912 - protein, 9 aa, Dengue virus
YISTRVEMG

SEQ ID NO: 262913 - protein, 9 aa, Dengue virus
ITLATGPLS

SEQ ID NO: 262914 - protein, 9 aa, Dengue virus
FGRAKGSRA

SEQ ID NO: 262915 - protein, 9 aa, Dengue virus
LLMMRTTWA

SEQ ID NO: 262916 - protein, 9 aa, Dengue virus
IFMTATPPG

SEQ ID NO: 262917 - protein, 9 aa, Dengue virus
VSRGSAKIR

SEQ ID NO: 262918 - protein, 9 aa, Dengue virus
VWLSYKVAS

SEQ ID NO: 262919 - protein, 9 aa, Dengue virus
VWLAYKVAS

SEQ ID NO: 262920 - protein, 9 aa, Dengue virus
IKRKLRTLI

SEQ ID NO: 262921 - protein, 9 aa, Dengue virus
LKGLPIRYQ

SEQ ID NO: 262922 - protein, 9 aa, Dengue virus
ISKMLLNRF

SEQ ID NO: 262923 - protein, 9 aa, Dengue virus
NLSLAAIAN

SEQ ID NO: 262924 - protein, 9 aa, Dengue virus
VSILASALL

SEQ ID NO: 262925 - protein, 9 aa, Dengue virus
DLRLASMAI

SEQ ID NO: 262926 - protein, 9 aa, Dengue virus
VVTRSGAYV

SEQ ID NO: 262927 - protein, 9 aa, Dengue virus
FKLTYQNKV

SEQ ID NO: 262928 - protein, 9 aa, Dengue virus
FEKQLGQVM

SEQ ID NO: 262929 - protein, 9 aa, Dengue virus
FLTIPPTAG

SEQ ID NO: 262930 - protein, 9 aa, Dengue virus
SYAQMWQLM

SEQ ID NO: 262931 - protein, 9 aa, Dengue virus
YCGGLKNVK

SEQ ID NO: 262932 - protein, 9 aa, Dengue virus
LIGLTSRAT

SEQ ID NO: 262933 - protein, 9 aa, Dengue virus
CHATFTTRL

SEQ ID NO: 262934 - protein, 9 aa, Dengue virus
YMWLGARFL

SEQ ID NO: 262935 - protein, 9 aa, Dengue virus
ISQGAGWSL

SEQ ID NO: 262936 - protein, 9 aa, Dengue virus
MVTFKVPHA

SEQ ID NO: 262937 - protein, 9 aa, Dengue virus
ISYGGGWRL

SEQ ID NO: 262938 - protein, 9 aa, Dengue virus
ITLATGPLS

SEQ ID NO: 262939 - protein, 9 aa, Dengue virus
YLPAIIREA

SEQ ID NO: 262940 - protein, 9 aa, Dengue virus
VVRLLTKPW

SEQ ID NO: 262941 - protein, 9 aa, Dengue virus
MGLGKGWPI

SEQ ID NO: 262942 - protein, 9 aa, Dengue virus
MRTTWAFCE

SEQ ID NO: 262943 - protein, 9 aa, Dengue virus
LTIMDLHPG

SEQ ID NO: 262944 - protein, 9 aa, Dengue virus
HWFSRGNSL

SEQ ID NO: 262945 - protein, 9 aa, Dengue virus
LRPASAWTL

SEQ ID NO: 262946 - protein, 9 aa, Dengue virus
WNTTIAVSM

SEQ ID NO: 262947 - protein, 9 aa, Dengue virus
YFHRRDLRL

SEQ ID NO: 262948 - protein, 9 aa, Dengue virus
FCSHHFHQL

SEQ ID NO: 262949 - protein, 9 aa, Dengue virus
LRTTTASGK

SEQ ID NO: 262950 - protein, 9 aa, Dengue virus
IRYQTTAVK

SEQ ID NO: 262951 - protein, 9 aa, Dengue virus
FCSHHFHEL

SEQ ID NO: 262952 - protein, 9 aa, Dengue virus
VNMTSKMLL

SEQ ID NO: 262953 - protein, 9 aa, Dengue virus
YRILQRGLL

SEQ ID NO: 262954 - protein, 9 aa, Dengue virus
CYVLSGSSA

SEQ ID NO: 262955 - protein, 9 aa, Dengue virus
VLTLATGPV

SEQ ID NO: 262956 - protein, 9 aa, Dengue virus
ILLMRTSWA

SEQ ID NO: 262957 - protein, 9 aa, Dengue virus
LLMMRTTWA

SEQ ID NO: 262958 - protein, 9 aa, Dengue virus
FHQLIMKDG

SEQ ID NO: 262959 - protein, 9 aa, Dengue virus
VSRGSAKLR

SEQ ID NO: 262960 - protein, 9 aa, Dengue virus
MRLLSPVRV

SEQ ID NO: 262961 - protein, 9 aa, Dengue virus
VRTNAAMGA

SEQ ID NO: 262962 - protein, 9 aa, Dengue virus
GFGIFTTNI

SEQ ID NO: 262963 - protein, 9 aa, Dengue virus
VREALKRRL

SEQ ID NO: 262964 - protein, 9 aa, Dengue virus
FEKQLGQIM

SEQ ID NO: 262965 - protein, 9 aa, Dengue virus
YSQIGAGVY

SEQ ID NO: 262966 - protein, 9 aa, Dengue virus
SYAQMWQLM

SEQ ID NO: 262967 - protein, 9 aa, Dengue virus
RMAILGDTA

SEQ ID NO: 262968 - protein, 9 aa, Dengue virus
TTTASGKLV

SEQ ID NO: 262969 - protein, 9 aa, Dengue virus
WKLARASFI

SEQ ID NO: 262970 - protein, 9 aa, Dengue virus
TYQNKVVRV

SEQ ID NO: 262971 - protein, 9 aa, Dengue virus
LNTFTNMEV

SEQ ID NO: 262972 - protein, 9 aa, Dengue virus
NRVSTPQGL

SEQ ID NO: 262973 - protein, 9 aa, Dengue virus
VQLLLMRTS

SEQ ID NO: 262974 - protein, 9 aa, Dengue virus
FGVFSTNIW

SEQ ID NO: 262975 - protein, 9 aa, Dengue virus
IRYQTTAIK

SEQ ID NO: 262976 - protein, 9 aa, Dengue virus
TYQNKVVKV

SEQ ID NO: 262977 - protein, 9 aa, Dengue virus
YRLKGEARK

SEQ ID NO: 262978 - protein, 9 aa, Dengue virus
ISQGAGWSL

SEQ ID NO: 262979 - protein, 9 aa, Dengue virus
WCNATSAWV

SEQ ID NO: 262980 - protein, 9 aa, Dengue virus
FQADSPKRL

SEQ ID NO: 262981 - protein, 9 aa, Dengue virus
CHATFTTRL

SEQ ID NO: 262982 - protein, 9 aa, Dengue virus
VKRFSTGLL

SEQ ID NO: 262983 - protein, 9 aa, Dengue virus
FLEFEALGF

SEQ ID NO: 262984 - protein, 9 aa, Dengue virus
LRMVLAFIT

SEQ ID NO: 262985 - protein, 9 aa, Dengue virus
TTTASGKLV

SEQ ID NO: 262986 - protein, 9 aa, Dengue virus
VKLLTKPWD

SEQ ID NO: 262987 - protein, 9 aa, Dengue virus
YGMEIRPVS

SEQ ID NO: 262988 - protein, 9 aa, Dengue virus
TKRILPSIV

SEQ ID NO: 262989 - protein, 9 aa, Dengue virus
TIENSTANV

SEQ ID NO: 262990 - protein, 9 aa, Dengue virus
SRTIRVLSL

SEQ ID NO: 262991 - protein, 9 aa, Dengue virus
FTNMEAQLI

SEQ ID NO: 262992 - protein, 9 aa, Dengue virus
FRAERVIDP

SEQ ID NO: 262993 - protein, 9 aa, Dengue virus
FLEFEALGF

SEQ ID NO: 262994 - protein, 9 aa, Dengue virus
IRYQTPAIR

SEQ ID NO: 262995 - protein, 9 aa, Dengue virus
WKMERASFI

SEQ ID NO: 262996 - protein, 9 aa, Dengue virus
GHLKCRLKM

SEQ ID NO: 262997 - protein, 9 aa, Dengue virus
FTRKVRSNA

SEQ ID NO: 262998 - protein, 9 aa, Dengue virus
WMVHRQWFF

SEQ ID NO: 262999 - protein, 9 aa, Dengue virus
LRWFVERNM

SEQ ID NO: 263000 - protein, 9 aa, Dengue virus
WSIHAHHQW

SEQ ID NO: 263001 - protein, 9 aa, Dengue virus
FKTAHAKKQ

SEQ ID NO: 263002 - protein, 9 aa, Dengue virus
RMAILGDTA

SEQ ID NO: 263003 - protein, 9 aa, Dengue virus
TRRYLPAMV

SEQ ID NO: 263004 - protein, 9 aa, Dengue virus
IVSSVNTIS

SEQ ID NO: 263005 - protein, 9 aa, Dengue virus
ATTIITPML

SEQ ID NO: 263006 - protein, 9 aa, Dengue virus
WAFCESLTL

SEQ ID NO: 263007 - protein, 9 aa, Dengue virus
LKGMPIRYQ

SEQ ID NO: 263008 - protein, 9 aa, Dengue virus
FLRVLSIPP

SEQ ID NO: 263009 - protein, 9 aa, Dengue virus
VALTPHSGM

SEQ ID NO: 263010 - protein, 9 aa, Dengue virus
HWFSRGNSL

SEQ ID NO: 263011 - protein, 9 aa, Dengue virus
HKMDLGVPL

SEQ ID NO: 263012 - protein, 9 aa, Dengue virus
KRILPSIVR

SEQ ID NO: 263013 - protein, 9 aa, Dengue virus
WKLARASFI

SEQ ID NO: 263014 - protein, 9 aa, Dengue virus
LILAPTRVV

SEQ ID NO: 263015 - protein, 9 aa, Dengue virus
WLVHKQWFL

SEQ ID NO: 263016 - protein, 9 aa, Dengue virus
VWFVPSIKS

SEQ ID NO: 263017 - protein, 9 aa, Dengue virus
YGWNLVKLH

SEQ ID NO: 263018 - protein, 9 aa, Dengue virus
DLRLASMAI

SEQ ID NO: 263019 - protein, 9 aa, Dengue virus
AYVMTGRSA

SEQ ID NO: 263020 - protein, 9 aa, Dengue virus
IRYQTPAVK

SEQ ID NO: 263021 - protein, 9 aa, Dengue virus
PVRVPNYNL

SEQ ID NO: 263022 - protein, 9 aa, Dengue virus
HRLMSAAIK

SEQ ID NO: 263023 - protein, 9 aa, Dengue virus
FQADSPKKL

SEQ ID NO: 263024 - protein, 9 aa, Dengue virus
LHKLGYILR

SEQ ID NO: 263025 - protein, 9 aa, Dengue virus
FCEALTLAT

SEQ ID NO: 263026 - protein, 9 aa, Dengue virus
VILAGPMPV

SEQ ID NO: 263027 - protein, 9 aa, Dengue virus
NRVSTVQQL

SEQ ID NO: 263028 - protein, 9 aa, Dengue virus
YAQMWALMY

SEQ ID NO: 263029 - protein, 9 aa, Dengue virus
PQWIASSII

SEQ ID NO: 263030 - protein, 9 aa, Dengue virus
SKMDLGVPL

SEQ ID NO: 263031 - protein, 9 aa, Dengue virus
HHFHQLIMK

SEQ ID NO: 263032 - protein, 9 aa, Dengue virus
MINGVVRLL

SEQ ID NO: 263033 - protein, 9 aa, Dengue virus
YVLSGSSAD

SEQ ID NO: 263034 - protein, 9 aa, Dengue virus
VVTRSGTYV

SEQ ID NO: 263035 - protein, 9 aa, Dengue virus
SVALAPHVG

SEQ ID NO: 263036 - protein, 9 aa, Dengue virus
LSSLLKNDV

SEQ ID NO: 263037 - protein, 9 aa, Dengue virus
ISRMLLNRF

SEQ ID NO: 263038 - protein, 9 aa, Dengue virus
IIREAIKRK

SEQ ID NO: 263039 - protein, 9 aa, Dengue virus
HRMDLGVPL

SEQ ID NO: 263040 - protein, 9 aa, Dengue virus
YQHALSELP

SEQ ID NO: 263041 - protein, 9 aa, Dengue virus
CIKVLNPYM

SEQ ID NO: 263042 - protein, 9 aa, Dengue virus
VWLAYKVAS

SEQ ID NO: 263043 - protein, 9 aa, Dengue virus
TRRYLPAMV

SEQ ID NO: 263044 - protein, 9 aa, Dengue virus
CIKVLNPYM

SEQ ID NO: 263045 - protein, 9 aa, Dengue virus
WTLMYFHRR

SEQ ID NO: 263046 - protein, 9 aa, Dengue virus
SALTGATEI

SEQ ID NO: 263047 - protein, 9 aa, Dengue virus
LVSILLSSL

SEQ ID NO: 263048 - protein, 9 aa, Dengue virus
FQADSPKRL

SEQ ID NO: 263049 - protein, 9 aa, Dengue virus
VITLATGPL

SEQ ID NO: 263050 - protein, 9 aa, Dengue virus
IVSSVNMVS

SEQ ID NO: 263051 - protein, 9 aa, Dengue virus
HKMDLGVPL

SEQ ID NO: 263052 - protein, 9 aa, Dengue virus
IVSAVNMTS

SEQ ID NO: 263053 - protein, 9 aa, Dengue virus
MKDGRVLVV

SEQ ID NO: 263054 - protein, 9 aa, Dengue virus
SRTIRVLKM

SEQ ID NO: 263055 - protein, 9 aa, Dengue virus
YISTRVEMG

SEQ ID NO: 263056 - protein, 9 aa, Dengue virus
VIPMVTQMA

SEQ ID NO: 263057 - protein, 9 aa, Dengue virus
LQWIASAII

SEQ ID NO: 263058 - protein, 9 aa, Dengue virus
ITLATGPLS

SEQ ID NO: 263059 - protein, 9 aa, Dengue virus
WLSYKVASA

SEQ ID NO: 263060 - protein, 9 aa, Dengue virus
WLAHKVAAE

SEQ ID NO: 263061 - protein, 9 aa, Dengue virus
LIGLSSRAT

SEQ ID NO: 263062 - protein, 9 aa, Dengue virus
IFITDNVHT

SEQ ID NO: 263063 - protein, 9 aa, Dengue virus
CIGISNRDF

SEQ ID NO: 263064 - protein, 9 aa, Dengue virus
IVSSVNTIS

SEQ ID NO: 263065 - protein, 9 aa, Dengue virus
WLAHKVAAE

SEQ ID NO: 263066 - protein, 9 aa, Dengue virus
GLFGKGSLL

SEQ ID NO: 263067 - protein, 9 aa, Dengue virus
CVTTIAKSK

SEQ ID NO: 263068 - protein, 9 aa, Dengue virus
FCEVLTLAT

SEQ ID NO: 263069 - protein, 9 aa, Dengue virus
TRKYLPAII

SEQ ID NO: 263070 - protein, 9 aa, Dengue virus
FQADSPKRL

SEQ ID NO: 263071 - protein, 9 aa, Dengue virus
IVSSVNMIS

SEQ ID NO: 263072 - protein, 9 aa, Dengue virus
FGMFSTNIW

SEQ ID NO: 263073 - protein, 9 aa, Dengue virus
YYCAGLKKV

SEQ ID NO: 263074 - protein, 9 aa, Dengue virus
VRTNAAIGA

SEQ ID NO: 263075 - protein, 9 aa, Dengue virus
LKRRLRTLI

SEQ ID NO: 263076 - protein, 9 aa, Dengue virus
VLTLATGPV

SEQ ID NO: 263077 - protein, 9 aa, Dengue virus
VRSNAALGA

SEQ ID NO: 263078 - protein, 9 aa, Dengue virus
VDIGVPLLA

SEQ ID NO: 263079 - protein, 9 aa, Dengue virus
HRMDIGVPL

SEQ ID NO: 263080 - protein, 9 aa, Dengue virus
FCSHHFHKI

SEQ ID NO: 263081 - protein, 9 aa, Dengue virus
VRSNAAMGA

SEQ ID NO: 263082 - protein, 9 aa, Dengue virus
LHKLGKCGS

SEQ ID NO: 263083 - protein, 9 aa, Dengue virus
ILLMRTSWA

SEQ ID NO: 263084 - protein, 9 aa, Dengue virus
CVTTMAKNK

SEQ ID NO: 263085 - protein, 9 aa, Dengue virus
LRTLILAPT

SEQ ID NO: 263086 - protein, 9 aa, Dengue virus
LVTFKNPHA

SEQ ID NO: 263087 - protein, 9 aa, Dengue virus
WLAYKVASE

SEQ ID NO: 263088 - protein, 9 aa, Dengue virus
NRVSTPQGL

SEQ ID NO: 263089 - protein, 9 aa, Dengue virus
WMTTEDMLK

SEQ ID NO: 263090 - protein, 9 aa, Dengue virus
WIESQKNGS

SEQ ID NO: 263091 - protein, 9 aa, Dengue virus
RSVALAPHV

SEQ ID NO: 263092 - protein, 9 aa, Dengue virus
WAYHGSYEV

SEQ ID NO: 263093 - protein, 9 aa, Dengue virus
WALCEALTL

SEQ ID NO: 263094 - protein, 9 aa, Dengue virus
LTAIANQAV

SEQ ID NO: 263095 - protein, 9 aa, Dengue virus
FQADSPKRL

SEQ ID NO: 263096 - protein, 9 aa, Dengue virus
QLTYVVIAI

SEQ ID NO: 263097 - protein, 9 aa, Dengue virus
LTIMDLHPG

SEQ ID NO: 263098 - protein, 9 aa, Dengue virus
FWNTTIAVS

SEQ ID NO: 263099 - protein, 9 aa, Dengue virus
MGLGKGWPI

SEQ ID NO: 263100 - protein, 9 aa, Dengue virus
KRFSKGLFS

SEQ ID NO: 263101 - protein, 9 aa, Dengue virus
VWLAYKVAA

SEQ ID NO: 263102 - protein, 9 aa, Dengue virus
FGKGSLVTC

SEQ ID NO: 263103 - protein, 9 aa, Dengue virus
LLILCASQI

SEQ ID NO: 263104 - protein, 9 aa, Dengue virus
YWIESALND

SEQ ID NO: 263105 - protein, 9 aa, Dengue virus
FEKQLGQIM

SEQ ID NO: 263106 - protein, 9 aa, Dengue virus
IFVIDNVHT

SEQ ID NO: 263107 - protein, 9 aa, Dengue virus
LILAPTRVV

SEQ ID NO: 263108 - protein, 9 aa, Dengue virus
QTWMSSEGA

SEQ ID NO: 263109 - protein, 9 aa, Dengue virus
FGKAKGSRA

SEQ ID NO: 263110 - protein, 9 aa, Dengue virus
LRPASAWTL

SEQ ID NO: 263111 - protein, 9 aa, Dengue virus
AVSRGTAKL

SEQ ID NO: 263112 - protein, 9 aa, Dengue virus
LLILCASQI

SEQ ID NO: 263113 - protein, 9 aa, Dengue virus
ATTIVTPML

SEQ ID NO: 263114 - protein, 9 aa, Dengue virus
VVLMGLGRG

SEQ ID NO: 263115 - protein, 9 aa, Dengue virus
YLEFEALGF

SEQ ID NO: 263116 - protein, 9 aa, Dengue virus
VWLAYRVAA

SEQ ID NO: 263117 - protein, 9 aa, Dengue virus
ITLATGPLS

SEQ ID NO: 263118 - protein, 9 aa, Dengue virus
LKRERNRVS

SEQ ID NO: 263119 - protein, 9 aa, Dengue virus
ATTFITPMM

SEQ ID NO: 263120 - protein, 9 aa, Dengue virus
LNGKGPLRM

SEQ ID NO: 263121 - protein, 9 aa, Dengue virus
LFSGQGPMK

SEQ ID NO: 263122 - protein, 9 aa, Dengue virus
FMALVAFLR

SEQ ID NO: 263123 - protein, 9 aa, Dengue virus
HQWMTTEDM

SEQ ID NO: 263124 - protein, 9 aa, Dengue virus
AVSRGTAKL

SEQ ID NO: 263125 - protein, 9 aa, Dengue virus
WCNLTSTWV

SEQ ID NO: 263126 - protein, 9 aa, Dengue virus
LRLASNAIC

SEQ ID NO: 263127 - protein, 9 aa, Dengue virus
YRLRGEARK

SEQ ID NO: 263128 - protein, 9 aa, Dengue virus
TTTVSGKLI

SEQ ID NO: 263129 - protein, 9 aa, Dengue virus
FWNTTIAVS

SEQ ID NO: 263130 - protein, 9 aa, Dengue virus
WLAHKVASE

SEQ ID NO: 263131 - protein, 9 aa, Dengue virus
HRMDIGVPL

SEQ ID NO: 263132 - protein, 9 aa, Dengue virus
YMWLGARYL

SEQ ID NO: 263133 - protein, 9 aa, Dengue virus
VWFVPSIKA

SEQ ID NO: 263134 - protein, 9 aa, Dengue virus
MAMTDTTPF

SEQ ID NO: 263135 - protein, 9 aa, Dengue virus
LLRNDVPMA

SEQ ID NO: 263136 - protein, 9 aa, Dengue virus
TTTVSGKLI

SEQ ID NO: 263137 - protein, 9 aa, Dengue virus
VNVSLTAIA

SEQ ID NO: 263138 - protein, 9 aa, Dengue virus
WCNLTSTWV

SEQ ID NO: 263139 - protein, 9 aa, Dengue virus
MGLDKGWPL

SEQ ID NO: 263140 - protein, 9 aa, Dengue virus
IKRKLRTLI

SEQ ID NO: 263141 - protein, 9 aa, Dengue virus
FQADSPKKL

SEQ ID NO: 263142 - protein, 9 aa, Dengue virus
LIGLTARAT

SEQ ID NO: 263143 - protein, 9 aa, Dengue virus
SIAARGYIS

SEQ ID NO: 263144 - protein, 9 aa, Dengue virus
VITLATGPL

SEQ ID NO: 263145 - protein, 9 aa, Dengue virus
YYCGGLKNV

SEQ ID NO: 263146 - protein, 9 aa, Dengue virus
FQPESPARV

SEQ ID NO: 263147 - protein, 9 aa, Dengue virus
IKQQGILGK

SEQ ID NO: 263148 - protein, 9 aa, Dengue virus
FHTMWHVTR

SEQ ID NO: 263149 - protein, 9 aa, Dengue virus
SYAQMWTLM

SEQ ID NO: 263150 - protein, 9 aa, Dengue virus
FGKAKGSRA

SEQ ID NO: 263151 - protein, 9 aa, Dengue virus
YMWLGARYL

SEQ ID NO: 263152 - protein, 9 aa, Dengue virus
YRIKQQGIL

SEQ ID NO: 263153 - protein, 9 aa, Dengue virus
MVSILASAL

SEQ ID NO: 263154 - protein, 9 aa, Dengue virus
WISNGTGNI

SEQ ID NO: 263155 - protein, 9 aa, Dengue virus
IANQAAVLM

SEQ ID NO: 263156 - protein, 9 aa, Dengue virus
YGWNLVKLM

SEQ ID NO: 263157 - protein, 9 aa, Dengue virus
VWFVPSIKA

SEQ ID NO: 263158 - protein, 9 aa, Dengue virus
LLKNDIPMT

SEQ ID NO: 263159 - protein, 9 aa, Dengue virus
VSLAAIANQ

SEQ ID NO: 263160 - protein, 9 aa, Dengue virus
YFHRRDLRL

SEQ ID NO: 263161 - protein, 9 aa, Dengue virus
YHGSYEVKA

SEQ ID NO: 263162 - protein, 9 aa, Dengue virus
YRIKQRGIL

SEQ ID NO: 263163 - protein, 9 aa, Dengue virus
VVSILASSF

SEQ ID NO: 263164 - protein, 9 aa, Dengue virus
FEKQLGQVM

SEQ ID NO: 263165 - protein, 9 aa, Dengue virus
MATLKNVRE

SEQ ID NO: 263166 - protein, 9 aa, Dengue virus
DLRLASMAI

SEQ ID NO: 263167 - protein, 9 aa, Dengue virus
FQPESPARV

SEQ ID NO: 263168 - protein, 9 aa, Dengue virus
LLKNDVPLA

SEQ ID NO: 263169 - protein, 9 aa, Dengue virus
WVSNASGNI

SEQ ID NO: 263170 - protein, 9 aa, Dengue virus
FEKQLGQVM

SEQ ID NO: 263171 - protein, 9 aa, Dengue virus
LIMKDGRSL

SEQ ID NO: 263172 - protein, 9 aa, Dengue virus
WMTTEDMLS

SEQ ID NO: 263173 - protein, 9 aa, Dengue virus
NLSLTAIAN

SEQ ID NO: 263174 - protein, 9 aa, Dengue virus
WMTTEDMLS

SEQ ID NO: 263175 - protein, 9 aa, Dengue virus
YGWNLVKLM

SEQ ID NO: 263176 - protein, 9 aa, Dengue virus
YAQMWQLMY

SEQ ID NO: 263177 - protein, 9 aa, Dengue virus
LNTFTNMEA

SEQ ID NO: 263178 - protein, 9 aa, Dengue virus
YGWNLVKLH

SEQ ID NO: 263179 - protein, 9 aa, Dengue virus
SKMDIGVPL

SEQ ID NO: 263180 - protein, 9 aa, Dengue virus
NRVSTGSQL

SEQ ID NO: 263181 - protein, 9 aa, Dengue virus
YYCAGLKKV

SEQ ID NO: 263182 - protein, 9 aa, Dengue virus
YAVATTIIT

SEQ ID NO: 263183 - protein, 9 aa, Dengue virus
IFITDNVHT

SEQ ID NO: 263184 - protein, 9 aa, Dengue virus
WLVHRQWFL

SEQ ID NO: 263185 - protein, 9 aa, Dengue virus
PKKLASAIL

SEQ ID NO: 263186 - protein, 9 aa, Dengue virus
LMCHATFTT

SEQ ID NO: 263187 - protein, 9 aa, Dengue virus
RSVALAPHV

SEQ ID NO: 263188 - protein, 9 aa, Dengue virus
YAIIGPGLQ

SEQ ID NO: 263189 - protein, 9 aa, Dengue virus
TQVLLMRTT

SEQ ID NO: 263190 - protein, 9 aa, Dengue virus
WCNATSAWV

SEQ ID NO: 263191 - protein, 9 aa, Dengue virus
LTIMDLHPG

SEQ ID NO: 263192 - protein, 9 aa, Dengue virus
MFESTYRGA

SEQ ID NO: 263193 - protein, 9 aa, Dengue virus
CYVLSGSSA

SEQ ID NO: 263194 - protein, 9 aa, Dengue virus
IVASVNTTS

SEQ ID NO: 263195 - protein, 9 aa, Dengue virus
NRVSTGSQL

SEQ ID NO: 263196 - protein, 9 aa, Dengue virus
LLILCASQI

SEQ ID NO: 263197 - protein, 9 aa, Dengue virus
WTLMYFHRR

SEQ ID NO: 263198 - protein, 9 aa, Dengue virus
WVSGATGNI

SEQ ID NO: 263199 - protein, 9 aa, Dengue virus
YVITGTSAD

SEQ ID NO: 263200 - protein, 9 aa, Dengue virus
YTALFSGVS

SEQ ID NO: 263201 - protein, 9 aa, Dengue virus
MGLDKGWPL

SEQ ID NO: 263202 - protein, 9 aa, Dengue virus
IRYQTTATK

SEQ ID NO: 263203 - protein, 9 aa, Dengue virus
VMAFIAFLR

SEQ ID NO: 263204 - protein, 9 aa, Dengue virus
WYGMEIRPI

SEQ ID NO: 263205 - protein, 9 aa, Dengue virus
NIVSSVNMV

SEQ ID NO: 263206 - protein, 9 aa, Dengue virus
MVTQMAMTD

SEQ ID NO: 263207 - protein, 9 aa, Dengue virus
FETTMRGAK

SEQ ID NO: 263208 - protein, 9 aa, Dengue virus
FTRKVRSNA

SEQ ID NO: 263209 - protein, 9 aa, Dengue virus
TSRLLINRF

SEQ ID NO: 263210 - protein, 9 aa, Dengue virus
LTAIANQAA

SEQ ID NO: 263211 - protein, 9 aa, Dengue virus
IHMENVFHT

SEQ ID NO: 263212 - protein, 9 aa, Dengue virus
ISLAAIANQ

SEQ ID NO: 263213 - protein, 9 aa, Dengue virus
IANQAAILM

SEQ ID NO: 263214 - protein, 9 aa, Dengue virus
VEAGRTLRV

SEQ ID NO: 263215 - protein, 9 aa, Dengue virus
IRYQTTAVK

SEQ ID NO: 263216 - protein, 9 aa, Dengue virus
YAVATTFIT

SEQ ID NO: 263217 - protein, 9 aa, Dengue virus
FHTMWHVTR

SEQ ID NO: 263218 - protein, 9 aa, Dengue virus
PHWIAASII

SEQ ID NO: 263219 - protein, 9 aa, Dengue virus
IANQATVLM

SEQ ID NO: 263220 - protein, 9 aa, Dengue virus
WLSYKVASA

SEQ ID NO: 263221 - protein, 9 aa, Dengue virus
YAQMWSLMY

SEQ ID NO: 263222 - protein, 9 aa, Dengue virus
YRIKQRGIL

SEQ ID NO: 263223 - protein, 9 aa, Dengue virus
YQHALSELP

SEQ ID NO: 263224 - protein, 9 aa, Dengue virus
STRVPNYNL

SEQ ID NO: 263225 - protein, 9 aa, Dengue virus
FCEALTLAT

SEQ ID NO: 263226 - protein, 9 aa, Dengue virus
FQPESPARL

SEQ ID NO: 263227 - protein, 9 aa, Dengue virus
LRHSIENSS

SEQ ID NO: 263228 - protein, 9 aa, Dengue virus
WMSAEGAWR

SEQ ID NO: 263229 - protein, 9 aa, Dengue virus
WMTTEDMLA

SEQ ID NO: 263230 - protein, 9 aa, Dengue virus
LIMKDGRVL

SEQ ID NO: 263231 - protein, 9 aa, Dengue virus
WALCEVITL

SEQ ID NO: 263232 - protein, 9 aa, Dengue virus
FKAERVIDP

SEQ ID NO: 263233 - protein, 9 aa, Dengue virus
VWFVPSIKT

SEQ ID NO: 263234 - protein, 9 aa, Dengue virus
LTLATGPVL

SEQ ID NO: 263235 - protein, 9 aa, Dengue virus
WAYHGSYEV

SEQ ID NO: 263236 - protein, 9 aa, Dengue virus
MGLDKGWPI

SEQ ID NO: 263237 - protein, 9 aa, Dengue virus
LNGKGPLRM

SEQ ID NO: 263238 - protein, 9 aa, Dengue virus
IENTSANLS

SEQ ID NO: 263239 - protein, 9 aa, Dengue virus
FSRGMLQGQ

SEQ ID NO: 263240 - protein, 9 aa, Dengue virus
MINGVVRLL

SEQ ID NO: 263241 - protein, 9 aa, Dengue virus
LMRTTWALC

SEQ ID NO: 263242 - protein, 9 aa, Dengue virus
ANIFRGSYL

SEQ ID NO: 263243 - protein, 9 aa, Dengue virus
FLAIPPTAG

SEQ ID NO: 263244 - protein, 9 aa, Dengue virus
KAYAQMWSL

SEQ ID NO: 263245 - protein, 9 aa, Dengue virus
VSILLSSLL

SEQ ID NO: 263246 - protein, 9 aa, Dengue virus
SVAARGYIS

SEQ ID NO: 263247 - protein, 9 aa, Dengue virus
DLRLASMAI

SEQ ID NO: 263248 - protein, 9 aa, Dengue virus
HQWMTTEDM

SEQ ID NO: 263249 - protein, 9 aa, Dengue virus
CVKVLNPYM

SEQ ID NO: 263250 - protein, 9 aa, Dengue virus
FETTMRGAK

SEQ ID NO: 263251 - protein, 9 aa, Dengue virus
PKRLASAIQ

SEQ ID NO: 263252 - protein, 9 aa, Dengue virus
VVTTSGTYV

SEQ ID NO: 263253 - protein, 9 aa, Dengue virus
NIVSSVNMV

SEQ ID NO: 263254 - protein, 9 aa, Dengue virus
FNMLKRARN

SEQ ID NO: 263255 - protein, 9 aa, Dengue virus
LGKGWPIHR

SEQ ID NO: 263256 - protein, 9 aa, Dengue virus
FTNMEAQLI

SEQ ID NO: 263257 - protein, 9 aa, Dengue virus
IAKSKPTLD

SEQ ID NO: 263258 - protein, 9 aa, Dengue virus
LTAIANQAT

SEQ ID NO: 263259 - protein, 9 aa, Dengue virus
YGLNTFTNM

SEQ ID NO: 263260 - protein, 9 aa, Dengue virus
VMAFIAFLR

SEQ ID NO: 263261 - protein, 9 aa, Dengue virus
YTTMFGGVS

SEQ ID NO: 263262 - protein, 9 aa, Dengue virus
YKEGVFHTM

SEQ ID NO: 263263 - protein, 9 aa, Dengue virus
PLKLFMALV

SEQ ID NO: 263264 - protein, 9 aa, Dengue virus
WALCEALTL

SEQ ID NO: 263265 - protein, 9 aa, Dengue virus
FSGVEGEGL

SEQ ID NO: 263266 - protein, 9 aa, Dengue virus
FSSELLSGR

SEQ ID NO: 263267 - protein, 9 aa, Dengue virus
CVTTMAKNK

SEQ ID NO: 263268 - protein, 9 aa, Dengue virus
YLEFEALGF

SEQ ID NO: 263269 - protein, 9 aa, Dengue virus
IFVADNVHT

SEQ ID NO: 263270 - protein, 9 aa, Dengue virus
YLPAMVREA

SEQ ID NO: 263271 - protein, 9 aa, Dengue virus
LLKNDIPMT

SEQ ID NO: 263272 - protein, 9 aa, Dengue virus
VVLMGLGKG

SEQ ID NO: 263273 - protein, 9 aa, Dengue virus
LAAIANQAV

SEQ ID NO: 263274 - protein, 9 aa, Dengue virus
WKLEKASFI

SEQ ID NO: 263275 - protein, 9 aa, Dengue virus
LHPASAWTL

SEQ ID NO: 263276 - protein, 9 aa, Dengue virus
LKGLPIRYQ

SEQ ID NO: 263277 - protein, 9 aa, Dengue virus
YWIESSKNQ

SEQ ID NO: 263278 - protein, 9 aa, Dengue virus
VVLMGLGRG

SEQ ID NO: 263279 - protein, 9 aa, Dengue virus
VITGTSADL

SEQ ID NO: 263280 - protein, 9 aa, Dengue virus
IVREALKRR

SEQ ID NO: 263281 - protein, 9 aa, Dengue virus
YFHRRDLRL

SEQ ID NO: 263282 - protein, 9 aa, Dengue virus
YFHRRDLRL

SEQ ID NO: 263283 - protein, 9 aa, Dengue virus
FNMLKRARN

SEQ ID NO: 263284 - protein, 9 aa, Dengue virus
LGKSYAQMW

SEQ ID NO: 263285 - protein, 9 aa, Dengue virus
FMALVAFLR

SEQ ID NO: 263286 - protein, 9 aa, Dengue virus
FGKGSLLTC

SEQ ID NO: 263287 - protein, 9 aa, Dengue virus
MRTSWAFCE

SEQ ID NO: 263288 - protein, 9 aa, Dengue virus
LLLMRTSWA

SEQ ID NO: 263289 - protein, 9 aa, Dengue virus
WALCEALTL

SEQ ID NO: 263290 - protein, 9 aa, Dengue virus
VCYVLSGSS

SEQ ID NO: 263291 - protein, 9 aa, Dengue virus
FHTMWHVTR

SEQ ID NO: 263292 - protein, 9 aa, Dengue virus
TRKYLPAII

SEQ ID NO: 263293 - protein, 9 aa, Dengue virus
HRMDLGVPL

SEQ ID NO: 263294 - protein, 9 aa, Dengue virus
MVREAIRRG

SEQ ID NO: 263295 - protein, 9 aa, Dengue virus
LIGLSSRAT

SEQ ID NO: 263296 - protein, 9 aa, Dengue virus
FCEALTLAT

SEQ ID NO: 263297 - protein, 9 aa, Dengue virus
YLPAIVREA

SEQ ID NO: 263298 - protein, 9 aa, Dengue virus
IFITNNVHT

SEQ ID NO: 263299 - protein, 9 aa, Dengue virus
IEESRTIRV

SEQ ID NO: 263300 - protein, 9 aa, Dengue virus
LLSSTRVPN

SEQ ID NO: 263301 - protein, 9 aa, Dengue virus
CRSCTLPPL

SEQ ID NO: 263302 - protein, 9 aa, Dengue virus
YWIESSKNQ

SEQ ID NO: 263303 - protein, 9 aa, Dengue virus
WVSCGTGNI

SEQ ID NO: 263304 - protein, 9 aa, Dengue virus
LRPASAWTL

SEQ ID NO: 263305 - protein, 9 aa, Dengue virus
VWLSYKVAS

SEQ ID NO: 263306 - protein, 9 aa, Dengue virus
MYWVSNASG

SEQ ID NO: 263307 - protein, 9 aa, Dengue virus
GFGVFTTNI

SEQ ID NO: 263308 - protein, 9 aa, Dengue virus
TACLGKSYA

SEQ ID NO: 263309 - protein, 9 aa, Dengue virus
LLALLGAMT

SEQ ID NO: 263310 - protein, 9 aa, Dengue virus
WNTTIAVSM

SEQ ID NO: 263311 - protein, 9 aa, Dengue virus
FNMLKRERN

SEQ ID NO: 263312 - protein, 9 aa, Dengue virus
LIGLTARAT

SEQ ID NO: 263313 - protein, 9 aa, Dengue virus
YAQMWTLMY

SEQ ID NO: 263314 - protein, 9 aa, Dengue virus
LKRRLRTLI

SEQ ID NO: 263315 - protein, 9 aa, Dengue virus
FRAERVIDP

SEQ ID NO: 263316 - protein, 9 aa, Dengue virus
WVSNASGNI

SEQ ID NO: 263317 - protein, 9 aa, Dengue virus
LTVLLKTAL

SEQ ID NO: 263318 - protein, 9 aa, Dengue virus
LLKNDVPLA

SEQ ID NO: 263319 - protein, 9 aa, Dengue virus
FEKQLGQVM

SEQ ID NO: 263320 - protein, 9 aa, Dengue virus
LRLAANAIC

SEQ ID NO: 263321 - protein, 9 aa, Dengue virus
LEPGKNPRA

SEQ ID NO: 263322 - protein, 9 aa, Dengue virus
LMRTSWALC

SEQ ID NO: 263323 - protein, 9 aa, Dengue virus
TLYAVATTV

SEQ ID NO: 263324 - protein, 9 aa, Dengue virus
VRTNAAIGA

SEQ ID NO: 263325 - protein, 9 aa, Dengue virus
LTAIANQAV

SEQ ID NO: 263326 - protein, 9 aa, Dengue virus
TKRILPSIV

SEQ ID NO: 263327 - protein, 9 aa, Dengue virus
WQIEKASLI

SEQ ID NO: 263328 - protein, 9 aa, Dengue virus
VQQLTKRFS

SEQ ID NO: 263329 - protein, 9 aa, Dengue virus
IANQATVLM

SEQ ID NO: 263330 - protein, 9 aa, Dengue virus
FCESLTLAT

SEQ ID NO: 263331 - protein, 9 aa, Dengue virus
FKNAHAKRQ

SEQ ID NO: 263332 - protein, 9 aa, Dengue virus
YMWLGARFL

SEQ ID NO: 263333 - protein, 9 aa, Dengue virus
LSGRGPLKL

SEQ ID NO: 263334 - protein, 9 aa, Dengue virus
CVTTMAKNK

SEQ ID NO: 263335 - protein, 9 aa, Dengue virus
VCYVLSGSS

SEQ ID NO: 263336 - protein, 9 aa, Dengue virus
FIAFLRFLT

SEQ ID NO: 263337 - protein, 9 aa, Dengue virus
PVRVPNYNM

SEQ ID NO: 263338 - protein, 9 aa, Dengue virus
LVTFKNAHA

SEQ ID NO: 263339 - protein, 9 aa, Dengue virus
FRGSYLAGA

SEQ ID NO: 263340 - protein, 9 aa, Dengue virus
VEAGRTLRV

SEQ ID NO: 263341 - protein, 9 aa, Dengue virus
GSYLAGAGL

SEQ ID NO: 263342 - protein, 9 aa, Dengue virus
SLRTTTASG

SEQ ID NO: 263343 - protein, 9 aa, Dengue virus
WDVVPTVTQ

SEQ ID NO: 263344 - protein, 9 aa, Dengue virus
VRSNAALGA

SEQ ID NO: 263345 - protein, 9 aa, Dengue virus
YGMEIRPLK

SEQ ID NO: 263346 - protein, 9 aa, Dengue virus
VSQLAKRFS

SEQ ID NO: 263347 - protein, 9 aa, Dengue virus
TFITPMMRH

SEQ ID NO: 263348 - protein, 9 aa, Dengue virus
FQPESPARL

SEQ ID NO: 263349 - protein, 9 aa, Dengue virus
LLRNDVPMA

SEQ ID NO: 263350 - protein, 9 aa, Dengue virus
FCSHHFHQL

SEQ ID NO: 263351 - protein, 9 aa, Dengue virus
MMRTTWALC

SEQ ID NO: 263352 - protein, 9 aa, Dengue virus
SRMLLNRFT

SEQ ID NO: 263353 - protein, 9 aa, Dengue virus
VKLLTKPWD

SEQ ID NO: 263354 - protein, 9 aa, Dengue virus
FEATARGAR

SEQ ID NO: 263355 - protein, 9 aa, Dengue virus
WALCEALTL

SEQ ID NO: 263356 - protein, 9 aa, Dengue virus
TQVLLMRTT

SEQ ID NO: 263357 - protein, 9 aa, Dengue virus
LLKNDIPMT

SEQ ID NO: 263358 - protein, 9 aa, Dengue virus
WMTTEDMLS

SEQ ID NO: 263359 - protein, 9 aa, Dengue virus
YRGAKRMAI

SEQ ID NO: 263360 - protein, 9 aa, Dengue virus
FSGQGPMKL

SEQ ID NO: 263361 - protein, 9 aa, Dengue virus
CIKILNPYM

SEQ ID NO: 263362 - protein, 9 aa, Dengue virus
IFVVDNVHT

SEQ ID NO: 263363 - protein, 9 aa, Dengue virus
ISQGAGWSL

SEQ ID NO: 263364 - protein, 9 aa, Dengue virus
LLKNDVPLA

SEQ ID NO: 263365 - protein, 9 aa, Dengue virus
IRYQTTATK

SEQ ID NO: 263366 - protein, 9 aa, Dengue virus
WLAHKVAAE

SEQ ID NO: 263367 - protein, 9 aa, Dengue virus
LGSQEGAMH

SEQ ID NO: 263368 - protein, 9 aa, Dengue virus
IKKVRTNAA

SEQ ID NO: 263369 - protein, 9 aa, Dengue virus
LLKNDVPLA

SEQ ID NO: 263370 - protein, 9 aa, Dengue virus
SVALTPHSG

SEQ ID NO: 263371 - protein, 9 aa, Dengue virus
WLDARVYSD

SEQ ID NO: 263372 - protein, 9 aa, Dengue virus
MAMTDTTPF

SEQ ID NO: 263373 - protein, 9 aa, Dengue virus
WQIEKASLI

SEQ ID NO: 263374 - protein, 9 aa, Dengue virus
VVLMGLDKG

SEQ ID NO: 263375 - protein, 9 aa, Dengue virus
DLRLAANAI

SEQ ID NO: 263376 - protein, 9 aa, Dengue virus
VSILASSLL

SEQ ID NO: 263377 - protein, 9 aa, Dengue virus
FQPESPKRL

SEQ ID NO: 263378 - protein, 9 aa, Dengue virus
FLRFLAIPP

SEQ ID NO: 263379 - protein, 9 aa, Dengue virus
TRKYLPAIV

SEQ ID NO: 263380 - protein, 9 aa, Dengue virus
VNMVSRMLL

SEQ ID NO: 263381 - protein, 9 aa, Dengue virus
LVKLYSGKD

SEQ ID NO: 263382 - protein, 9 aa, Dengue virus
WMTTEDMLK

SEQ ID NO: 263383 - protein, 9 aa, Dengue virus
LVKLYSGKD

SEQ ID NO: 263384 - protein, 9 aa, Dengue virus
IAVSMANIF

SEQ ID NO: 263385 - protein, 9 aa, Dengue virus
WDVVPTVTQ

SEQ ID NO: 263386 - protein, 9 aa, Dengue virus
IHMENVFHT

SEQ ID NO: 263387 - protein, 9 aa, Dengue virus
QRGLLGKTQ

SEQ ID NO: 263388 - protein, 9 aa, Dengue virus
FTMRLLSPV

SEQ ID NO: 263389 - protein, 9 aa, Dengue virus
YGMEIRPLK

SEQ ID NO: 263390 - protein, 9 aa, Dengue virus
VTRSGAYVS

SEQ ID NO: 263391 - protein, 9 aa, Dengue virus
LKRARNRVS

SEQ ID NO: 263392 - protein, 9 aa, Dengue virus
MVSILASAL

SEQ ID NO: 263393 - protein, 9 aa, Dengue virus
IREAIKRKL

SEQ ID NO: 263394 - protein, 9 aa, Dengue virus
VWFVPSIKT

SEQ ID NO: 263395 - protein, 9 aa, Dengue virus
FGGVSWVMK

SEQ ID NO: 263396 - protein, 9 aa, Dengue virus
VVRLLTKPW

SEQ ID NO: 263397 - protein, 9 aa, Dengue virus
CYSQVNPLT

SEQ ID NO: 263398 - protein, 9 aa, Dengue virus
LLSGRGPLK

SEQ ID NO: 263399 - protein, 9 aa, Dengue virus
YCGGLKNVT

SEQ ID NO: 263400 - protein, 9 aa, Dengue virus
VVSILASSF

SEQ ID NO: 263401 - protein, 9 aa, Dengue virus
LIMKDGRSL

SEQ ID NO: 263402 - protein, 9 aa, Dengue virus
FLRVLSIPP

SEQ ID NO: 263403 - protein, 9 aa, Dengue virus
YISTRVEMG

SEQ ID NO: 263404 - protein, 9 aa, Dengue virus
VTYSLNTFT

SEQ ID NO: 263405 - protein, 9 aa, Dengue virus
VEAGRTLRV

SEQ ID NO: 263406 - protein, 9 aa, Dengue virus
IVASVNTTS

SEQ ID NO: 263407 - protein, 9 aa, Dengue virus
YGVLFSGVS

SEQ ID NO: 263408 - protein, 9 aa, Dengue virus
FQPESPARL

SEQ ID NO: 263409 - protein, 9 aa, Dengue virus
YAQMWALMY

SEQ ID NO: 263410 - protein, 9 aa, Dengue virus
LILCASQIL

SEQ ID NO: 263411 - protein, 9 aa, Dengue virus
WLVHKQWFL

SEQ ID NO: 263412 - protein, 9 aa, Dengue virus
WAYHGSYEV

SEQ ID NO: 263413 - protein, 9 aa, Dengue virus
LIMKDGRSL

SEQ ID NO: 263414 - protein, 9 aa, Dengue virus
IEEGRTLRV

SEQ ID NO: 263415 - protein, 9 aa, Dengue virus
MVSILASAL

SEQ ID NO: 263416 - protein, 9 aa, Dengue virus
WAYHGSYEV

SEQ ID NO: 263417 - protein, 9 aa, Dengue virus
AVSMANIFR

SEQ ID NO: 263418 - protein, 9 aa, Dengue virus
YGMEIRPVS

SEQ ID NO: 263419 - protein, 9 aa, Dengue virus
WMTTEDMLS

SEQ ID NO: 263420 - protein, 9 aa, Dengue virus
FKAGRVIDP

SEQ ID NO: 263421 - protein, 9 aa, Dengue virus
FCSHHFHEL

SEQ ID NO: 263422 - protein, 9 aa, Dengue virus
LLRNDVPLA

SEQ ID NO: 263423 - protein, 9 aa, Dengue virus
LTAIANQAT

SEQ ID NO: 263424 - protein, 9 aa, Dengue virus
YRGAKRMAI

SEQ ID NO: 263425 - protein, 9 aa, Dengue virus
FQPESPSRL

SEQ ID NO: 263426 - protein, 9 aa, Dengue virus
VRSNAAMGA

SEQ ID NO: 263427 - protein, 9 aa, Dengue virus
YYMATLKNV

SEQ ID NO: 263428 - protein, 9 aa, Dengue virus
WLAYKVASE

SEQ ID NO: 263429 - protein, 9 aa, Dengue virus
VTYGLNTFT

SEQ ID NO: 263430 - protein, 9 aa, Dengue virus
SIAARGYIS

SEQ ID NO: 263431 - protein, 9 aa, Dengue virus
LVSLLGSSL

SEQ ID NO: 263432 - protein, 9 aa, Dengue virus
IAKNKPTLD

SEQ ID NO: 263433 - protein, 9 aa, Dengue virus
YISTRVGMG

SEQ ID NO: 263434 - protein, 9 aa, Dengue virus
WLVHKQWFF

SEQ ID NO: 263435 - protein, 9 aa, Dengue virus
LEPGKNPRA

SEQ ID NO: 263436 - protein, 9 aa, Dengue virus
VALAPHVGL

SEQ ID NO: 263437 - protein, 9 aa, Dengue virus
FQPESPARV

SEQ ID NO: 263438 - protein, 9 aa, Dengue virus
YGMEIRPVS

SEQ ID NO: 263439 - protein, 9 aa, Dengue virus
IVASVNTTS

SEQ ID NO: 263440 - protein, 9 aa, Dengue virus
LLNGKGPLR

SEQ ID NO: 263441 - protein, 9 aa, Dengue virus
SKMDIGVPL

SEQ ID NO: 263442 - protein, 9 aa, Dengue virus
LVTFKNPHA

SEQ ID NO: 263443 - protein, 9 aa, Dengue virus
VVRLLTKPW

SEQ ID NO: 263444 - protein, 9 aa, Dengue virus
MRGAKRMAI

SEQ ID NO: 263445 - protein, 9 aa, Dengue virus
LKGMPIRYQ

SEQ ID NO: 263446 - protein, 9 aa, Dengue virus
WHVTRGAVL

SEQ ID NO: 263447 - protein, 9 aa, Dengue virus
FLRVLSIPP

SEQ ID NO: 263448 - protein, 9 aa, Dengue virus
MAKNKPTLD

SEQ ID NO: 263449 - protein, 9 aa, Dengue virus
MRTSWALCE

SEQ ID NO: 263450 - protein, 9 aa, Dengue virus
VALTPHSGM

SEQ ID NO: 263451 - protein, 9 aa, Dengue virus
IAMTDTTPF

SEQ ID NO: 263452 - protein, 9 aa, Dengue virus
IFVIDNVHT

SEQ ID NO: 263453 - protein, 9 aa, Dengue virus
LRTTTVTGK

SEQ ID NO: 263454 - protein, 9 aa, Dengue virus
IFVADNVHT

SEQ ID NO: 263455 - protein, 9 aa, Dengue virus
MGLDKGWPI

SEQ ID NO: 263456 - protein, 9 aa, Dengue virus
IRYQTPAIR

SEQ ID NO: 263457 - protein, 9 aa, Dengue virus
YSQVNPITL

SEQ ID NO: 263458 - protein, 9 aa, Dengue virus
WMTTEDMLA

SEQ ID NO: 263459 - protein, 9 aa, Dengue virus
LILAPTRVV

SEQ ID NO: 263460 - protein, 9 aa, Dengue virus
ISKMLINRF

SEQ ID NO: 263461 - protein, 9 aa, Dengue virus
MGLGRGWPI

SEQ ID NO: 263462 - protein, 9 aa, Dengue virus
FQPESPSRL

SEQ ID NO: 263463 - protein, 9 aa, Dengue virus
FLRFLAIPP

SEQ ID NO: 263464 - protein, 9 aa, Dengue virus
LVTFKNPHA

SEQ ID NO: 263465 - protein, 9 aa, Dengue virus
IKRGLRTLI

SEQ ID NO: 263466 - protein, 9 aa, Dengue virus
FCEVLTLAT

SEQ ID NO: 263467 - protein, 9 aa, Dengue virus
YGWNIVKLM

SEQ ID NO: 263468 - protein, 9 aa, Dengue virus
MGLGKGWPI

SEQ ID NO: 263469 - protein, 9 aa, Dengue virus
YVMTGRSAD

SEQ ID NO: 263470 - protein, 9 aa, Dengue virus
IRYQTTATK

SEQ ID NO: 263471 - protein, 9 aa, Dengue virus
IKDSKAVHA

SEQ ID NO: 263472 - protein, 9 aa, Dengue virus
PLKLFMALV

SEQ ID NO: 263473 - protein, 9 aa, Dengue virus
YRGAKRMAI

SEQ ID NO: 263474 - protein, 9 aa, Dengue virus
MLRHSIENS

SEQ ID NO: 263475 - protein, 9 aa, Dengue virus
FQPESPKRL

SEQ ID NO: 263476 - protein, 9 aa, Dengue virus
PQWIASAII

SEQ ID NO: 263477 - protein, 9 aa, Dengue virus
YISTRVEMG

SEQ ID NO: 263478 - protein, 9 aa, Dengue virus
IMKNPTVDG

SEQ ID NO: 263479 - protein, 9 aa, Dengue virus
IVLEHGSCV

SEQ ID NO: 263480 - protein, 9 aa, Dengue virus
WQIEKASLI

SEQ ID NO: 263481 - protein, 9 aa, Dengue virus
LTLATGPVS

SEQ ID NO: 263482 - protein, 9 aa, Dengue virus
TKRYLPAIV

SEQ ID NO: 263483 - protein, 9 aa, Dengue virus
IFVADNVHT

SEQ ID NO: 263484 - protein, 9 aa, Dengue virus
YGAAFSGVS

SEQ ID NO: 263485 - protein, 9 aa, Dengue virus
TFKVPHAKK

SEQ ID NO: 263486 - protein, 9 aa, Dengue virus
LLLMRTSWA

SEQ ID NO: 263487 - protein, 9 aa, Dengue virus
LLRNDVPMA

SEQ ID NO: 263488 - protein, 9 aa, Dengue virus
WNLVKLHSG

SEQ ID NO: 263489 - protein, 9 aa, Dengue virus
LILAPTRVV

SEQ ID NO: 263490 - protein, 9 aa, Dengue virus
IENTSANLS

SEQ ID NO: 263491 - protein, 9 aa, Dengue virus
ITPMLRHTI

SEQ ID NO: 263492 - protein, 9 aa, Dengue virus
TSKMLLNRF

SEQ ID NO: 263493 - protein, 9 aa, Dengue virus
WKMERASFI

SEQ ID NO: 263494 - protein, 9 aa, Dengue virus
MYWVSNASG

SEQ ID NO: 263495 - protein, 9 aa, Dengue virus
MYWVSNASG

SEQ ID NO: 263496 - protein, 9 aa, Dengue virus
FLRFLTIPP

SEQ ID NO: 263497 - protein, 9 aa, Dengue virus
LHKLGKCGS

SEQ ID NO: 263498 - protein, 9 aa, Dengue virus
FIAFLRFLA

SEQ ID NO: 263499 - protein, 9 aa, Dengue virus
LQWIASAIV

SEQ ID NO: 263500 - protein, 9 aa, Dengue virus
ANIFRGSYL

SEQ ID NO: 263501 - protein, 9 aa, Dengue virus
GFGVFTTNI

SEQ ID NO: 263502 - protein, 9 aa, Dengue virus
MVSILASAL

SEQ ID NO: 263503 - protein, 9 aa, Dengue virus
NRVSTGSQL

SEQ ID NO: 263504 - protein, 9 aa, Dengue virus
SQILLMRTT

SEQ ID NO: 263505 - protein, 9 aa, Dengue virus
LAAIANQAT

SEQ ID NO: 263506 - protein, 9 aa, Dengue virus
IKKVRTNAA

SEQ ID NO: 263507 - protein, 9 aa, Dengue virus
YGWNLVKLY

SEQ ID NO: 263508 - protein, 9 aa, Dengue virus
IVSSVNMIS

SEQ ID NO: 263509 - protein, 9 aa, Dengue virus
TSRLLINRF

SEQ ID NO: 263510 - protein, 9 aa, Dengue virus
PRWLDARVY

SEQ ID NO: 263511 - protein, 9 aa, Dengue virus
IENTSANLS

SEQ ID NO: 263512 - protein, 9 aa, Dengue virus
YLPAIVREA

SEQ ID NO: 263513 - protein, 9 aa, Dengue virus
LVTFKNPHA

SEQ ID NO: 263514 - protein, 9 aa, Dengue virus
FLRFLTIPP

SEQ ID NO: 263515 - protein, 9 aa, Dengue virus
TRKYLPAIV

SEQ ID NO: 263516 - protein, 9 aa, Dengue virus
IANQATVLM

SEQ ID NO: 263517 - protein, 9 aa, Dengue virus
YAVATTFIT

SEQ ID NO: 263518 - protein, 9 aa, Dengue virus
TVSQLAKRF

SEQ ID NO: 263519 - protein, 9 aa, Dengue virus
VILAGPIPV

SEQ ID NO: 263520 - protein, 9 aa, Dengue virus
WMTTEDMLS

SEQ ID NO: 263521 - protein, 9 aa, Dengue virus
ILLMRTSWA

SEQ ID NO: 263522 - protein, 9 aa, Dengue virus
PMATYGWNL

SEQ ID NO: 263523 - protein, 9 aa, Dengue virus
LLSGRGPLK

SEQ ID NO: 263524 - protein, 9 aa, Dengue virus
IRYQTTAVK

SEQ ID NO: 263525 - protein, 9 aa, Dengue virus
YAQMWALMY

SEQ ID NO: 263526 - protein, 9 aa, Dengue virus
WAFCESLTL

SEQ ID NO: 263527 - protein, 9 aa, Dengue virus
WHVTRGAVL

SEQ ID NO: 263528 - protein, 9 aa, Dengue virus
RMAILGETA

SEQ ID NO: 263529 - protein, 9 aa, Dengue virus
TIENTSANL

SEQ ID NO: 263530 - protein, 9 aa, Dengue virus
WMTTEDMLS

SEQ ID NO: 263531 - protein, 9 aa, Dengue virus
CVTTIAKNK

SEQ ID NO: 263532 - protein, 9 aa, Dengue virus
LTAIANQAA

SEQ ID NO: 263533 - protein, 9 aa, Dengue virus
IRRGLRTLI

SEQ ID NO: 263534 - protein, 9 aa, Dengue virus
IRYQTTAIK

SEQ ID NO: 263535 - protein, 9 aa, Dengue virus
YVITGTSAD

SEQ ID NO: 263536 - protein, 9 aa, Dengue virus
SRTIRVLSL

SEQ ID NO: 263537 - protein, 9 aa, Dengue virus
IYGAAFSGV

SEQ ID NO: 263538 - protein, 9 aa, Dengue virus
LAKRFSKGL

SEQ ID NO: 263539 - protein, 9 aa, Dengue virus
SKMDIGVPL

SEQ ID NO: 263540 - protein, 9 aa, Dengue virus
VWFVPSIKT

SEQ ID NO: 263541 - protein, 9 aa, Dengue virus
IFMTATPPG

SEQ ID NO: 263542 - protein, 9 aa, Dengue virus
NTTANISLT

SEQ ID NO: 263543 - protein, 9 aa, Dengue virus
IEEGRTLRV

SEQ ID NO: 263544 - protein, 9 aa, Dengue virus
FWNTTIAVS

SEQ ID NO: 263545 - protein, 9 aa, Dengue virus
WMTTEDMLS

SEQ ID NO: 263546 - protein, 9 aa, Dengue virus
FRADRVIDP

SEQ ID NO: 263547 - protein, 9 aa, Dengue virus
IFITDNVHT

SEQ ID NO: 263548 - protein, 9 aa, Dengue virus
SLRTTTVSG

SEQ ID NO: 263549 - protein, 9 aa, Dengue virus
CIKVLNPYM

SEQ ID NO: 263550 - protein, 9 aa, Dengue virus
WIASSIILE

SEQ ID NO: 263551 - protein, 9 aa, Dengue virus
CHATFTTRL

SEQ ID NO: 263552 - protein, 9 aa, Dengue virus
LTAIANQAT

SEQ ID NO: 263553 - protein, 9 aa, Dengue virus
FLRFLTIPP

SEQ ID NO: 263554 - protein, 9 aa, Dengue virus
IVSILASSL

SEQ ID NO: 263555 - protein, 9 aa, Dengue virus
LIMKDGRSL

SEQ ID NO: 263556 - protein, 9 aa, Dengue virus
LTLATGPIL

SEQ ID NO: 263557 - protein, 9 aa, Dengue virus
VWLAYKVAS

SEQ ID NO: 263558 - protein, 9 aa, Dengue virus
IRYQTTAVK

SEQ ID NO: 263559 - protein, 9 aa, Dengue virus
LILAPTRVV

SEQ ID NO: 263560 - protein, 9 aa, Dengue virus
IGKMFETTM

SEQ ID NO: 263561 - protein, 9 aa, Dengue virus
FCSHHFHKI

SEQ ID NO: 263562 - protein, 9 aa, Dengue virus
VVRVQRPAK

SEQ ID NO: 263563 - protein, 9 aa, Dengue virus
YAVATTVLT

SEQ ID NO: 263564 - protein, 9 aa, Dengue virus
PMATYGWNL

SEQ ID NO: 263565 - protein, 9 aa, Dengue virus
ITPMLRHSI

SEQ ID NO: 263566 - protein, 9 aa, Dengue virus
MRTSWAFCE

SEQ ID NO: 263567 - protein, 9 aa, Dengue virus
YFHRRDLRL

SEQ ID NO: 263568 - protein, 9 aa, Dengue virus
MINGVVRLL

SEQ ID NO: 263569 - protein, 9 aa, Dengue virus
CYVLSGSSA

SEQ ID NO: 263570 - protein, 9 aa, Dengue virus
VCYVLSGSS

SEQ ID NO: 263571 - protein, 9 aa, Dengue virus
IRYQTPAIR

SEQ ID NO: 263572 - protein, 9 aa, Dengue virus
WCNATSTWV

SEQ ID NO: 263573 - protein, 9 aa, Dengue virus
VVPMVTQLA

SEQ ID NO: 263574 - protein, 9 aa, Dengue virus
YFHRRDLRL

SEQ ID NO: 263575 - protein, 9 aa, Dengue virus
TRRYLPAMV

SEQ ID NO: 263576 - protein, 9 aa, Dengue virus
LQGQGPMKM

SEQ ID NO: 263577 - protein, 9 aa, Dengue virus
IVASVNTTS

SEQ ID NO: 263578 - protein, 9 aa, Dengue virus
AVSRGSAKI

SEQ ID NO: 263579 - protein, 9 aa, Dengue virus
TYSLNTFTN

SEQ ID NO: 263580 - protein, 9 aa, Dengue virus
LAKRFSKGL

SEQ ID NO: 263581 - protein, 9 aa, Dengue virus
FKLTYQNKV

SEQ ID NO: 263582 - protein, 9 aa, Dengue virus
YGWNLVKLH

SEQ ID NO: 263583 - protein, 9 aa, Dengue virus
WYGMEIRPI

SEQ ID NO: 263584 - protein, 9 aa, Dengue virus
LGSQEGAMR

SEQ ID NO: 263585 - protein, 9 aa, Dengue virus
WHVTRGSVI

SEQ ID NO: 263586 - protein, 9 aa, Dengue virus
VLPMVTQIA

SEQ ID NO: 263587 - protein, 9 aa, Dengue virus
ILARWGSFK

SEQ ID NO: 263588 - protein, 9 aa, Dengue virus
MVSILASAL

SEQ ID NO: 263589 - protein, 9 aa, Dengue virus
LTLATGPIL

SEQ ID NO: 263590 - protein, 9 aa, Dengue virus
IFVADNVHT

SEQ ID NO: 263591 - protein, 9 aa, Dengue virus
LLMMRTTWA

SEQ ID NO: 263592 - protein, 9 aa, Dengue virus
FCSHHFHQL

SEQ ID NO: 263593 - protein, 9 aa, Dengue virus
ATTIVTPML

SEQ ID NO: 263594 - protein, 9 aa, Dengue virus
YGWNLVKLY

SEQ ID NO: 263595 - protein, 9 aa, Dengue virus
WIASAIVLE

SEQ ID NO: 263596 - protein, 9 aa, Dengue virus
SKLMSAAIK

SEQ ID NO: 263597 - protein, 9 aa, Dengue virus
VWFVPSIKT

SEQ ID NO: 263598 - protein, 9 aa, Dengue virus
YNHALNELP

SEQ ID NO: 263599 - protein, 9 aa, Dengue virus
AKRFSRGML

SEQ ID NO: 263600 - protein, 9 aa, Dengue virus
TKRILPSIV

SEQ ID NO: 263601 - protein, 9 aa, Dengue virus
IWYMWLGAR

SEQ ID NO: 263602 - protein, 9 aa, Dengue virus
MGLDKGWPI

SEQ ID NO: 263603 - protein, 9 aa, Dengue virus
LAAIANQAA

SEQ ID NO: 263604 - protein, 9 aa, Dengue virus
YGWNLVRLQ

SEQ ID NO: 263605 - protein, 9 aa, Dengue virus
YRLKGEARK

SEQ ID NO: 263606 - protein, 9 aa, Dengue virus
DARIYSDPL

SEQ ID NO: 263607 - protein, 9 aa, Dengue virus
LLRNDVPMA

SEQ ID NO: 263608 - protein, 9 aa, Dengue virus
LVMKDGRKL

SEQ ID NO: 263609 - protein, 9 aa, Dengue virus
FKLTYQNKV

SEQ ID NO: 263610 - protein, 9 aa, Dengue virus
IAVSTANIF

SEQ ID NO: 263611 - protein, 9 aa, Dengue virus
GCYSQVNPI

SEQ ID NO: 263612 - protein, 9 aa, Dengue virus
LVTFKTAHA

SEQ ID NO: 263613 - protein, 9 aa, Dengue virus
TIENTSANL

SEQ ID NO: 263614 - protein, 9 aa, Dengue virus
YISTRVGMG

SEQ ID NO: 263615 - protein, 9 aa, Dengue virus
PVRVPNYNL

SEQ ID NO: 263616 - protein, 9 aa, Dengue virus
YVITGTSAD

SEQ ID NO: 263617 - protein, 9 aa, Dengue virus
IEESRTIRV

SEQ ID NO: 263618 - protein, 9 aa, Dengue virus
FHTMWHVTR

SEQ ID NO: 263619 - protein, 9 aa, Dengue virus
FTNMEVQLI

SEQ ID NO: 263620 - protein, 9 aa, Dengue virus
TIENTTANI

SEQ ID NO: 263621 - protein, 9 aa, Dengue virus
RSVALVPHV

SEQ ID NO: 263622 - protein, 9 aa, Dengue virus
VNGVVRLLT

SEQ ID NO: 263623 - protein, 9 aa, Dengue virus
IRSTTRLEN

SEQ ID NO: 263624 - protein, 9 aa, Dengue virus
YMWLGARFL

SEQ ID NO: 263625 - protein, 9 aa, Dengue virus
TMRGAKRMA

SEQ ID NO: 263626 - protein, 9 aa, Dengue virus
WVSNASGNI

SEQ ID NO: 263627 - protein, 9 aa, Dengue virus
WLVHKQWFL

SEQ ID NO: 263628 - protein, 9 aa, Dengue virus
LILAPTRVV

SEQ ID NO: 263629 - protein, 9 aa, Dengue virus
FGKAKGSRA

SEQ ID NO: 263630 - protein, 9 aa, Dengue virus
WNTTIAVSM

SEQ ID NO: 263631 - protein, 9 aa, Dengue virus
YAVATTFIT

SEQ ID NO: 263632 - protein, 9 aa, Dengue virus
IVASVNTTS

SEQ ID NO: 263633 - protein, 9 aa, Dengue virus
TRLLSSTRV

SEQ ID NO: 263634 - protein, 9 aa, Dengue virus
IRYQTPAVK

SEQ ID NO: 263635 - protein, 9 aa, Dengue virus
WNTTIAVST

SEQ ID NO: 263636 - protein, 9 aa, Dengue virus
KRFSRGMLQ

SEQ ID NO: 263637 - protein, 9 aa, Dengue virus
TMRLLSPVR

SEQ ID NO: 263638 - protein, 9 aa, Dengue virus
FGKAKGSRA

SEQ ID NO: 263639 - protein, 9 aa, Dengue virus
VEAGRTLRV

SEQ ID NO: 263640 - protein, 9 aa, Dengue virus
YISTRVGMG

SEQ ID NO: 263641 - protein, 9 aa, Dengue virus
QWMTTEDML

SEQ ID NO: 263642 - protein, 9 aa, Dengue virus
MGLGRGWPI

SEQ ID NO: 263643 - protein, 9 aa, Dengue virus
IRRGLRTLI

SEQ ID NO: 263644 - protein, 9 aa, Dengue virus
LLMRTSWAF

SEQ ID NO: 263645 - protein, 9 aa, Dengue virus
MLKRARNRV

SEQ ID NO: 263646 - protein, 9 aa, Dengue virus
YSQVNPLTL

SEQ ID NO: 263647 - protein, 9 aa, Dengue virus
YSQVNPTTL

SEQ ID NO: 263648 - protein, 9 aa, Dengue virus
AVSMANIFR

SEQ ID NO: 263649 - protein, 9 aa, Dengue virus
LKCKVRMEK

SEQ ID NO: 263650 - protein, 9 aa, Dengue virus
SKLMSAAIK

SEQ ID NO: 263651 - protein, 9 aa, Dengue virus
VWFVPSIKS

SEQ ID NO: 263652 - protein, 9 aa, Dengue virus
LAAIANQAV

SEQ ID NO: 263653 - protein, 9 aa, Dengue virus
YAQMWSLMY

SEQ ID NO: 263654 - protein, 9 aa, Dengue virus
TTTVSGKLI

SEQ ID NO: 263655 - protein, 9 aa, Dengue virus
VKATGSASS

SEQ ID NO: 263656 - protein, 9 aa, Dengue virus
VLTLATGPV

SEQ ID NO: 263657 - protein, 9 aa, Dengue virus
VNTTSRLLL

SEQ ID NO: 263658 - protein, 9 aa, Dengue virus
TRKVRSNAA

SEQ ID NO: 263659 - protein, 9 aa, Dengue virus
LTIMDLHPG

SEQ ID NO: 263660 - protein, 9 aa, Dengue virus
LLRNDVPLA

SEQ ID NO: 263661 - protein, 9 aa, Dengue virus
CHATFTMRL

SEQ ID NO: 263662 - protein, 9 aa, Dengue virus
WQIEKASLI

SEQ ID NO: 263663 - protein, 9 aa, Dengue virus
YAQMWALMY

SEQ ID NO: 263664 - protein, 9 aa, Dengue virus
KRKLRTLVL

SEQ ID NO: 263665 - protein, 9 aa, Dengue virus
ARGYISTRV

SEQ ID NO: 263666 - protein, 9 aa, Dengue virus
VFHTMWHVT

SEQ ID NO: 263667 - protein, 9 aa, Dengue virus
LLKNDVPLA

SEQ ID NO: 263668 - protein, 9 aa, Dengue virus
FCSHHFHQL

SEQ ID NO: 263669 - protein, 9 aa, Dengue virus
LNTFTNMEA

SEQ ID NO: 263670 - protein, 9 aa, Dengue virus
YGVLFSGVS

SEQ ID NO: 263671 - protein, 9 aa, Dengue virus
LQWIASAIV

SEQ ID NO: 263672 - protein, 9 aa, Dengue virus
RIKQKGIFG

SEQ ID NO: 263673 - protein, 9 aa, Dengue virus
IRYQTPAVK

SEQ ID NO: 263674 - protein, 9 aa, Dengue virus
LLLMRTSWA

SEQ ID NO: 263675 - protein, 9 aa, Dengue virus
IREAIKRKL

SEQ ID NO: 263676 - protein, 9 aa, Dengue virus
LRKSGKRVI

SEQ ID NO: 263677 - protein, 9 aa, Dengue virus
LAAIANQAT

SEQ ID NO: 263678 - protein, 9 aa, Dengue virus
YSQVNPLTL

SEQ ID NO: 263679 - protein, 9 aa, Dengue virus
MFEATARGA

SEQ ID NO: 263680 - protein, 9 aa, Dengue virus
YKFQPESPA

SEQ ID NO: 263681 - protein, 9 aa, Dengue virus
FQADSPKRL

SEQ ID NO: 263682 - protein, 9 aa, Dengue virus
LILAPTRVV

SEQ ID NO: 263683 - protein, 9 aa, Dengue virus
LTLATGPVS

SEQ ID NO: 263684 - protein, 9 aa, Dengue virus
FGRAKGSRA

SEQ ID NO: 263685 - protein, 9 aa, Dengue virus
IHMENVFHT

SEQ ID NO: 263686 - protein, 9 aa, Dengue virus
LQWIASAIV

SEQ ID NO: 263687 - protein, 9 aa, Dengue virus
VRTNAAIGA

SEQ ID NO: 263688 - protein, 9 aa, Dengue virus
VWLAYKVAA

SEQ ID NO: 263689 - protein, 9 aa, Dengue virus
LNTFTNMEV

SEQ ID NO: 263690 - protein, 9 aa, Dengue virus
INKVRSNAA

SEQ ID NO: 263691 - protein, 9 aa, Dengue virus
LTKRFSLGL

SEQ ID NO: 263692 - protein, 9 aa, Dengue virus
WNTTIAVST

SEQ ID NO: 263693 - protein, 9 aa, Dengue virus
LTAIANQAV

SEQ ID NO: 263694 - protein, 9 aa, Dengue virus
TTIITPMLR

SEQ ID NO: 263695 - protein, 9 aa, Dengue virus
MGLGKGWPI

SEQ ID NO: 263696 - protein, 9 aa, Dengue virus
WLVHRQWFL

SEQ ID NO: 263697 - protein, 9 aa, Dengue virus
VKRFSSELL

SEQ ID NO: 263698 - protein, 9 aa, Dengue virus
YGVLFSGVS

SEQ ID NO: 263699 - protein, 9 aa, Dengue virus
IENSTANVS

SEQ ID NO: 263700 - protein, 9 aa, Dengue virus
SVNMISRML

SEQ ID NO: 263701 - protein, 9 aa, Dengue virus
YAQMWTLMY

SEQ ID NO: 263702 - protein, 9 aa, Dengue virus
VTYGLNTFT

SEQ ID NO: 263703 - protein, 9 aa, Dengue virus
VLSIPPTAG

SEQ ID NO: 263704 - protein, 9 aa, Dengue virus
YRGAKRMAI

SEQ ID NO: 263705 - protein, 9 aa, Dengue virus
FKLTYQNKV

SEQ ID NO: 263706 - protein, 9 aa, Dengue virus
YSQVNPLTL

SEQ ID NO: 263707 - protein, 9 aa, Dengue virus
SLAAIANQA

SEQ ID NO: 263708 - protein, 9 aa, Dengue virus
LLMRTSWAF

SEQ ID NO: 263709 - protein, 9 aa, Dengue virus
YTALFGGVS

SEQ ID NO: 263710 - protein, 9 aa, Dengue virus
IKRGLRTLI

SEQ ID NO: 263711 - protein, 9 aa, Dengue virus
IENTTANIS

SEQ ID NO: 263712 - protein, 9 aa, Dengue virus
CYVITGRSA

SEQ ID NO: 263713 - protein, 9 aa, Dengue virus
LVHKQWFLN

SEQ ID NO: 263714 - protein, 9 aa, Dengue virus
CVKVLNPYM

SEQ ID NO: 263715 - protein, 9 aa, Dengue virus
LTAIANQAA

SEQ ID NO: 263716 - protein, 9 aa, Dengue virus
LLLMRTSWA

SEQ ID NO: 263717 - protein, 9 aa, Dengue virus
YRILQRGLL

SEQ ID NO: 263718 - protein, 9 aa, Dengue virus
LLAAYVMTG

SEQ ID NO: 263719 - protein, 9 aa, Dengue virus
NIVSSVNMI

SEQ ID NO: 263720 - protein, 9 aa, Dengue virus
VWFVPSIKA

SEQ ID NO: 263721 - protein, 9 aa, Dengue virus
VNTTSRLLI

SEQ ID NO: 263722 - protein, 9 aa, Dengue virus
TRKYLPAIV

SEQ ID NO: 263723 - protein, 9 aa, Dengue virus
FLAIPPTAG

SEQ ID NO: 263724 - protein, 9 aa, Dengue virus
IYRIKQKGI

SEQ ID NO: 263725 - protein, 9 aa, Dengue virus
LFGKGSLLT

SEQ ID NO: 263726 - protein, 9 aa, Dengue virus
FITFLRVLS

SEQ ID NO: 263727 - protein, 9 aa, Dengue virus
LIGLTSRAT

SEQ ID NO: 263728 - protein, 9 aa, Dengue virus
FQADSPKRL

SEQ ID NO: 263729 - protein, 9 aa, Dengue virus
MFEATARGA

SEQ ID NO: 263730 - protein, 9 aa, Dengue virus
YAVATTIIT

SEQ ID NO: 263731 - protein, 9 aa, Dengue virus
VWFVPSIKS

SEQ ID NO: 263732 - protein, 9 aa, Dengue virus
CVKILNPYM

SEQ ID NO: 263733 - protein, 9 aa, Dengue virus
LTLATGPVL

SEQ ID NO: 263734 - protein, 9 aa, Dengue virus
SVNTTSRLL

SEQ ID NO: 263735 - protein, 9 aa, Dengue virus
FHRRDLRLA

SEQ ID NO: 263736 - protein, 9 aa, Dengue virus
VMAFIAFLR

SEQ ID NO: 263737 - protein, 9 aa, Dengue virus
FSGQGPMKL

SEQ ID NO: 263738 - protein, 9 aa, Dengue virus
YGWNLVRLQ

SEQ ID NO: 263739 - protein, 9 aa, Dengue virus
TIAKSKPTL

SEQ ID NO: 263740 - protein, 9 aa, Dengue virus
WNTTIAVSM

SEQ ID NO: 263741 - protein, 9 aa, Dengue virus
IRYQTTAIK

SEQ ID NO: 263742 - protein, 9 aa, Dengue virus
IAVSTANIF

SEQ ID NO: 263743 - protein, 9 aa, Dengue virus
LIGLSSRAT

SEQ ID NO: 263744 - protein, 9 aa, Dengue virus
YAQMWALMY

SEQ ID NO: 263745 - protein, 9 aa, Dengue virus
ITLATGPLS

SEQ ID NO: 263746 - protein, 9 aa, Dengue virus
FTMRLLSPV

SEQ ID NO: 263747 - protein, 9 aa, Dengue virus
NISLTAIAN

SEQ ID NO: 263748 - protein, 9 aa, Dengue virus
MMRTTWALC

SEQ ID NO: 263749 - protein, 9 aa, Dengue virus
FTTNIWLKL

SEQ ID NO: 263750 - protein, 9 aa, Dengue virus
IRRGLRTLI

SEQ ID NO: 263751 - protein, 9 aa, Dengue virus
VNTTSRLLI

SEQ ID NO: 263752 - protein, 9 aa, Dengue virus
YMATLKNVR

SEQ ID NO: 263753 - protein, 9 aa, Dengue virus
TMRLLSPVR

SEQ ID NO: 263754 - protein, 9 aa, Dengue virus
TIAVSTANI

SEQ ID NO: 263755 - protein, 9 aa, Dengue virus
FLTIPPTAG

SEQ ID NO: 263756 - protein, 9 aa, Dengue virus
IFVVDNVHT

SEQ ID NO: 263757 - protein, 9 aa, Dengue virus
LLSSTRVPN

SEQ ID NO: 263758 - protein, 9 aa, Dengue virus
VVKLLTKPW

SEQ ID NO: 263759 - protein, 9 aa, Dengue virus
LFGKGSLVT

SEQ ID NO: 263760 - protein, 9 aa, Dengue virus
YMWLGARYL

SEQ ID NO: 263761 - protein, 9 aa, Dengue virus
LLMRTTWAF

SEQ ID NO: 263762 - protein, 9 aa, Dengue virus
VVSILASSF

SEQ ID NO: 263763 - protein, 9 aa, Dengue virus
RLMSAAIKD

SEQ ID NO: 263764 - protein, 9 aa, Dengue virus
SQILLMRTT

SEQ ID NO: 263765 - protein, 9 aa, Dengue virus
LTIMDLHPG

SEQ ID NO: 263766 - protein, 9 aa, Dengue virus
LRLAANAIC

SEQ ID NO: 263767 - protein, 9 aa, Dengue virus
VVRLLTKPW

SEQ ID NO: 263768 - protein, 9 aa, Dengue virus
LAAIANQAT

SEQ ID NO: 263769 - protein, 9 aa, Dengue virus
VLLMRTTWA

SEQ ID NO: 263770 - protein, 9 aa, Dengue virus
IYRIKQKGI

SEQ ID NO: 263771 - protein, 9 aa, Dengue virus
FKAERVIDP

SEQ ID NO: 263772 - protein, 9 aa, Dengue virus
TVLTPMLRH

SEQ ID NO: 263773 - protein, 9 aa, Dengue virus
MANIFRGSY

SEQ ID NO: 263774 - protein, 9 aa, Dengue virus
VMAFIAFLR

SEQ ID NO: 263775 - protein, 9 aa, Dengue virus
NIVSSVNTI

SEQ ID NO: 263776 - protein, 9 aa, Dengue virus
IRYQTPAIR

SEQ ID NO: 263777 - protein, 9 aa, Dengue virus
YAVATTIIT

SEQ ID NO: 263778 - protein, 9 aa, Dengue virus
CHATFTMRL

SEQ ID NO: 263779 - protein, 9 aa, Dengue virus
LVTFKNAHA

SEQ ID NO: 263780 - protein, 9 aa, Dengue virus
YFHRRDLRL

SEQ ID NO: 263781 - protein, 9 aa, Dengue virus
LKRVRNRVS

SEQ ID NO: 263782 - protein, 9 aa, Dengue virus
YRIKQQGIL

SEQ ID NO: 263783 - protein, 9 aa, Dengue virus
LNTFTNMEA

SEQ ID NO: 263784 - protein, 9 aa, Dengue virus
SVNMVSRML

SEQ ID NO: 263785 - protein, 9 aa, Dengue virus
YGWNIVKLH

SEQ ID NO: 263786 - protein, 9 aa, Dengue virus
VNMVSRMLL

SEQ ID NO: 263787 - protein, 9 aa, Dengue virus
WLVHKQWFL

SEQ ID NO: 263788 - protein, 9 aa, Dengue virus
VTRLENIMW

SEQ ID NO: 263789 - protein, 9 aa, Dengue virus
ITLATGPLS

SEQ ID NO: 263790 - protein, 9 aa, Dengue virus
VLTLATGPV

SEQ ID NO: 263791 - protein, 9 aa, Dengue virus
MRLLSPVRV

SEQ ID NO: 263792 - protein, 9 aa, Dengue virus
YVITGTSAD

SEQ ID NO: 263793 - protein, 9 aa, Dengue virus
YYCAGLKKV

SEQ ID NO: 263794 - protein, 9 aa, Dengue virus
LTIMDLHPG

SEQ ID NO: 263795 - protein, 9 aa, Dengue virus
FEKQLGQIM

SEQ ID NO: 263796 - protein, 9 aa, Dengue virus
LMRTSWALC

SEQ ID NO: 263797 - protein, 9 aa, Dengue virus
FGRAKGSRA

SEQ ID NO: 263798 - protein, 9 aa, Dengue virus
TIENTSANL

SEQ ID NO: 263799 - protein, 9 aa, Dengue virus
WLAYKVAAE

SEQ ID NO: 263800 - protein, 9 aa, Dengue virus
LAAIANQAT

SEQ ID NO: 263801 - protein, 9 aa, Dengue virus
IRYQTTAVK

SEQ ID NO: 263802 - protein, 9 aa, Dengue virus
VSILLSSLL

SEQ ID NO: 263803 - protein, 9 aa, Dengue virus
WKLARASFI

SEQ ID NO: 263804 - protein, 9 aa, Dengue virus
IVSSVNTIS

SEQ ID NO: 263805 - protein, 9 aa, Dengue virus
VVLMGLGKG

SEQ ID NO: 263806 - protein, 9 aa, Dengue virus
IFITNNVHT

SEQ ID NO: 263807 - protein, 9 aa, Dengue virus
LTPMLRHSI

SEQ ID NO: 263808 - protein, 9 aa, Dengue virus
MEVQLIRQM

SEQ ID NO: 263809 - protein, 9 aa, Dengue virus
IRYQTTAIK

SEQ ID NO: 263810 - protein, 9 aa, Dengue virus
VFHTMWHVT

SEQ ID NO: 263811 - protein, 9 aa, Dengue virus
VTPMLRHTI

SEQ ID NO: 263812 - protein, 9 aa, Dengue virus
TRLLSSTRV

SEQ ID NO: 263813 - protein, 9 aa, Dengue virus
LNGKGPLRM

SEQ ID NO: 263814 - protein, 9 aa, Dengue virus
MVTQLAMTD

SEQ ID NO: 263815 - protein, 9 aa, Dengue virus
YSLNTFTNM

SEQ ID NO: 263816 - protein, 9 aa, Dengue virus
FLRVLSIPP

SEQ ID NO: 263817 - protein, 9 aa, Dengue virus
ILLMRTTWA

SEQ ID NO: 263818 - protein, 9 aa, Dengue virus
FCEVLTLAT

SEQ ID NO: 263819 - protein, 9 aa, Dengue virus
VCGIRSVTR

SEQ ID NO: 263820 - protein, 9 aa, Dengue virus
VVKLLTKPW

SEQ ID NO: 263821 - protein, 9 aa, Dengue virus
WKLARASFI

SEQ ID NO: 263822 - protein, 9 aa, Dengue virus
IKKVRTNAA

SEQ ID NO: 263823 - protein, 9 aa, Dengue virus
FQPESPARV

SEQ ID NO: 263824 - protein, 9 aa, Dengue virus
YRIKQRGIL

SEQ ID NO: 263825 - protein, 9 aa, Dengue virus
WSIHAHHQW

SEQ ID NO: 263826 - protein, 9 aa, Dengue virus
FCKKVRSNA

SEQ ID NO: 263827 - protein, 9 aa, Dengue virus
ATTIITPML

SEQ ID NO: 263828 - protein, 9 aa, Dengue virus
LSSTRVPNY

SEQ ID NO: 263829 - protein, 9 aa, Dengue virus
PLRMVLAFI

SEQ ID NO: 263830 - protein, 9 aa, Dengue virus
VSTVQQLTK

SEQ ID NO: 263831 - protein, 9 aa, Dengue virus
LIGLTSRAT

SEQ ID NO: 263832 - protein, 9 aa, Dengue virus
VNTISKMLL

SEQ ID NO: 263833 - protein, 9 aa, Dengue virus
LTPMLRHSI

SEQ ID NO: 263834 - protein, 9 aa, Dengue virus
VNMTSRMLL

SEQ ID NO: 263835 - protein, 9 aa, Dengue virus
YVLSGSSAD

SEQ ID NO: 263836 - protein, 9 aa, Dengue virus
YYCAGLKKV

SEQ ID NO: 263837 - protein, 9 aa, Dengue virus
YAQMWQLMY

SEQ ID NO: 263838 - protein, 9 aa, Dengue virus
LTIMDLHPG

SEQ ID NO: 263839 - protein, 9 aa, Dengue virus
WSIHATHQW

SEQ ID NO: 263840 - protein, 9 aa, Dengue virus
TWSIHAKHQ

SEQ ID NO: 263841 - protein, 9 aa, Dengue virus
IYRIKQKGI

SEQ ID NO: 263842 - protein, 9 aa, Dengue virus
FCEVLTLAT

SEQ ID NO: 263843 - protein, 9 aa, Dengue virus
IRYQTPAVK

SEQ ID NO: 263844 - protein, 9 aa, Dengue virus
FLRFLTIPP

SEQ ID NO: 263845 - protein, 9 aa, Dengue virus
LTIMDLHPG

SEQ ID NO: 263846 - protein, 9 aa, Dengue virus
IANQAAVLM

SEQ ID NO: 263847 - protein, 9 aa, Dengue virus
VCGIRSVTR

SEQ ID NO: 263848 - protein, 9 aa, Dengue virus
YKFQPESPA

SEQ ID NO: 263849 - protein, 9 aa, Dengue virus
YSQVNPTTL

SEQ ID NO: 263850 - protein, 9 aa, Dengue virus
IKRKLRTLV

SEQ ID NO: 263851 - protein, 9 aa, Dengue virus
LTIMDLHPG

SEQ ID NO: 263852 - protein, 9 aa, Dengue virus
TIENTTANI

SEQ ID NO: 263853 - protein, 9 aa, Dengue virus
WALMYFHRR

SEQ ID NO: 263854 - protein, 9 aa, Dengue virus
TIENTSANL

SEQ ID NO: 263855 - protein, 9 aa, Dengue virus
VNTTSRLLL

SEQ ID NO: 263856 - protein, 9 aa, Dengue virus
WQLMYFHRR

SEQ ID NO: 263857 - protein, 9 aa, Dengue virus
CVTTIAKSK

SEQ ID NO: 263858 - protein, 9 aa, Dengue virus
IVSAVNMTS

SEQ ID NO: 263859 - protein, 9 aa, Dengue virus
FLRVLSIPP

SEQ ID NO: 263860 - protein, 9 aa, Dengue virus
MVTFKVPHA

SEQ ID NO: 263861 - protein, 9 aa, Dengue virus
YEVKATGSA

SEQ ID NO: 263862 - protein, 9 aa, Dengue virus
ILLMRTSWA

SEQ ID NO: 263863 - protein, 9 aa, Dengue virus
WNTTIAVST

SEQ ID NO: 263864 - protein, 9 aa, Dengue virus
YRIKQRGIL

SEQ ID NO: 263865 - protein, 9 aa, Dengue virus
YAQMWALMY

SEQ ID NO: 263866 - protein, 9 aa, Dengue virus
KRFSKGLFS

SEQ ID NO: 263867 - protein, 9 aa, Dengue virus
FTNMEAQLI

SEQ ID NO: 263868 - protein, 9 aa, Dengue virus
VNVSLTAIA

SEQ ID NO: 263869 - protein, 9 aa, Dengue virus
LKRRLRTLI

SEQ ID NO: 263870 - protein, 9 aa, Dengue virus
TLILAPTRV

SEQ ID NO: 263871 - protein, 9 aa, Dengue virus
LLRNDVPMA

SEQ ID NO: 263872 - protein, 9 aa, Dengue virus
NISLAAIAN

SEQ ID NO: 263873 - protein, 9 aa, Dengue virus
LRTLILAPT

SEQ ID NO: 263874 - protein, 9 aa, Dengue virus
CYVITGRSA

SEQ ID NO: 263875 - protein, 9 aa, Dengue virus
IENTSANLS

SEQ ID NO: 263876 - protein, 9 aa, Dengue virus
IANQAAILM

SEQ ID NO: 263877 - protein, 9 aa, Dengue virus
YGVLFSGVS

SEQ ID NO: 263878 - protein, 9 aa, Dengue virus
LAAIANQAV

SEQ ID NO: 263879 - protein, 9 aa, Dengue virus
FHTMWHVTR

SEQ ID NO: 263880 - protein, 9 aa, Dengue virus
FQADSPKRL

SEQ ID NO: 263881 - protein, 9 aa, Dengue virus
VVKLLTKPW

SEQ ID NO: 263882 - protein, 9 aa, Dengue virus
WIQDNPNMI

SEQ ID NO: 263883 - protein, 9 aa, Dengue virus
VKATGSASS

SEQ ID NO: 263884 - protein, 9 aa, Dengue virus
LVTFKNPHA

SEQ ID NO: 263885 - protein, 9 aa, Dengue virus
LRTLILAPT

SEQ ID NO: 263886 - protein, 9 aa, Dengue virus
FLTIPPTAG

SEQ ID NO: 263887 - protein, 9 aa, Dengue virus
YYMATLKNV

SEQ ID NO: 263888 - protein, 9 aa, Dengue virus
IRYQTPAIR

SEQ ID NO: 263889 - protein, 9 aa, Dengue virus
VSILLSSLL

SEQ ID NO: 263890 - protein, 9 aa, Dengue virus
FGRAKGSRA

SEQ ID NO: 263891 - protein, 9 aa, Dengue virus
FQADSPSKL

SEQ ID NO: 263892 - protein, 9 aa, Dengue virus
YKFQPESPK

SEQ ID NO: 263893 - protein, 9 aa, Dengue virus
IKKVRTNAA

SEQ ID NO: 263894 - protein, 9 aa, Dengue virus
VSRMLLNRF

SEQ ID NO: 263895 - protein, 9 aa, Dengue virus
FTNMEVQLI

SEQ ID NO: 263896 - protein, 9 aa, Dengue virus
KRFSKGLFS

SEQ ID NO: 263897 - protein, 9 aa, Dengue virus
YTALFGGVS

SEQ ID NO: 263898 - protein, 9 aa, Dengue virus
VSQLAKRFS

SEQ ID NO: 263899 - protein, 9 aa, Dengue virus
VSILLSSLL

SEQ ID NO: 263900 - protein, 9 aa, Dengue virus
WDVVPTVTQ

SEQ ID NO: 263901 - protein, 9 aa, Dengue virus
WAFCESLTL

SEQ ID NO: 263902 - protein, 9 aa, Dengue virus
QLIMKDGRV

SEQ ID NO: 263903 - protein, 9 aa, Dengue virus
FKLTYQNKV

SEQ ID NO: 263904 - protein, 9 aa, Dengue virus
FCEVLTLAT

SEQ ID NO: 263905 - protein, 9 aa, Dengue virus
LNTFTNMEA

SEQ ID NO: 263906 - protein, 9 aa, Dengue virus
VRTNAAIGA

SEQ ID NO: 263907 - protein, 9 aa, Dengue virus
VRSNAALGA

SEQ ID NO: 263908 - protein, 9 aa, Dengue virus
FTTNIWLRL

SEQ ID NO: 263909 - protein, 9 aa, Dengue virus
VRSNAALGA

SEQ ID NO: 263910 - protein, 9 aa, Dengue virus
LLMMRTTWA

SEQ ID NO: 263911 - protein, 9 aa, Dengue virus
YAQMWQLMY

SEQ ID NO: 263912 - protein, 9 aa, Dengue virus
ISRMLLNRF

SEQ ID NO: 263913 - protein, 9 aa, Dengue virus
LVAFLRFLA

SEQ ID NO: 263914 - protein, 9 aa, Dengue virus
VVRLLTKPW

SEQ ID NO: 263915 - protein, 9 aa, Dengue virus
SVNMISRML

SEQ ID NO: 263916 - protein, 9 aa, Dengue virus
VRSNAAIGA

SEQ ID NO: 263917 - protein, 9 aa, Dengue virus
FEKQLGQIM

SEQ ID NO: 263918 - protein, 9 aa, Dengue virus
TKRYLPAIV

SEQ ID NO: 263919 - protein, 9 aa, Dengue virus
YAVATTFIT

SEQ ID NO: 263920 - protein, 9 aa, Dengue virus
YRIKQQGIL

SEQ ID NO: 263921 - protein, 9 aa, Dengue virus
YRGAKRMAI

SEQ ID NO: 263922 - protein, 9 aa, Dengue virus
YSQVNPLTL

SEQ ID NO: 263923 - protein, 9 aa, Dengue virus
LTLATGPVS

SEQ ID NO: 263924 - protein, 9 aa, Dengue virus
ISRMLLNRF

SEQ ID NO: 263925 - protein, 9 aa, Dengue virus
LRTLILAPT

SEQ ID NO: 263926 - protein, 9 aa, Dengue virus
LTLATGPIT

SEQ ID NO: 263927 - protein, 9 aa, Dengue virus
QLIMKDGRV

SEQ ID NO: 263928 - protein, 9 aa, Dengue virus
TKRYLPAIV

SEQ ID NO: 263929 - protein, 9 aa, Dengue virus
LRLAANAIC

SEQ ID NO: 263930 - protein, 9 aa, Dengue virus
YTALFGGVS

SEQ ID NO: 263931 - protein, 9 aa, Dengue virus
FLRFLAIPP

SEQ ID NO: 263932 - protein, 9 aa, Dengue virus
LLMRTSWAF

SEQ ID NO: 263933 - protein, 9 aa, Dengue virus
WSIHAHHQW

SEQ ID NO: 263934 - protein, 9 aa, Dengue virus
TRLLSSTRV

SEQ ID NO: 263935 - protein, 9 aa, Dengue virus
LVSLLGSSL

SEQ ID NO: 263936 - protein, 9 aa, Dengue virus
LSGRGPLKL

SEQ ID NO: 263937 - protein, 9 aa, Dengue virus
VNTTSRLLL

SEQ ID NO: 263938 - protein, 9 aa, Dengue virus
LIGLTSRAT

SEQ ID NO: 263939 - protein, 9 aa, Dengue virus
WLVHRQWFL

SEQ ID NO: 263940 - protein, 9 aa, Dengue virus
YAVATTVLT

SEQ ID NO: 263941 - protein, 9 aa, Dengue virus
YKFQADSPK

SEQ ID NO: 263942 - protein, 9 aa, Dengue virus
FCSHHFHKI

SEQ ID NO: 263943 - protein, 9 aa, Dengue virus
LSGRGPLKL

SEQ ID NO: 263944 - protein, 9 aa, Dengue virus
KRFSLGLLS

SEQ ID NO: 263945 - protein, 9 aa, Dengue virus
WLSYKVASA

SEQ ID NO: 263946 - protein, 9 aa, Dengue virus
INKVRSNAA

SEQ ID NO: 263947 - protein, 9 aa, Dengue virus
SVNMISRML

SEQ ID NO: 263948 - protein, 9 aa, Dengue virus
LKRVRNRVS

SEQ ID NO: 263949 - protein, 9 aa, Dengue virus
IYRIKQKGI

SEQ ID NO: 263950 - protein, 9 aa, Dengue virus
YWVSGVSGN

SEQ ID NO: 263951 - protein, 9 aa, Dengue virus
VCGIRSATR

SEQ ID NO: 263952 - protein, 9 aa, Dengue virus
SLRTTTASG

SEQ ID NO: 263953 - protein, 9 aa, Dengue virus
FMALVAFLR

SEQ ID NO: 263954 - protein, 9 aa, Dengue virus
NLVRLQSGV

SEQ ID NO: 263955 - protein, 9 aa, Dengue virus
TTTVSGKLI

SEQ ID NO: 263956 - protein, 9 aa, Dengue virus
LIGLSSRAT

SEQ ID NO: 263957 - protein, 9 aa, Dengue virus
YKFQPESPA

SEQ ID NO: 263958 - protein, 9 aa, Dengue virus
VVKLLTKPW

SEQ ID NO: 263959 - protein, 9 aa, Dengue virus
VSQLAKRFS

SEQ ID NO: 263960 - protein, 9 aa, Dengue virus
VSILASALL

SEQ ID NO: 263961 - protein, 9 aa, Dengue virus
LQWIASAIV

SEQ ID NO: 263962 - protein, 9 aa, Dengue virus
WFSRGNSLS

SEQ ID NO: 263963 - protein, 9 aa, Dengue virus
YVITGTSAD

SEQ ID NO: 263964 - protein, 9 aa, Dengue virus
IRYQTPAIR

SEQ ID NO: 263965 - protein, 9 aa, Dengue virus
SLTAIANQA

SEQ ID NO: 263966 - protein, 9 aa, Dengue virus
VLTLATGPI

SEQ ID NO: 263967 - protein, 9 aa, Dengue virus
VMAFIAFLR

SEQ ID NO: 263968 - protein, 9 aa, Dengue virus
LLLMRTSWA

SEQ ID NO: 263969 - protein, 9 aa, Dengue virus
IFVIDNVHT

SEQ ID NO: 263970 - protein, 9 aa, Dengue virus
IVSILASSL

SEQ ID NO: 263971 - protein, 9 aa, Dengue virus
SQILLMRTT

SEQ ID NO: 263972 - protein, 9 aa, Dengue virus
MWHVTRGSV

SEQ ID NO: 263973 - protein, 9 aa, Dengue virus
WQLMYFHRR

SEQ ID NO: 263974 - protein, 9 aa, Dengue virus
YWVSGVSGN

SEQ ID NO: 263975 - protein, 9 aa, Dengue virus
KRFSLGLLS

SEQ ID NO: 263976 - protein, 9 aa, Dengue virus
LRKSGKRVI

SEQ ID NO: 263977 - protein, 9 aa, Dengue virus
RYQTTATKT

SEQ ID NO: 263978 - protein, 9 aa, Dengue virus
YVMTGRSAD

SEQ ID NO: 263979 - protein, 9 aa, Dengue virus
YRGAKRMAI

SEQ ID NO: 263980 - protein, 9 aa, Dengue virus
FQADSPKKL

SEQ ID NO: 263981 - protein, 9 aa, Dengue virus
CVTTMAKNK

SEQ ID NO: 263982 - protein, 9 aa, Dengue virus
MINGVVRLL

SEQ ID NO: 263983 - protein, 9 aa, Dengue virus
YAQMWTLMY

SEQ ID NO: 263984 - protein, 9 aa, Dengue virus
IKRKLRTLV

SEQ ID NO: 263985 - protein, 9 aa, Dengue virus
YKFQPESPA

SEQ ID NO: 263986 - protein, 9 aa, Dengue virus
FCESLTLAT

SEQ ID NO: 263987 - protein, 9 aa, Dengue virus
FQADSPKKL

SEQ ID NO: 263988 - protein, 9 aa, Dengue virus
HHFHQLIMK

SEQ ID NO: 263989 - protein, 9 aa, Dengue virus
VCGIRSVTR

SEQ ID NO: 263990 - protein, 9 aa, Dengue virus
CVTTMAKNK

SEQ ID NO: 263991 - protein, 9 aa, Dengue virus
MRLLSPVRV

SEQ ID NO: 263992 - protein, 9 aa, Dengue virus
LLMMRTTWA

SEQ ID NO: 263993 - protein, 9 aa, Dengue virus
LIGLTSRAT

SEQ ID NO: 263994 - protein, 9 aa, Dengue virus
TMRGAKRMA

SEQ ID NO: 263995 - protein, 9 aa, Dengue virus
AVSMANIFR

SEQ ID NO: 263996 - protein, 9 aa, Dengue virus
YFHRRDLRL

SEQ ID NO: 263997 - protein, 9 aa, Dengue virus
LAAIANQAA

SEQ ID NO: 263998 - protein, 9 aa, Dengue virus
IHMENVFHT

SEQ ID NO: 263999 - protein, 9 aa, Dengue virus
WALCESITL

SEQ ID NO: 264000 - protein, 9 aa, Dengue virus
YAVATTVLT

SEQ ID NO: 264001 - protein, 9 aa, Dengue virus
YSQVNPTTL

SEQ ID NO: 264002 - protein, 9 aa, Dengue virus
YSQVNPLTL

SEQ ID NO: 264003 - protein, 9 aa, Dengue virus
SQILLMRTS

SEQ ID NO: 264004 - protein, 9 aa, Dengue virus
FLRFLAIPP

SEQ ID NO: 264005 - protein, 9 aa, Dengue virus
YAVATTIIT

SEQ ID NO: 264006 - protein, 9 aa, Dengue virus
MMRTTWALC

SEQ ID NO: 264007 - protein, 9 aa, Dengue virus
MGLGKGWPL

SEQ ID NO: 264008 - protein, 9 aa, Dengue virus
LTAIANQAV

SEQ ID NO: 264009 - protein, 9 aa, Dengue virus
IRWIVERGM

SEQ ID NO: 264010 - protein, 9 aa, Dengue virus
NLSLTAIAN

SEQ ID NO: 264011 - protein, 9 aa, Dengue virus
YMWLGARYL

SEQ ID NO: 264012 - protein, 9 aa, Dengue virus
YMWLGARYL

SEQ ID NO: 264013 - protein, 9 aa, Dengue virus
FLRFLAIPP

SEQ ID NO: 264014 - protein, 9 aa, Dengue virus
LRTLVLAPT

SEQ ID NO: 264015 - protein, 9 aa, Dengue virus
FTNMEAQLI

SEQ ID NO: 264016 - protein, 9 aa, Dengue virus
VKRFSTGLL

SEQ ID NO: 264017 - protein, 9 aa, Dengue virus
IRYQTTAVK

SEQ ID NO: 264018 - protein, 9 aa, Dengue virus
TANIFRGSY

SEQ ID NO: 264019 - protein, 9 aa, Dengue virus
FQADSPKRL

SEQ ID NO: 264020 - protein, 9 aa, Dengue virus
TMRLLSPVR

SEQ ID NO: 264021 - protein, 9 aa, Dengue virus
MRGAKRMAI

SEQ ID NO: 264022 - protein, 9 aa, Dengue virus
LRLAANAIC

SEQ ID NO: 264023 - protein, 9 aa, Dengue virus
VRSNAAIGA

SEQ ID NO: 264024 - protein, 9 aa, Dengue virus
LRLASNAIC

SEQ ID NO: 264025 - protein, 9 aa, Dengue virus
MFEATARGA

SEQ ID NO: 264026 - protein, 9 aa, Dengue virus
LRKSGKKVI

SEQ ID NO: 264027 - protein, 9 aa, Dengue virus
YRGAKRMAI

SEQ ID NO: 264028 - protein, 9 aa, Dengue virus
LLLMRTSWA

SEQ ID NO: 264029 - protein, 9 aa, Dengue virus
FTNMEVQLI

SEQ ID NO: 264030 - protein, 9 aa, Dengue virus
YAQMWTLMY

SEQ ID NO: 264031 - protein, 9 aa, Dengue virus
CYVITGRSA

SEQ ID NO: 264032 - protein, 9 aa, Dengue virus
YFHRRDLRL

SEQ ID NO: 264033 - protein, 9 aa, Dengue virus
FCEALTLAT

SEQ ID NO: 264034 - protein, 9 aa, Dengue virus
IKRGLRTLI

SEQ ID NO: 264035 - protein, 9 aa, Dengue virus
VVKVLRPTP

SEQ ID NO: 264036 - protein, 9 aa, Dengue virus
YQFQPESPA

SEQ ID NO: 264037 - protein, 9 aa, Dengue virus
MLQGQGPMK

SEQ ID NO: 264038 - protein, 9 aa, Dengue virus
YISTRVEMG

SEQ ID NO: 264039 - protein, 9 aa, Dengue virus
IFVVDNVHT

SEQ ID NO: 264040 - protein, 9 aa, Dengue virus
TTTVSGKLI

SEQ ID NO: 264041 - protein, 9 aa, Dengue virus
WSLMYFHRR

SEQ ID NO: 264042 - protein, 9 aa, Dengue virus
IRYQTPAIR

SEQ ID NO: 264043 - protein, 9 aa, Dengue virus
WNTTIAVSM

SEQ ID NO: 264044 - protein, 9 aa, Dengue virus
WNTTIAVSM

SEQ ID NO: 264045 - protein, 9 aa, Dengue virus
YGWNIVKLM

SEQ ID NO: 264046 - protein, 9 aa, Dengue virus
WNTTIAVST

SEQ ID NO: 264047 - protein, 9 aa, Dengue virus
SRTIRVLKM

SEQ ID NO: 264048 - protein, 9 aa, Dengue virus
NLSLAAIAN

SEQ ID NO: 264049 - protein, 9 aa, Dengue virus
VCGIRSATR

SEQ ID NO: 264050 - protein, 9 aa, Dengue virus
FMALVAFLR

SEQ ID NO: 264051 - protein, 9 aa, Dengue virus
VEAGRTLRV

SEQ ID NO: 264052 - protein, 9 aa, Dengue virus
IRRGLRTLI

SEQ ID NO: 264053 - protein, 9 aa, Dengue virus
IVSILASSL

SEQ ID NO: 264054 - protein, 9 aa, Dengue virus
IVSILASSL

SEQ ID NO: 264055 - protein, 9 aa, Dengue virus
MRLLSPVRV

SEQ ID NO: 264056 - protein, 9 aa, Dengue virus
DLRLASMAI

SEQ ID NO: 264057 - protein, 9 aa, Dengue virus
NIVSSVNMI

SEQ ID NO: 264058 - protein, 9 aa, Dengue virus
IKRGLRTLI

SEQ ID NO: 264059 - protein, 9 aa, Dengue virus
IRSTTRLEN

SEQ ID NO: 264060 - protein, 9 aa, Dengue virus
LMRTTWAFC

SEQ ID NO: 264061 - protein, 9 aa, Dengue virus
IVSSVNMVS

SEQ ID NO: 264062 - protein, 9 aa, Dengue virus
LIGLTSRAT

SEQ ID NO: 264063 - protein, 9 aa, Dengue virus
LVTFKNPHA

SEQ ID NO: 264064 - protein, 9 aa, Dengue virus
IVSAVNMTS

SEQ ID NO: 264065 - protein, 9 aa, Dengue virus
YGWNLVRLQ

SEQ ID NO: 264066 - protein, 9 aa, Dengue virus
FCEVLTLAT

SEQ ID NO: 264067 - protein, 9 aa, Dengue virus
YSQVNPLTL

SEQ ID NO: 264068 - protein, 9 aa, Dengue virus
YRGAKRMAI

SEQ ID NO: 264069 - protein, 9 aa, Dengue virus
WNLVKLHSG

SEQ ID NO: 264070 - protein, 9 aa, Dengue virus
YYMATLKNV

SEQ ID NO: 264071 - protein, 9 aa, Dengue virus
CIKVLNPYM

SEQ ID NO: 264072 - protein, 9 aa, Dengue virus
MGLGKGWPL

SEQ ID NO: 264073 - protein, 9 aa, Dengue virus
WAFCESLTL

SEQ ID NO: 264074 - protein, 9 aa, Dengue virus
WHVTRGSVI

SEQ ID NO: 264075 - protein, 9 aa, Dengue virus
FLRVLSIPP

SEQ ID NO: 264076 - protein, 9 aa, Dengue virus
MGLGKGWPL

SEQ ID NO: 264077 - protein, 9 aa, Dengue virus
FHTMWHVTR

SEQ ID NO: 264078 - protein, 9 aa, Dengue virus
FLNDMGKVR

SEQ ID NO: 264079 - protein, 9 aa, Dengue virus
LTAIANQAA

SEQ ID NO: 264080 - protein, 9 aa, Dengue virus
VSLAAIANQ

SEQ ID NO: 264081 - protein, 9 aa, Dengue virus
WVSNASGNI

SEQ ID NO: 264082 - protein, 9 aa, Dengue virus
VKRFSTGLL

SEQ ID NO: 264083 - protein, 9 aa, Dengue virus
LRKSGKRVI

SEQ ID NO: 264084 - protein, 9 aa, Dengue virus
YMWLGARFL

SEQ ID NO: 264085 - protein, 9 aa, Dengue virus
YGWNLVKLH

SEQ ID NO: 264086 - protein, 9 aa, Dengue virus
TKRILPSIV

SEQ ID NO: 264087 - protein, 9 aa, Dengue virus
SRTIRVLKM

SEQ ID NO: 264088 - protein, 9 aa, Dengue virus
IENTTANIS

SEQ ID NO: 264089 - protein, 9 aa, Dengue virus
FQPESPKRL

SEQ ID NO: 264090 - protein, 9 aa, Dengue virus
FCKKVRSNA

SEQ ID NO: 264091 - protein, 9 aa, Dengue virus
WCNATSAWV

SEQ ID NO: 264092 - protein, 9 aa, Dengue virus
WMTTEDMLS

SEQ ID NO: 264093 - protein, 9 aa, Dengue virus
YAVSRGTSK

SEQ ID NO: 264094 - protein, 9 aa, Dengue virus
IFMTATPPG

SEQ ID NO: 264095 - protein, 9 aa, Dengue virus
YKFQADSPS

SEQ ID NO: 264096 - protein, 9 aa, Dengue virus
FGKGSLITC

SEQ ID NO: 264097 - protein, 9 aa, Dengue virus
YLPAIVREA

SEQ ID NO: 264098 - protein, 9 aa, Dengue virus
TFITPMLRH

SEQ ID NO: 264099 - protein, 9 aa, Dengue virus
VSILLSSLL

SEQ ID NO: 264100 - protein, 9 aa, Dengue virus
VITGRSADL

SEQ ID NO: 264101 - protein, 9 aa, Dengue virus
YVITGRSAD

SEQ ID NO: 264102 - protein, 9 aa, Dengue virus
WNIVKLHSG

SEQ ID NO: 264103 - protein, 9 aa, Dengue virus
FSGVSWIMK

SEQ ID NO: 264104 - protein, 9 aa, Dengue virus
ITLATGPLS

SEQ ID NO: 264105 - protein, 9 aa, Dengue virus
IRYQTTAVK

SEQ ID NO: 264106 - protein, 9 aa, Dengue virus
YAQMWALMY

SEQ ID NO: 264107 - protein, 9 aa, Dengue virus
MGLGKGWPL

SEQ ID NO: 264108 - protein, 9 aa, Dengue virus
MMRTTWALC

SEQ ID NO: 264109 - protein, 9 aa, Dengue virus
VSLAAIANQ

SEQ ID NO: 264110 - protein, 9 aa, Dengue virus
VTPMLRHTI

SEQ ID NO: 264111 - protein, 9 aa, Dengue virus
TKRILPSIV

SEQ ID NO: 264112 - protein, 9 aa, Dengue virus
IFRGSYLAG

SEQ ID NO: 264113 - protein, 9 aa, Dengue virus
IFITDNVHT

SEQ ID NO: 264114 - protein, 9 aa, Dengue virus
YAQMWTLMY

SEQ ID NO: 264115 - protein, 9 aa, Dengue virus
FLRFLTIPP

SEQ ID NO: 264116 - protein, 9 aa, Dengue virus
VITLATGPL

SEQ ID NO: 264117 - protein, 9 aa, Dengue virus
FQADSPKRL

SEQ ID NO: 264118 - protein, 9 aa, Dengue virus
IRYQTPAIR

SEQ ID NO: 264119 - protein, 9 aa, Dengue virus
YFHRRDLRL

SEQ ID NO: 264120 - protein, 9 aa, Dengue virus
LKGLPIRYQ

SEQ ID NO: 264121 - protein, 9 aa, Dengue virus
YAVATTIVT

SEQ ID NO: 264122 - protein, 9 aa, Dengue virus
LVKLMSGKD

SEQ ID NO: 264123 - protein, 9 aa, Dengue virus
LVTFKTAHA

SEQ ID NO: 264124 - protein, 9 aa, Dengue virus
NIVSSVNMI

SEQ ID NO: 264125 - protein, 9 aa, Dengue virus
YRIKQQGIL

SEQ ID NO: 264126 - protein, 9 aa, Dengue virus
MVTFKVPHA

SEQ ID NO: 264127 - protein, 9 aa, Dengue virus
WNTTIAVSM

SEQ ID NO: 264128 - protein, 9 aa, Dengue virus
LVTFKNPHA

SEQ ID NO: 264129 - protein, 9 aa, Dengue virus
WNTTIAVSM

SEQ ID NO: 264130 - protein, 9 aa, Dengue virus
WHVTRGAVL

SEQ ID NO: 264131 - protein, 9 aa, Dengue virus
SVNTISKML

SEQ ID NO: 264132 - protein, 9 aa, Dengue virus
FKLTYQNKV

SEQ ID NO: 264133 - protein, 9 aa, Dengue virus
IAKSKPTLD

SEQ ID NO: 264134 - protein, 9 aa, Dengue virus
VSQLAKRFS

SEQ ID NO: 264135 - protein, 9 aa, Dengue virus
YGAAFSGVS

SEQ ID NO: 264136 - protein, 9 aa, Dengue virus
VRSNAAIGA

SEQ ID NO: 264137 - protein, 9 aa, Dengue virus
YLPAIVREA

SEQ ID NO: 264138 - protein, 9 aa, Dengue virus
FGKGSLVTC

SEQ ID NO: 264139 - protein, 9 aa, Dengue virus
IFMTATPPG

SEQ ID NO: 264140 - protein, 9 aa, Dengue virus
SVNMISRML

SEQ ID NO: 264141 - protein, 9 aa, Dengue virus
MINGVVRLL

SEQ ID NO: 264142 - protein, 9 aa, Dengue virus
VEAGRTLRV

SEQ ID NO: 264143 - protein, 9 aa, Dengue virus
LIGLTARAT

SEQ ID NO: 264144 - protein, 9 aa, Dengue virus
IREAIKRKL

SEQ ID NO: 264145 - protein, 9 aa, Dengue virus
LVSLLGSSL

SEQ ID NO: 264146 - protein, 9 aa, Dengue virus
YKFQPESPA

SEQ ID NO: 264147 - protein, 9 aa, Dengue virus
LSSLLKNDV

SEQ ID NO: 264148 - protein, 9 aa, Dengue virus
ITLATGPLS

SEQ ID NO: 264149 - protein, 9 aa, Dengue virus
WSIHATHQW

SEQ ID NO: 264150 - protein, 9 aa, Dengue virus
IRYQTPAIR

SEQ ID NO: 264151 - protein, 9 aa, Dengue virus
TRKYLPAII

SEQ ID NO: 264152 - protein, 9 aa, Dengue virus
YKFQADSPK

SEQ ID NO: 264153 - protein, 9 aa, Dengue virus
IVSILASSL

SEQ ID NO: 264154 - protein, 9 aa, Dengue virus
VITLATGPL

SEQ ID NO: 264155 - protein, 9 aa, Dengue virus
IRYQTTAVK

SEQ ID NO: 264156 - protein, 9 aa, Dengue virus
VKRFSTGLL

SEQ ID NO: 264157 - protein, 9 aa, Dengue virus
YMWLGARYL

SEQ ID NO: 264158 - protein, 9 aa, Dengue virus
IVSAVNMTS

SEQ ID NO: 264159 - protein, 9 aa, Dengue virus
IRYQTTAVK

SEQ ID NO: 264160 - protein, 9 aa, Dengue virus
FLAIPPTAG

SEQ ID NO: 264161 - protein, 9 aa, Dengue virus
YGWNLVRLQ

SEQ ID NO: 264162 - protein, 9 aa, Dengue virus
ISRMLINRF

SEQ ID NO: 264163 - protein, 9 aa, Dengue virus
AVSRGSAKL

SEQ ID NO: 264164 - protein, 9 aa, Dengue virus
LFGKGSLLT

SEQ ID NO: 264165 - protein, 9 aa, Dengue virus
FKTAHAKKQ

SEQ ID NO: 264166 - protein, 9 aa, Dengue virus
YISTRVEMG

SEQ ID NO: 264167 - protein, 9 aa, Dengue virus
WKLARASFI

SEQ ID NO: 264168 - protein, 9 aa, Dengue virus
TRLLSSTRV

SEQ ID NO: 264169 - protein, 9 aa, Dengue virus
WISNGTGNI

SEQ ID NO: 264170 - protein, 9 aa, Dengue virus
IAKNKPTLD

SEQ ID NO: 264171 - protein, 9 aa, Dengue virus
FQADSPKRL

SEQ ID NO: 264172 - protein, 9 aa, Dengue virus
ISKMLLNRF

SEQ ID NO: 264173 - protein, 9 aa, Dengue virus
MGLGKGWPI

SEQ ID NO: 264174 - protein, 9 aa, Dengue virus
CVKILNPYM

SEQ ID NO: 264175 - protein, 9 aa, Dengue virus
VQQLTKRFS

SEQ ID NO: 264176 - protein, 9 aa, Dengue virus
LRLASNAIC

SEQ ID NO: 264177 - protein, 9 aa, Dengue virus
YRIKQQGIL

SEQ ID NO: 264178 - protein, 9 aa, Dengue virus
TIITPMLRH

SEQ ID NO: 264179 - protein, 9 aa, Dengue virus
FLRFLAIPP

SEQ ID NO: 264180 - protein, 9 aa, Dengue virus
WHVTRGAVL

SEQ ID NO: 264181 - protein, 9 aa, Dengue virus
KMFETTMRG

SEQ ID NO: 264182 - protein, 9 aa, Dengue virus
IFVVDNVHT

SEQ ID NO: 264183 - protein, 9 aa, Dengue virus
YQFQPESPA

SEQ ID NO: 264184 - protein, 9 aa, Dengue virus
VSLAAIANQ

SEQ ID NO: 264185 - protein, 9 aa, Dengue virus
FLAIPPTAG

SEQ ID NO: 264186 - protein, 9 aa, Dengue virus
IRYQTTATK

SEQ ID NO: 264187 - protein, 9 aa, Dengue virus
IFITNNVHT

SEQ ID NO: 264188 - protein, 9 aa, Dengue virus
LAMTDTTPF

SEQ ID NO: 264189 - protein, 9 aa, Dengue virus
YAVATTFIT

SEQ ID NO: 264190 - protein, 9 aa, Dengue virus
WNIVKLHSG

SEQ ID NO: 264191 - protein, 9 aa, Dengue virus
TILLKATLL

SEQ ID NO: 264192 - protein, 9 aa, Dengue virus
TVLTPMLRH

SEQ ID NO: 264193 - protein, 9 aa, Dengue virus
LRTLILAPT

SEQ ID NO: 264194 - protein, 9 aa, Dengue virus
LLMRTTWAF

SEQ ID NO: 264195 - protein, 9 aa, Dengue virus
FHQLIMKDG

SEQ ID NO: 264196 - protein, 9 aa, Dengue virus
YAQMWSLMY

SEQ ID NO: 264197 - protein, 9 aa, Dengue virus
LHRLGYILR

SEQ ID NO: 264198 - protein, 9 aa, Dengue virus
MWHVTRGAV

SEQ ID NO: 264199 - protein, 9 aa, Dengue virus
FTNMEVQLI

SEQ ID NO: 264200 - protein, 9 aa, Dengue virus
VKATGSASS

SEQ ID NO: 264201 - protein, 9 aa, Dengue virus
LIGLSSRAT

SEQ ID NO: 264202 - protein, 9 aa, Dengue virus
LLMRTSWAL

SEQ ID NO: 264203 - protein, 9 aa, Dengue virus
YISTRVEMG

SEQ ID NO: 264204 - protein, 9 aa, Dengue virus
YKFQADSPS

SEQ ID NO: 264205 - protein, 9 aa, Dengue virus
FTNMEVQLI

SEQ ID NO: 264206 - protein, 9 aa, Dengue virus
YYCAGLKKV

SEQ ID NO: 264207 - protein, 9 aa, Dengue virus
LRMVLAFIT

SEQ ID NO: 264208 - protein, 9 aa, Dengue virus
VLTLATGPI

SEQ ID NO: 264209 - protein, 9 aa, Dengue virus
VTYSLNTFT

SEQ ID NO: 264210 - protein, 9 aa, Dengue virus
MGLDKGWPL

SEQ ID NO: 264211 - protein, 9 aa, Dengue virus
WNLVRLQSG

SEQ ID NO: 264212 - protein, 9 aa, Dengue virus
LRTLILAPT

SEQ ID NO: 264213 - protein, 9 aa, Dengue virus
YSLNTFTNM

SEQ ID NO: 264214 - protein, 9 aa, Dengue virus
NRVSTVQQL

SEQ ID NO: 264215 - protein, 9 aa, Dengue virus
VMAFIAFLR

SEQ ID NO: 264216 - protein, 9 aa, Dengue virus
IAVSMANIF

SEQ ID NO: 264217 - protein, 9 aa, Dengue virus
YMWLGARFL

SEQ ID NO: 264218 - protein, 9 aa, Dengue virus
NVFHTMWHV

SEQ ID NO: 264219 - protein, 9 aa, Dengue virus
LLMRTSWAL

SEQ ID NO: 264220 - protein, 9 aa, Dengue virus
FKEFAAGRR

SEQ ID NO: 264221 - protein, 9 aa, Dengue virus
FNMLKRARN

SEQ ID NO: 264222 - protein, 9 aa, Dengue virus
VVKLLTKPW

SEQ ID NO: 264223 - protein, 9 aa, Dengue virus
FGRAKGSRA

SEQ ID NO: 264224 - protein, 9 aa, Dengue virus
YRILQRGLL

SEQ ID NO: 264225 - protein, 9 aa, Dengue virus
YISTRVGMG

SEQ ID NO: 264226 - protein, 9 aa, Dengue virus
LKGMPIRYQ

SEQ ID NO: 264227 - protein, 9 aa, Dengue virus
LSGRGPLKL

SEQ ID NO: 264228 - protein, 9 aa, Dengue virus
VMAFIAFLR

SEQ ID NO: 264229 - protein, 9 aa, Dengue virus
FKLTYQNKV

SEQ ID NO: 264230 - protein, 9 aa, Dengue virus
LSSLLKNDV

SEQ ID NO: 264231 - protein, 9 aa, Dengue virus
WNLVKLMSG

SEQ ID NO: 264232 - protein, 9 aa, Dengue virus
LRLASNAIC

SEQ ID NO: 264233 - protein, 9 aa, Dengue virus
YSQVNPTTL

SEQ ID NO: 264234 - protein, 9 aa, Dengue virus
LTLATGPVS

SEQ ID NO: 264235 - protein, 9 aa, Dengue virus
VNGVVRLLT

SEQ ID NO: 264236 - protein, 9 aa, Dengue virus
WLAHKVASE

SEQ ID NO: 264237 - protein, 9 aa, Dengue virus
YFHRRDLRL

SEQ ID NO: 264238 - protein, 9 aa, Dengue virus
VSRGTAKLR

SEQ ID NO: 264239 - protein, 9 aa, Dengue virus
WNLVKLHSG

SEQ ID NO: 264240 - protein, 9 aa, Dengue virus
YFHRRDLRL

SEQ ID NO: 264241 - protein, 9 aa, Dengue virus
LVSLLGSSL

SEQ ID NO: 264242 - protein, 9 aa, Dengue virus
IEAGRTLRV

SEQ ID NO: 264243 - protein, 9 aa, Dengue virus
TFITPMLRH

SEQ ID NO: 264244 - protein, 9 aa, Dengue virus
YSQVNPITL

SEQ ID NO: 264245 - protein, 9 aa, Dengue virus
CYVITGRSA

SEQ ID NO: 264246 - protein, 9 aa, Dengue virus
LSSLLRNDV

SEQ ID NO: 264247 - protein, 9 aa, Dengue virus
VSRLLLNRF

SEQ ID NO: 264248 - protein, 9 aa, Dengue virus
FKTAHAKKQ

SEQ ID NO: 264249 - protein, 9 aa, Dengue virus
IVSAVNMTS

SEQ ID NO: 264250 - protein, 9 aa, Dengue virus
GFGIFTTNI

SEQ ID NO: 264251 - protein, 9 aa, Dengue virus
YFHRRDLRL

SEQ ID NO: 264252 - protein, 9 aa, Dengue virus
FITFLRVLS

SEQ ID NO: 264253 - protein, 9 aa, Dengue virus
YGWNLVKLM

SEQ ID NO: 264254 - protein, 9 aa, Dengue virus
VRSNAALGA

SEQ ID NO: 264255 - protein, 9 aa, Dengue virus
VMTGRSADL

SEQ ID NO: 264256 - protein, 9 aa, Dengue virus
FTNMEAQLI

SEQ ID NO: 264257 - protein, 9 aa, Dengue virus
FQADSPKRL

SEQ ID NO: 264258 - protein, 9 aa, Dengue virus
MRLLSPVRV

SEQ ID NO: 264259 - protein, 9 aa, Dengue virus
YRILQRGLL

SEQ ID NO: 264260 - protein, 9 aa, Dengue virus
VVKLLTKPW

SEQ ID NO: 264261 - protein, 9 aa, Dengue virus
TFITPMMRH

SEQ ID NO: 264262 - protein, 9 aa, Dengue virus
YAVATTIIT

SEQ ID NO: 264263 - protein, 9 aa, Dengue virus
FQPESPARL

SEQ ID NO: 264264 - protein, 9 aa, Dengue virus
SLTAIANQA

SEQ ID NO: 264265 - protein, 9 aa, Dengue virus
FTNMEAQLI

SEQ ID NO: 264266 - protein, 9 aa, Dengue virus
VVRLLTKPW

SEQ ID NO: 264267 - protein, 9 aa, Dengue virus
SLAAIANQA

SEQ ID NO: 264268 - protein, 9 aa, Dengue virus
MFKKKNLTI

SEQ ID NO: 264269 - protein, 9 aa, Dengue virus
TSKMLLNRF

SEQ ID NO: 264270 - protein, 9 aa, Dengue virus
VSRGSAKLQ

SEQ ID NO: 264271 - protein, 9 aa, Dengue virus
VRSNAAIGA

SEQ ID NO: 264272 - protein, 9 aa, Dengue virus
WKLARASFI

SEQ ID NO: 264273 - protein, 9 aa, Dengue virus
MGLGRGWPL

SEQ ID NO: 264274 - protein, 9 aa, Dengue virus
FQADSPKRL

SEQ ID NO: 264275 - protein, 9 aa, Dengue virus
VSILLSSLL

SEQ ID NO: 264276 - protein, 9 aa, Dengue virus
PFCSHHFHK

SEQ ID NO: 264277 - protein, 9 aa, Dengue virus
IFVVDNVHT

SEQ ID NO: 264278 - protein, 9 aa, Dengue virus
YSQVNPLTL

SEQ ID NO: 264279 - protein, 9 aa, Dengue virus
SVNTTSRLL

SEQ ID NO: 264280 - protein, 9 aa, Dengue virus
YVITGTSAD

SEQ ID NO: 264281 - protein, 9 aa, Dengue virus
VKRFSTGLL

SEQ ID NO: 264282 - protein, 9 aa, Dengue virus
YWISNGTGN

SEQ ID NO: 264283 - protein, 9 aa, Dengue virus
YRILQRGLL

SEQ ID NO: 264284 - protein, 9 aa, Dengue virus
YQFQPESPA

SEQ ID NO: 264285 - protein, 9 aa, Dengue virus
YFHRRDLRL

SEQ ID NO: 264286 - protein, 9 aa, Dengue virus
YMATLKNVR

SEQ ID NO: 264287 - protein, 9 aa, Dengue virus
FKLTYQNKV

SEQ ID NO: 264288 - protein, 9 aa, Dengue virus
VWFVPSIKT

SEQ ID NO: 264289 - protein, 9 aa, Dengue virus
YAQMWTLMY

SEQ ID NO: 264290 - protein, 9 aa, Dengue virus
YTALFGGVS

SEQ ID NO: 264291 - protein, 9 aa, Dengue virus
TILLKATLL

SEQ ID NO: 264292 - protein, 9 aa, Dengue virus
LTIMDLHPG

SEQ ID NO: 264293 - protein, 9 aa, Dengue virus
LIGLTSRAT

SEQ ID NO: 264294 - protein, 9 aa, Dengue virus
ISRMLINRF

SEQ ID NO: 264295 - protein, 9 aa, Dengue virus
FLAIPPTAG

SEQ ID NO: 264296 - protein, 9 aa, Dengue virus
IVSAVNMTS

SEQ ID NO: 264297 - protein, 9 aa, Dengue virus
FCEVLTLAT

SEQ ID NO: 264298 - protein, 9 aa, Dengue virus
WHVTRGAVL

SEQ ID NO: 264299 - protein, 9 aa, Dengue virus
KRFSLGLLS

SEQ ID NO: 264300 - protein, 9 aa, Dengue virus
FSTGLLNGK

SEQ ID NO: 264301 - protein, 9 aa, Dengue virus
LKRRLRTLI

SEQ ID NO: 264302 - protein, 9 aa, Dengue virus
YLPAIIREA

SEQ ID NO: 264303 - protein, 9 aa, Dengue virus
YVITGTSAD

SEQ ID NO: 264304 - protein, 9 aa, Dengue virus
YYCAGLKKV

SEQ ID NO: 264305 - protein, 9 aa, Dengue virus
VSRGSAKLR

SEQ ID NO: 264306 - protein, 9 aa, Dengue virus
HRMDIGVPL

SEQ ID NO: 264307 - protein, 9 aa, Dengue virus
NIFRGSYLA

SEQ ID NO: 264308 - protein, 9 aa, Dengue virus
VNMTSKMLL

SEQ ID NO: 264309 - protein, 9 aa, Dengue virus
KRKLRTLVL

SEQ ID NO: 264310 - protein, 9 aa, Dengue virus
FCSHHFHKI

SEQ ID NO: 264311 - protein, 9 aa, Dengue virus
LQGQGPMKM

SEQ ID NO: 264312 - protein, 9 aa, Dengue virus
IVSAVNMTS

SEQ ID NO: 264313 - protein, 9 aa, Dengue virus
YKFQPESPS

SEQ ID NO: 264314 - protein, 9 aa, Dengue virus
YRIKQRGIL

SEQ ID NO: 264315 - protein, 9 aa, Dengue virus
MLKRVRNRV

SEQ ID NO: 264316 - protein, 9 aa, Dengue virus
SLTAIANQA

SEQ ID NO: 264317 - protein, 9 aa, Dengue virus
VVKLLTKPW

SEQ ID NO: 264318 - protein, 9 aa, Dengue virus
FLRFLAIPP

SEQ ID NO: 264319 - protein, 9 aa, Dengue virus
TWSIHAKHQ

SEQ ID NO: 264320 - protein, 9 aa, Dengue virus
IFITNNVHT

SEQ ID NO: 264321 - protein, 9 aa, Dengue virus
LILAPTRVV

SEQ ID NO: 264322 - protein, 9 aa, Dengue virus
IHRMDLGVP

SEQ ID NO: 264323 - protein, 9 aa, Dengue virus
YWVSGATGN

SEQ ID NO: 264324 - protein, 9 aa, Dengue virus
FGKAKGSRA

SEQ ID NO: 264325 - protein, 9 aa, Dengue virus
YGWNIVKLH

SEQ ID NO: 264326 - protein, 9 aa, Dengue virus
VRSNAALGA

SEQ ID NO: 264327 - protein, 9 aa, Dengue virus
LNGKGPLRM

SEQ ID NO: 264328 - protein, 9 aa, Dengue virus
YKFQPESPS

SEQ ID NO: 264329 - protein, 9 aa, Dengue virus
GFGIFTTNI

SEQ ID NO: 264330 - protein, 9 aa, Dengue virus
VLTLATGPI

SEQ ID NO: 264331 - protein, 9 aa, Dengue virus
VWFVPSIKA

SEQ ID NO: 264332 - protein, 9 aa, Dengue virus
FTNMEVQLI

SEQ ID NO: 264333 - protein, 9 aa, Dengue virus
YTALFSGVS

SEQ ID NO: 264334 - protein, 9 aa, Dengue virus
WALMYFHRR

SEQ ID NO: 264335 - protein, 9 aa, Dengue virus
LTAIANQAA

SEQ ID NO: 264336 - protein, 9 aa, Dengue virus
YGWNLVKLH

SEQ ID NO: 264337 - protein, 9 aa, Dengue virus
IFRGSYLAG

SEQ ID NO: 264338 - protein, 9 aa, Dengue virus
YAQMWSLMY

SEQ ID NO: 264339 - protein, 9 aa, Dengue virus
IRYQTPAIR

SEQ ID NO: 264340 - protein, 9 aa, Dengue virus
GFGMFTTNI

SEQ ID NO: 264341 - protein, 9 aa, Dengue virus
LHRMDIGVP

SEQ ID NO: 264342 - protein, 9 aa, Dengue virus
WFSRGNSLS

SEQ ID NO: 264343 - protein, 9 aa, Dengue virus
ICGIRSTTR

SEQ ID NO: 264344 - protein, 9 aa, Dengue virus
LRGLPIRYQ

SEQ ID NO: 264345 - protein, 9 aa, Dengue virus
YLPAIVREA

SEQ ID NO: 264346 - protein, 9 aa, Dengue virus
YFHRRDLRL

SEQ ID NO: 264347 - protein, 9 aa, Dengue virus
YAVATTIVT

SEQ ID NO: 264348 - protein, 9 aa, Dengue virus
IKRGLRTLI

SEQ ID NO: 264349 - protein, 9 aa, Dengue virus
IREAIKRKL

SEQ ID NO: 264350 - protein, 9 aa, Dengue virus
NISLTAIAN

SEQ ID NO: 264351 - protein, 9 aa, Dengue virus
VSRGSSKLR

SEQ ID NO: 264352 - protein, 9 aa, Dengue virus
LIGLSSRAT

SEQ ID NO: 264353 - protein, 9 aa, Dengue virus
YSQVNPITL

SEQ ID NO: 264354 - protein, 9 aa, Dengue virus
YFHRRDLRL

SEQ ID NO: 264355 - protein, 9 aa, Dengue virus
WNTTIAVSM

SEQ ID NO: 264356 - protein, 9 aa, Dengue virus
TIENSTANV

SEQ ID NO: 264357 - protein, 9 aa, Dengue virus
VVKLLTKPW

SEQ ID NO: 264358 - protein, 9 aa, Dengue virus
VNVSLTAIA

SEQ ID NO: 264359 - protein, 9 aa, Dengue virus
VLAFITFLR

SEQ ID NO: 264360 - protein, 9 aa, Dengue virus
FCKKVRSNA

SEQ ID NO: 264361 - protein, 9 aa, Dengue virus
VLTLATGPI

SEQ ID NO: 264362 - protein, 9 aa, Dengue virus
VLAFITFLR

SEQ ID NO: 264363 - protein, 9 aa, Dengue virus
NISLTAIAN

SEQ ID NO: 264364 - protein, 9 aa, Dengue virus
LRTLILAPT

SEQ ID NO: 264365 - protein, 9 aa, Dengue virus
YISTRVEMG

SEQ ID NO: 264366 - protein, 9 aa, Dengue virus
LSGRGPLKL

SEQ ID NO: 264367 - protein, 9 aa, Dengue virus
IANQAAILM

SEQ ID NO: 264368 - protein, 9 aa, Dengue virus
VSRMLLNRF

SEQ ID NO: 264369 - protein, 9 aa, Dengue virus
LTAIANQAA

SEQ ID NO: 264370 - protein, 9 aa, Dengue virus
RIYSDPLAL

SEQ ID NO: 264371 - protein, 9 aa, Dengue virus
GCYSQVNPL

SEQ ID NO: 264372 - protein, 9 aa, Dengue virus
FTNMEAQLI

SEQ ID NO: 264373 - protein, 9 aa, Dengue virus
LRTLILAPT

SEQ ID NO: 264374 - protein, 9 aa, Dengue virus
SLAAIANQA

SEQ ID NO: 264375 - protein, 9 aa, Dengue virus
LAAIANQAV

SEQ ID NO: 264376 - protein, 9 aa, Dengue virus
YKFQPESPA

SEQ ID NO: 264377 - protein, 9 aa, Dengue virus
IEEGRTLRV

SEQ ID NO: 264378 - protein, 9 aa, Dengue virus
YRIMQRGLF

SEQ ID NO: 264379 - protein, 9 aa, Dengue virus
IFRGSYLAG

SEQ ID NO: 264380 - protein, 9 aa, Dengue virus
LRTLILAPT

SEQ ID NO: 264381 - protein, 9 aa, Dengue virus
IRYQTPAVK

SEQ ID NO: 264382 - protein, 9 aa, Dengue virus
VKRFSSELL

SEQ ID NO: 264383 - protein, 9 aa, Dengue virus
FLRFLTIPP

SEQ ID NO: 264384 - protein, 9 aa, Dengue virus
MGLGRGWPL

SEQ ID NO: 264385 - protein, 9 aa, Dengue virus
LVTFKNPHA

SEQ ID NO: 264386 - protein, 9 aa, Dengue virus
CHATFTTRL

SEQ ID NO: 264387 - protein, 9 aa, Dengue virus
FCKKVRSNA

SEQ ID NO: 264388 - protein, 9 aa, Dengue virus
AVSRGSAKL

SEQ ID NO: 264389 - protein, 9 aa, Dengue virus
KRFSRGMLQ

SEQ ID NO: 264390 - protein, 9 aa, Dengue virus
SVNTTSRLL

SEQ ID NO: 264391 - protein, 9 aa, Dengue virus
YISTRVGMG

SEQ ID NO: 264392 - protein, 9 aa, Dengue virus
LRTLILAPT

SEQ ID NO: 264393 - protein, 9 aa, Dengue virus
NIVSSVNMI

SEQ ID NO: 264394 - protein, 9 aa, Dengue virus
YISTRVGMG

SEQ ID NO: 264395 - protein, 9 aa, Dengue virus
YTALFSGVS

SEQ ID NO: 264396 - protein, 9 aa, Dengue virus
LFGKGSLIT

SEQ ID NO: 264397 - protein, 9 aa, Dengue virus
LTLATGPIT

SEQ ID NO: 264398 - protein, 9 aa, Dengue virus
AVSRGSAKL

SEQ ID NO: 264399 - protein, 9 aa, Dengue virus
VRSNAAMGA

SEQ ID NO: 264400 - protein, 9 aa, Dengue virus
LRKSGKKVI

SEQ ID NO: 264401 - protein, 9 aa, Dengue virus
VEAGRTLRV

SEQ ID NO: 264402 - protein, 9 aa, Dengue virus
LVKLMSGKD

SEQ ID NO: 264403 - protein, 9 aa, Dengue virus
LILAPTRVV

SEQ ID NO: 264404 - protein, 9 aa, Dengue virus
RLMSAAIKD

SEQ ID NO: 264405 - protein, 9 aa, Dengue virus
MGLGRGWPL

SEQ ID NO: 264406 - protein, 9 aa, Dengue virus
NIVSSVNTI

SEQ ID NO: 264407 - protein, 9 aa, Dengue virus
WLVHRQWFL

SEQ ID NO: 264408 - protein, 9 aa, Dengue virus
VVKLLTKPW

SEQ ID NO: 264409 - protein, 9 aa, Dengue virus
CIKILNPYM

SEQ ID NO: 264410 - protein, 9 aa, Dengue virus
WHVTRGAVL

SEQ ID NO: 264411 - protein, 9 aa, Dengue virus
VVRLLTKPW

SEQ ID NO: 264412 - protein, 9 aa, Dengue virus
SLTAIANQA

SEQ ID NO: 264413 - protein, 9 aa, Dengue virus
YSQVNPTTL

SEQ ID NO: 264414 - protein, 9 aa, Dengue virus
LTLATGPVL

SEQ ID NO: 264415 - protein, 9 aa, Dengue virus
YSQVNPITL

SEQ ID NO: 264416 - protein, 9 aa, Dengue virus
LIGLTSRAT

SEQ ID NO: 264417 - protein, 9 aa, Dengue virus
LTLATGPIT

SEQ ID NO: 264418 - protein, 9 aa, Dengue virus
FKTAHAKKQ

SEQ ID NO: 264419 - protein, 9 aa, Dengue virus
ISKMLINRF

SEQ ID NO: 264420 - protein, 9 aa, Dengue virus
FHTMWHVTR

SEQ ID NO: 264421 - protein, 9 aa, Dengue virus
LAAIANQAA

SEQ ID NO: 264422 - protein, 9 aa, Dengue virus
VQLLLMRTS

SEQ ID NO: 264423 - protein, 9 aa, Dengue virus
TRKYLPAII

SEQ ID NO: 264424 - protein, 9 aa, Dengue virus
FGKAKGSRA

SEQ ID NO: 264425 - protein, 9 aa, Dengue virus
IKKVRTNAA

SEQ ID NO: 264426 - protein, 9 aa, Dengue virus
YVITGRSAD

SEQ ID NO: 264427 - protein, 9 aa, Dengue virus
FKNAHAKRQ

SEQ ID NO: 264428 - protein, 9 aa, Dengue virus
LSGRGPLKL

SEQ ID NO: 264429 - protein, 9 aa, Dengue virus
LTAIANQAV

SEQ ID NO: 264430 - protein, 9 aa, Dengue virus
WVSGVSGNI

SEQ ID NO: 264431 - protein, 9 aa, Dengue virus
VMAFIAFLR

SEQ ID NO: 264432 - protein, 9 aa, Dengue virus
LIGLSSRAT

SEQ ID NO: 264433 - protein, 9 aa, Dengue virus
TTTVSGKLI

SEQ ID NO: 264434 - protein, 9 aa, Dengue virus
NIFRGSYLA

SEQ ID NO: 264435 - protein, 9 aa, Dengue virus
IFVIDNVHT

SEQ ID NO: 264436 - protein, 9 aa, Dengue virus
IVSILASSL

SEQ ID NO: 264437 - protein, 9 aa, Dengue virus
WISNGTGNI

SEQ ID NO: 264438 - protein, 9 aa, Dengue virus
YLAGAGLAF

SEQ ID NO: 264439 - protein, 9 aa, Dengue virus
FLAIPPTAG

SEQ ID NO: 264440 - protein, 9 aa, Dengue virus
VQQLTKRFS

SEQ ID NO: 264441 - protein, 9 aa, Dengue virus
VTPMLRHTI

SEQ ID NO: 264442 - protein, 9 aa, Dengue virus
TVLTPMLRH

SEQ ID NO: 264443 - protein, 9 aa, Dengue virus
NIVSSVNMV

SEQ ID NO: 264444 - protein, 9 aa, Dengue virus
LRTLILAPT

SEQ ID NO: 264445 - protein, 9 aa, Dengue virus
WHVTRGAVL

SEQ ID NO: 264446 - protein, 9 aa, Dengue virus
VVRLLTKPW

SEQ ID NO: 264447 - protein, 9 aa, Dengue virus
FCEVLTLAT

SEQ ID NO: 264448 - protein, 9 aa, Dengue virus
WNIVKLHSG

SEQ ID NO: 264449 - protein, 9 aa, Dengue virus
LKGLPIRYQ

SEQ ID NO: 264450 - protein, 9 aa, Dengue virus
WISNGTGNI

SEQ ID NO: 264451 - protein, 9 aa, Dengue virus
FHTMWHVTR

SEQ ID NO: 264452 - protein, 9 aa, Dengue virus
LIGLSSRAT

SEQ ID NO: 264453 - protein, 9 aa, Dengue virus
YVITGTSAD

SEQ ID NO: 264454 - protein, 9 aa, Dengue virus
YWISNGTGN

SEQ ID NO: 264455 - protein, 9 aa, Dengue virus
YAQMWSLMY

SEQ ID NO: 264456 - protein, 9 aa, Dengue virus
GHLKCRLRM

SEQ ID NO: 264457 - protein, 9 aa, Dengue virus
LKRVRNRVS

SEQ ID NO: 264458 - protein, 9 aa, Dengue virus
YGWNIVKLH

SEQ ID NO: 264459 - protein, 9 aa, Dengue virus
YFHRRDLRL

SEQ ID NO: 264460 - protein, 9 aa, Dengue virus
LTIMDLHPG

SEQ ID NO: 264461 - protein, 9 aa, Dengue virus
LMRTTWAFC

SEQ ID NO: 264462 - protein, 9 aa, Dengue virus
YAVATTFIT

SEQ ID NO: 264463 - protein, 9 aa, Dengue virus
WKLEKASFI

SEQ ID NO: 264464 - protein, 9 aa, Dengue virus
TKRILPSIV

SEQ ID NO: 264465 - protein, 9 aa, Dengue virus
FHTMWHVTR

SEQ ID NO: 264466 - protein, 9 aa, Dengue virus
VSILLSSLL

SEQ ID NO: 264467 - protein, 9 aa, Dengue virus
IAVSMANIF

SEQ ID NO: 264468 - protein, 9 aa, Dengue virus
FLTIPPTAG

SEQ ID NO: 264469 - protein, 9 aa, Dengue virus
VKRFSTGLL

SEQ ID NO: 264470 - protein, 9 aa, Dengue virus
VWFVPSIKA

SEQ ID NO: 264471 - protein, 9 aa, Dengue virus
HHFHKIFMK

SEQ ID NO: 264472 - protein, 9 aa, Dengue virus
YAVATTVLT

SEQ ID NO: 264473 - protein, 9 aa, Dengue virus
YVITGTSAD

SEQ ID NO: 264474 - protein, 9 aa, Dengue virus
YTALFSGVS

SEQ ID NO: 264475 - protein, 9 aa, Dengue virus
TRKYLPAII

SEQ ID NO: 264476 - protein, 9 aa, Dengue virus
SLRTTTVTG

SEQ ID NO: 264477 - protein, 9 aa, Dengue virus
FGRAKGSRA

SEQ ID NO: 264478 - protein, 9 aa, Dengue virus
VSRGSAKLR

SEQ ID NO: 264479 - protein, 9 aa, Dengue virus
VLLMRTTWA

SEQ ID NO: 264480 - protein, 9 aa, Dengue virus
MVTFKVPHA

SEQ ID NO: 264481 - protein, 9 aa, Dengue virus
HWFSRGNSL

SEQ ID NO: 264482 - protein, 9 aa, Dengue virus
IFVIDNVHT

SEQ ID NO: 264483 - protein, 9 aa, Dengue virus
LTLATGPIT

SEQ ID NO: 264484 - protein, 9 aa, Dengue virus
LIMKDGRSL

SEQ ID NO: 264485 - protein, 9 aa, Dengue virus
NRVSTVQQL

SEQ ID NO: 264486 - protein, 9 aa, Dengue virus
HRMDLGVPL

SEQ ID NO: 264487 - protein, 9 aa, Dengue virus
LILAPTRVV

SEQ ID NO: 264488 - protein, 9 aa, Dengue virus
YISTRVEMG

SEQ ID NO: 264489 - protein, 9 aa, Dengue virus
IFITNNVHT

SEQ ID NO: 264490 - protein, 9 aa, Dengue virus
FQPESPSRL

SEQ ID NO: 264491 - protein, 9 aa, Dengue virus
YLAGAGLAF

SEQ ID NO: 264492 - protein, 9 aa, Dengue virus
VMAFIAFLR

SEQ ID NO: 264493 - protein, 9 aa, Dengue virus
FTNMEVQLI

SEQ ID NO: 264494 - protein, 9 aa, Dengue virus
MGLGRGWPI

SEQ ID NO: 264495 - protein, 9 aa, Dengue virus
LILAPTRVV

SEQ ID NO: 264496 - protein, 9 aa, Dengue virus
FQADSPKRL

SEQ ID NO: 264497 - protein, 9 aa, Dengue virus
NISLAAIAN

SEQ ID NO: 264498 - protein, 9 aa, Dengue virus
YVSAIAQAK

SEQ ID NO: 264499 - protein, 9 aa, Dengue virus
FTNMEVQLI

SEQ ID NO: 264500 - protein, 9 aa, Dengue virus
LVTFKNPHA

SEQ ID NO: 264501 - protein, 9 aa, Dengue virus
VRSNAALGA

SEQ ID NO: 264502 - protein, 9 aa, Dengue virus
QLIMKDGRV

SEQ ID NO: 264503 - protein, 9 aa, Dengue virus
VLTLATGPV

SEQ ID NO: 264504 - protein, 9 aa, Dengue virus
YNHALNELP

SEQ ID NO: 264505 - protein, 9 aa, Dengue virus
YTTMFGGVS

SEQ ID NO: 264506 - protein, 9 aa, Dengue virus
YAIIGPGLQ

SEQ ID NO: 264507 - protein, 9 aa, Dengue virus
VTYSLNTFT

SEQ ID NO: 264508 - protein, 9 aa, Dengue virus
FRAERVIDP

SEQ ID NO: 264509 - protein, 9 aa, Dengue virus
LMSAAVKDQ

SEQ ID NO: 264510 - protein, 9 aa, Dengue virus
VNMISRMLI

SEQ ID NO: 264511 - protein, 9 aa, Dengue virus
LFSGQGPMK

SEQ ID NO: 264512 - protein, 9 aa, Dengue virus
YAVSRGTSK

SEQ ID NO: 264513 - protein, 9 aa, Dengue virus
WNTTIAVST

SEQ ID NO: 264514 - protein, 9 aa, Dengue virus
YGWNLVKLM

SEQ ID NO: 264515 - protein, 9 aa, Dengue virus
YVITGTSAD

SEQ ID NO: 264516 - protein, 9 aa, Dengue virus
YKFQADSPS

SEQ ID NO: 264517 - protein, 9 aa, Dengue virus
SVNTTSKML

SEQ ID NO: 264518 - protein, 9 aa, Dengue virus
VQQLTKRFS

SEQ ID NO: 264519 - protein, 9 aa, Dengue virus
IRYQTPAIR

SEQ ID NO: 264520 - protein, 9 aa, Dengue virus
YAVATTFIT

SEQ ID NO: 264521 - protein, 9 aa, Dengue virus
IFVADNVHT

SEQ ID NO: 264522 - protein, 9 aa, Dengue virus
VSRGTAKLQ

SEQ ID NO: 264523 - protein, 9 aa, Dengue virus
YRILQRGLL

SEQ ID NO: 264524 - protein, 9 aa, Dengue virus
LTAIANQAA

SEQ ID NO: 264525 - protein, 9 aa, Dengue virus
FLRFLAIPP

SEQ ID NO: 264526 - protein, 9 aa, Dengue virus
IFVIDNVHT

SEQ ID NO: 264527 - protein, 9 aa, Dengue virus
LTAIANQAA

SEQ ID NO: 264528 - protein, 9 aa, Dengue virus
VRSNAALGA

SEQ ID NO: 264529 - protein, 9 aa, Dengue virus
YAQMWSLMY

SEQ ID NO: 264530 - protein, 9 aa, Dengue virus
FTMRLLSPV

SEQ ID NO: 264531 - protein, 9 aa, Dengue virus
LMRTSWAFC

SEQ ID NO: 264532 - protein, 9 aa, Dengue virus
FTSKVRSNA

SEQ ID NO: 264533 - protein, 9 aa, Dengue virus
FTSKVRSNA

SEQ ID NO: 264534 - protein, 9 aa, Dengue virus
LSSLLRNDV

SEQ ID NO: 264535 - protein, 9 aa, Dengue virus
YISTRVEMG

SEQ ID NO: 264536 - protein, 9 aa, Dengue virus
IRYQTTAVK

SEQ ID NO: 264537 - protein, 9 aa, Dengue virus
WNTTIAVST

SEQ ID NO: 264538 - protein, 9 aa, Dengue virus
IFMTATPPG

SEQ ID NO: 264539 - protein, 9 aa, Dengue virus
YRIKQRGIL

SEQ ID NO: 264540 - protein, 9 aa, Dengue virus
FLRFLAIPP

SEQ ID NO: 264541 - protein, 9 aa, Dengue virus
FQADSPKRL

SEQ ID NO: 264542 - protein, 9 aa, Dengue virus
VRSNAALGA

SEQ ID NO: 264543 - protein, 9 aa, Dengue virus
IFVIDNVHT

SEQ ID NO: 264544 - protein, 9 aa, Dengue virus
VNMTSKMLL

SEQ ID NO: 264545 - protein, 9 aa, Dengue virus
GFGMFSTNI

SEQ ID NO: 264546 - protein, 9 aa, Dengue virus
GFGIFTTNI

SEQ ID NO: 264547 - protein, 9 aa, Dengue virus
VVRLLTKPW

SEQ ID NO: 264548 - protein, 9 aa, Dengue virus
ITLATGPLS

SEQ ID NO: 264549 - protein, 9 aa, Dengue virus
VSILLSSLL

SEQ ID NO: 264550 - protein, 9 aa, Dengue virus
VLAFITFLR

SEQ ID NO: 264551 - protein, 9 aa, Dengue virus
YAVATTFIT

SEQ ID NO: 264552 - protein, 9 aa, Dengue virus
VSILLSSLL

SEQ ID NO: 264553 - protein, 9 aa, Dengue virus
WLAYKVASE

SEQ ID NO: 264554 - protein, 9 aa, Dengue virus
ATTFITPML

SEQ ID NO: 264555 - protein, 9 aa, Dengue virus
VSILLSSLL

SEQ ID NO: 264556 - protein, 9 aa, Dengue virus
WFSRENSLS

SEQ ID NO: 264557 - protein, 9 aa, Dengue virus
LMRTSWALC

SEQ ID NO: 264558 - protein, 9 aa, Dengue virus
WHVTRGAVL

SEQ ID NO: 264559 - protein, 9 aa, Dengue virus
IVASVNTTS

SEQ ID NO: 264560 - protein, 9 aa, Dengue virus
FHRRDLRLA

SEQ ID NO: 264561 - protein, 9 aa, Dengue virus
WNLVKLYSG

SEQ ID NO: 264562 - protein, 9 aa, Dengue virus
YVMTGRSAD

SEQ ID NO: 264563 - protein, 9 aa, Dengue virus
FLRVLSIPP

SEQ ID NO: 264564 - protein, 9 aa, Dengue virus
IAMTDTTPF

SEQ ID NO: 264565 - protein, 9 aa, Dengue virus
FCEALTLAT

SEQ ID NO: 264566 - protein, 9 aa, Dengue virus
VRSNAAIGA

SEQ ID NO: 264567 - protein, 9 aa, Dengue virus
FKEFAAGRK

SEQ ID NO: 264568 - protein, 9 aa, Dengue virus
WSLMYFHRR

SEQ ID NO: 264569 - protein, 9 aa, Dengue virus
VSRGSAKLR

SEQ ID NO: 264570 - protein, 9 aa, Dengue virus
VWFVPSIKS

SEQ ID NO: 264571 - protein, 9 aa, Dengue virus
HWFSRGNSL

SEQ ID NO: 264572 - protein, 9 aa, Dengue virus
VWLAYKVAS

SEQ ID NO: 264573 - protein, 9 aa, Dengue virus
LRLASNAIC

SEQ ID NO: 264574 - protein, 9 aa, Dengue virus
LTIMDLHPG

SEQ ID NO: 264575 - protein, 9 aa, Dengue virus
KRKLRTLIL

SEQ ID NO: 264576 - protein, 9 aa, Dengue virus
WLSYKVASA

SEQ ID NO: 264577 - protein, 9 aa, Dengue virus
LVTFKTAHA

SEQ ID NO: 264578 - protein, 9 aa, Dengue virus
IRYQTTAVK

SEQ ID NO: 264579 - protein, 9 aa, Dengue virus
LVRLQSGVD

SEQ ID NO: 264580 - protein, 9 aa, Dengue virus
TILIRTGLL

SEQ ID NO: 264581 - protein, 9 aa, Dengue virus
TIRVLSLVE

SEQ ID NO: 264582 - protein, 9 aa, Dengue virus
VTRLENIMW

SEQ ID NO: 264583 - protein, 9 aa, Dengue virus
LAAIANQAA

SEQ ID NO: 264584 - protein, 9 aa, Dengue virus
WMTTEDMLK

SEQ ID NO: 264585 - protein, 9 aa, Dengue virus
GFGMFTTNI

SEQ ID NO: 264586 - protein, 9 aa, Dengue virus
YAQMWQLMY

SEQ ID NO: 264587 - protein, 9 aa, Dengue virus
YKFQPESPA

SEQ ID NO: 264588 - protein, 9 aa, Dengue virus
SVNTTSRLL

SEQ ID NO: 264589 - protein, 9 aa, Dengue virus
LIGLSSRAT

SEQ ID NO: 264590 - protein, 9 aa, Dengue virus
LRTTTASGK

SEQ ID NO: 264591 - protein, 9 aa, Dengue virus
TFITPMMRH

SEQ ID NO: 264592 - protein, 9 aa, Dengue virus
VRSNAAIGA

SEQ ID NO: 264593 - protein, 9 aa, Dengue virus
FQADSPKKL

SEQ ID NO: 264594 - protein, 9 aa, Dengue virus
FLAIPPTAG

SEQ ID NO: 264595 - protein, 9 aa, Dengue virus
FTNMEAQLI

SEQ ID NO: 264596 - protein, 9 aa, Dengue virus
LIGLTSRAT

SEQ ID NO: 264597 - protein, 9 aa, Dengue virus
WNTTIAVST

SEQ ID NO: 264598 - protein, 9 aa, Dengue virus
MGLGRGWPL

SEQ ID NO: 264599 - protein, 9 aa, Dengue virus
TRLLSSTRV

SEQ ID NO: 264600 - protein, 9 aa, Dengue virus
FQADSPSKL

SEQ ID NO: 264601 - protein, 9 aa, Dengue virus
LRMVLAFIT

SEQ ID NO: 264602 - protein, 9 aa, Dengue virus
DLRLASMAI

SEQ ID NO: 264603 - protein, 9 aa, Dengue virus
WKMERASFI

SEQ ID NO: 264604 - protein, 9 aa, Dengue virus
YSQVNPLTL

SEQ ID NO: 264605 - protein, 9 aa, Dengue virus
LTIMDLHPG

SEQ ID NO: 264606 - protein, 9 aa, Dengue virus
YAVATTVLT

SEQ ID NO: 264607 - protein, 9 aa, Dengue virus
FMALVAFLR

SEQ ID NO: 264608 - protein, 9 aa, Dengue virus
LHKLGYILR

SEQ ID NO: 264609 - protein, 9 aa, Dengue virus
VVSILASSF

SEQ ID NO: 264610 - protein, 9 aa, Dengue virus
YVMTGRSAD

SEQ ID NO: 264611 - protein, 9 aa, Dengue virus
VQQLTKRFS

SEQ ID NO: 264612 - protein, 9 aa, Dengue virus
FLAIPPTAG

SEQ ID NO: 264613 - protein, 9 aa, Dengue virus
IRYQTTATK

SEQ ID NO: 264614 - protein, 9 aa, Dengue virus
LAAIANQAT

SEQ ID NO: 264615 - protein, 9 aa, Dengue virus
RWFVERNLV

SEQ ID NO: 264616 - protein, 9 aa, Dengue virus
VFHTMWHVT

SEQ ID NO: 264617 - protein, 9 aa, Dengue virus
YSQVNPITL

SEQ ID NO: 264618 - protein, 9 aa, Dengue virus
YYMATLKNV

SEQ ID NO: 264619 - protein, 9 aa, Dengue virus
ITPMLRHTI

SEQ ID NO: 264620 - protein, 9 aa, Dengue virus
VVSILASSF

SEQ ID NO: 264621 - protein, 9 aa, Dengue virus
WALCESITL

SEQ ID NO: 264622 - protein, 9 aa, Dengue virus
TKRILPSIV

SEQ ID NO: 264623 - protein, 9 aa, Dengue virus
YYMATLKNV

SEQ ID NO: 264624 - protein, 9 aa, Dengue virus
KRFSLGLLS

SEQ ID NO: 264625 - protein, 9 aa, Dengue virus
VRSNAAMGA

SEQ ID NO: 264626 - protein, 9 aa, Dengue virus
VSTVQQLTK

SEQ ID NO: 264627 - protein, 9 aa, Dengue virus
VQQLTKRFS

SEQ ID NO: 264628 - protein, 9 aa, Dengue virus
GFGIFTTNI

SEQ ID NO: 264629 - protein, 9 aa, Dengue virus
GFGMFSTNI

SEQ ID NO: 264630 - protein, 9 aa, Dengue virus
WHVTRGAVL

SEQ ID NO: 264631 - protein, 9 aa, Dengue virus
FLAIPPTAG

SEQ ID NO: 264632 - protein, 9 aa, Dengue virus
MGLGRGWPI

SEQ ID NO: 264633 - protein, 9 aa, Dengue virus
VTRLENIMW

SEQ ID NO: 264634 - protein, 9 aa, Dengue virus
WNTTIAVST

SEQ ID NO: 264635 - protein, 9 aa, Dengue virus
VNTISKMLL

SEQ ID NO: 264636 - protein, 9 aa, Dengue virus
WVSGATGNI

SEQ ID NO: 264637 - protein, 9 aa, Dengue virus
VNVSLTAIA

SEQ ID NO: 264638 - protein, 9 aa, Dengue virus
VRSNAALGA

SEQ ID NO: 264639 - protein, 9 aa, Dengue virus
IENTSANLS

SEQ ID NO: 264640 - protein, 9 aa, Dengue virus
FHTMWHVTR

SEQ ID NO: 264641 - protein, 9 aa, Dengue virus
WMTTEDMLT

SEQ ID NO: 264642 - protein, 9 aa, Dengue virus
VTYGLNTFT

SEQ ID NO: 264643 - protein, 9 aa, Dengue virus
VVRLLTKPW

SEQ ID NO: 264644 - protein, 9 aa, Dengue virus
FLAIPPTAG

SEQ ID NO: 264645 - protein, 9 aa, Dengue virus
WLAYKVAAE

SEQ ID NO: 264646 - protein, 9 aa, Dengue virus
YAVATTFIT

SEQ ID NO: 264647 - protein, 9 aa, Dengue virus
VWFVPSIKA

SEQ ID NO: 264648 - protein, 9 aa, Dengue virus
VMAFIAFLR

SEQ ID NO: 264649 - protein, 9 aa, Dengue virus
FNMLKRERN

SEQ ID NO: 264650 - protein, 9 aa, Dengue virus
FQADSPSKL

SEQ ID NO: 264651 - protein, 9 aa, Dengue virus
WKMERASFI

SEQ ID NO: 264652 - protein, 9 aa, Dengue virus
VWFVPSIKS

SEQ ID NO: 264653 - protein, 9 aa, Dengue virus
ISRMLINRF

SEQ ID NO: 264654 - protein, 9 aa, Dengue virus
IVSILASSL

SEQ ID NO: 264655 - protein, 9 aa, Dengue virus
MVTQIAMTD

SEQ ID NO: 264656 - protein, 9 aa, Dengue virus
VWFVPSIKA

SEQ ID NO: 264657 - protein, 9 aa, Dengue virus
LVSLLGSSL

SEQ ID NO: 264658 - protein, 9 aa, Dengue virus
YLAGAGLAF

SEQ ID NO: 264659 - protein, 9 aa, Dengue virus
IFVIDNVHT

SEQ ID NO: 264660 - protein, 9 aa, Dengue virus
TFITPMMRH

SEQ ID NO: 264661 - protein, 9 aa, Dengue virus
VQQLTKRFS

SEQ ID NO: 264662 - protein, 9 aa, Dengue virus
WCNATSTWV

SEQ ID NO: 264663 - protein, 9 aa, Dengue virus
PLKLFMALV

SEQ ID NO: 264664 - protein, 9 aa, Dengue virus
WQLMYFHRR

SEQ ID NO: 264665 - protein, 9 aa, Dengue virus
YISTRVEMG

SEQ ID NO: 264666 - protein, 9 aa, Dengue virus
ITLATGPLS

SEQ ID NO: 264667 - protein, 9 aa, Dengue virus
FGRAKGSRA

SEQ ID NO: 264668 - protein, 9 aa, Dengue virus
MMRTTWALC

SEQ ID NO: 264669 - protein, 9 aa, Dengue virus
IFMTATPPG

SEQ ID NO: 264670 - protein, 9 aa, Dengue virus
VSRGSAKIR

SEQ ID NO: 264671 - protein, 9 aa, Dengue virus
WLSYKVASA

SEQ ID NO: 264672 - protein, 9 aa, Dengue virus
KRKLRTLIL

SEQ ID NO: 264673 - protein, 9 aa, Dengue virus
TISKMLLNR

SEQ ID NO: 264674 - protein, 9 aa, Dengue virus
FHRRDLRLA

SEQ ID NO: 264675 - protein, 9 aa, Dengue virus
FKLTYQNKV

SEQ ID NO: 264676 - protein, 9 aa, Dengue virus
FLTIPPTAG

SEQ ID NO: 264677 - protein, 9 aa, Dengue virus
LIGLTSRAT

SEQ ID NO: 264678 - protein, 9 aa, Dengue virus
CHATFTTRL

SEQ ID NO: 264679 - protein, 9 aa, Dengue virus
YMWLGARFL

SEQ ID NO: 264680 - protein, 9 aa, Dengue virus
MVTFKVPHA

SEQ ID NO: 264681 - protein, 9 aa, Dengue virus
ITLATGPLS

SEQ ID NO: 264682 - protein, 9 aa, Dengue virus
VVRLLTKPW

SEQ ID NO: 264683 - protein, 9 aa, Dengue virus
LTIMDLHPG

SEQ ID NO: 264684 - protein, 9 aa, Dengue virus
WNTTIAVSM

SEQ ID NO: 264685 - protein, 9 aa, Dengue virus
YFHRRDLRL

SEQ ID NO: 264686 - protein, 9 aa, Dengue virus
LRTTTASGK

SEQ ID NO: 264687 - protein, 9 aa, Dengue virus
IRYQTTAVK

SEQ ID NO: 264688 - protein, 9 aa, Dengue virus
VNMTSKMLL

SEQ ID NO: 264689 - protein, 9 aa, Dengue virus
YRILQRGLL

SEQ ID NO: 264690 - protein, 9 aa, Dengue virus
VCYVLSGSS

SEQ ID NO: 264691 - protein, 9 aa, Dengue virus
ILLMRTSWA

SEQ ID NO: 264692 - protein, 9 aa, Dengue virus
LLMMRTTWA

SEQ ID NO: 264693 - protein, 9 aa, Dengue virus
TMRLLSPVR

SEQ ID NO: 264694 - protein, 9 aa, Dengue virus
GFGIFTTNI

SEQ ID NO: 264695 - protein, 9 aa, Dengue virus
VREALKRRL

SEQ ID NO: 264696 - protein, 9 aa, Dengue virus
YAQMWQLMY

SEQ ID NO: 264697 - protein, 9 aa, Dengue virus
WKLARASFI

SEQ ID NO: 264698 - protein, 9 aa, Dengue virus
YQNKVVRVQ

SEQ ID NO: 264699 - protein, 9 aa, Dengue virus
LNTFTNMEV

SEQ ID NO: 264700 - protein, 9 aa, Dengue virus
GFGVFSTNI

SEQ ID NO: 264701 - protein, 9 aa, Dengue virus
IRYQTTAIK

SEQ ID NO: 264702 - protein, 9 aa, Dengue virus
YQNKVVKVL

SEQ ID NO: 264703 - protein, 9 aa, Dengue virus
WCNATSAWV

SEQ ID NO: 264704 - protein, 9 aa, Dengue virus
FQADSPKRL

SEQ ID NO: 264705 - protein, 9 aa, Dengue virus
CHATFTTRL

SEQ ID NO: 264706 - protein, 9 aa, Dengue virus
VKRFSTGLL

SEQ ID NO: 264707 - protein, 9 aa, Dengue virus
LRMVLAFIT

SEQ ID NO: 264708 - protein, 9 aa, Dengue virus
VVKLLTKPW

SEQ ID NO: 264709 - protein, 9 aa, Dengue virus
TKRILPSIV

SEQ ID NO: 264710 - protein, 9 aa, Dengue virus
TIENSTANV

SEQ ID NO: 264711 - protein, 9 aa, Dengue virus
FTNMEAQLI

SEQ ID NO: 264712 - protein, 9 aa, Dengue virus
IRYQTPAIR

SEQ ID NO: 264713 - protein, 9 aa, Dengue virus
FTRKVRSNA

SEQ ID NO: 264714 - protein, 9 aa, Dengue virus
WMVHRQWFF

SEQ ID NO: 264715 - protein, 9 aa, Dengue virus
WSIHAHHQW

SEQ ID NO: 264716 - protein, 9 aa, Dengue virus
TRRYLPAMV

SEQ ID NO: 264717 - protein, 9 aa, Dengue virus
NIVSSVNTI

SEQ ID NO: 264718 - protein, 9 aa, Dengue virus
TIITPMLRH

SEQ ID NO: 264719 - protein, 9 aa, Dengue virus
LKGMPIRYQ

SEQ ID NO: 264720 - protein, 9 aa, Dengue virus
FLRVLSIPP

SEQ ID NO: 264721 - protein, 9 aa, Dengue virus
WKLARASFI

SEQ ID NO: 264722 - protein, 9 aa, Dengue virus
LILAPTRVV

SEQ ID NO: 264723 - protein, 9 aa, Dengue virus
VWFVPSIKS

SEQ ID NO: 264724 - protein, 9 aa, Dengue virus
YGWNLVKLH

SEQ ID NO: 264725 - protein, 9 aa, Dengue virus
YFHRRDLRL

SEQ ID NO: 264726 - protein, 9 aa, Dengue virus
IRYQTPAVK

SEQ ID NO: 264727 - protein, 9 aa, Dengue virus
RLMSAAIKD

SEQ ID NO: 264728 - protein, 9 aa, Dengue virus
FQADSPKKL

SEQ ID NO: 264729 - protein, 9 aa, Dengue virus
FCEALTLAT

SEQ ID NO: 264730 - protein, 9 aa, Dengue virus
VRNRVSTVQ

SEQ ID NO: 264731 - protein, 9 aa, Dengue virus
YAQMWALMY

SEQ ID NO: 264732 - protein, 9 aa, Dengue virus
HHFHQLIMK

SEQ ID NO: 264733 - protein, 9 aa, Dengue virus
YVLSGSSAD

SEQ ID NO: 264734 - protein, 9 aa, Dengue virus
VSILLSSLL

SEQ ID NO: 264735 - protein, 9 aa, Dengue virus
ISRMLLNRF

SEQ ID NO: 264736 - protein, 9 aa, Dengue virus
IREAIKRKL

SEQ ID NO: 264737 - protein, 9 aa, Dengue virus
YQHALSELP

SEQ ID NO: 264738 - protein, 9 aa, Dengue virus
CIKVLNPYM

SEQ ID NO: 264739 - protein, 9 aa, Dengue virus
WLAYKVASE

SEQ ID NO: 264740 - protein, 9 aa, Dengue virus
TRRYLPAMV

SEQ ID NO: 264741 - protein, 9 aa, Dengue virus
CIKVLNPYM

SEQ ID NO: 264742 - protein, 9 aa, Dengue virus
WTLMYFHRR

SEQ ID NO: 264743 - protein, 9 aa, Dengue virus
VSILLSSLL

SEQ ID NO: 264744 - protein, 9 aa, Dengue virus
FQADSPKRL

SEQ ID NO: 264745 - protein, 9 aa, Dengue virus
SVNMVSRML

SEQ ID NO: 264746 - protein, 9 aa, Dengue virus
IVSAVNMTS

SEQ ID NO: 264747 - protein, 9 aa, Dengue virus
QLIMKDGRV

SEQ ID NO: 264748 - protein, 9 aa, Dengue virus
SRTIRVLKM

SEQ ID NO: 264749 - protein, 9 aa, Dengue virus
YISTRVEMG

SEQ ID NO: 264750 - protein, 9 aa, Dengue virus
ITLATGPLS

SEQ ID NO: 264751 - protein, 9 aa, Dengue virus
WLSYKVASA

SEQ ID NO: 264752 - protein, 9 aa, Dengue virus
LIGLSSRAT

SEQ ID NO: 264753 - protein, 9 aa, Dengue virus
IFITDNVHT

SEQ ID NO: 264754 - protein, 9 aa, Dengue virus
IVSSVNTIS

SEQ ID NO: 264755 - protein, 9 aa, Dengue virus
IAKSKPTLD

SEQ ID NO: 264756 - protein, 9 aa, Dengue virus
FCEVLTLAT

SEQ ID NO: 264757 - protein, 9 aa, Dengue virus
TRKYLPAII

SEQ ID NO: 264758 - protein, 9 aa, Dengue virus
FQADSPKRL

SEQ ID NO: 264759 - protein, 9 aa, Dengue virus
IVSSVNMIS

SEQ ID NO: 264760 - protein, 9 aa, Dengue virus
GFGMFSTNI

SEQ ID NO: 264761 - protein, 9 aa, Dengue virus
YYCAGLKKV

SEQ ID NO: 264762 - protein, 9 aa, Dengue virus
VRTNAAIGA

SEQ ID NO: 264763 - protein, 9 aa, Dengue virus
LKRRLRTLI

SEQ ID NO: 264764 - protein, 9 aa, Dengue virus
VLTLATGPV

SEQ ID NO: 264765 - protein, 9 aa, Dengue virus
VRSNAALGA

SEQ ID NO: 264766 - protein, 9 aa, Dengue virus
FCSHHFHKI

SEQ ID NO: 264767 - protein, 9 aa, Dengue virus
VRSNAAMGA

SEQ ID NO: 264768 - protein, 9 aa, Dengue virus
ILLMRTSWA

SEQ ID NO: 264769 - protein, 9 aa, Dengue virus
TMAKNKPTL

SEQ ID NO: 264770 - protein, 9 aa, Dengue virus
LRTLILAPT

SEQ ID NO: 264771 - protein, 9 aa, Dengue virus
LVTFKNPHA

SEQ ID NO: 264772 - protein, 9 aa, Dengue virus
WLAYKVASE

SEQ ID NO: 264773 - protein, 9 aa, Dengue virus
FQADSPKRL

SEQ ID NO: 264774 - protein, 9 aa, Dengue virus
LTIMDLHPG

SEQ ID NO: 264775 - protein, 9 aa, Dengue virus
KFWNTTIAV

SEQ ID NO: 264776 - protein, 9 aa, Dengue virus
FGKGSLVTC

SEQ ID NO: 264777 - protein, 9 aa, Dengue virus
LILAPTRVV

SEQ ID NO: 264778 - protein, 9 aa, Dengue virus
FGKAKGSRA

SEQ ID NO: 264779 - protein, 9 aa, Dengue virus
AVSRGTAKL

SEQ ID NO: 264780 - protein, 9 aa, Dengue virus
TIVTPMLRH

SEQ ID NO: 264781 - protein, 9 aa, Dengue virus
VVLMGLGRG

SEQ ID NO: 264782 - protein, 9 aa, Dengue virus
ITLATGPLS

SEQ ID NO: 264783 - protein, 9 aa, Dengue virus
TFITPMMRH

SEQ ID NO: 264784 - protein, 9 aa, Dengue virus
LNGKGPLRM

SEQ ID NO: 264785 - protein, 9 aa, Dengue virus
LFSGQGPMK

SEQ ID NO: 264786 - protein, 9 aa, Dengue virus
LVAFLRFLA

SEQ ID NO: 264787 - protein, 9 aa, Dengue virus
WMTTEDMLT

SEQ ID NO: 264788 - protein, 9 aa, Dengue virus
AVSRGTAKL

SEQ ID NO: 264789 - protein, 9 aa, Dengue virus
LRLASNAIC

SEQ ID NO: 264790 - protein, 9 aa, Dengue virus
WNTTIAVST

SEQ ID NO: 264791 - protein, 9 aa, Dengue virus
WLAHKVASE

SEQ ID NO: 264792 - protein, 9 aa, Dengue virus
HRMDIGVPL

SEQ ID NO: 264793 - protein, 9 aa, Dengue virus
YMWLGARYL

SEQ ID NO: 264794 - protein, 9 aa, Dengue virus
VWFVPSIKA

SEQ ID NO: 264795 - protein, 9 aa, Dengue virus
LLRNDVPMA

SEQ ID NO: 264796 - protein, 9 aa, Dengue virus
KRKLRTLIL

SEQ ID NO: 264797 - protein, 9 aa, Dengue virus
LIGLTARAT

SEQ ID NO: 264798 - protein, 9 aa, Dengue virus
VITLATGPL

SEQ ID NO: 264799 - protein, 9 aa, Dengue virus
YKFQPESPA

SEQ ID NO: 264800 - protein, 9 aa, Dengue virus
MWHVTRGAV

SEQ ID NO: 264801 - protein, 9 aa, Dengue virus
FGKAKGSRA

SEQ ID NO: 264802 - protein, 9 aa, Dengue virus
YMWLGARYL

SEQ ID NO: 264803 - protein, 9 aa, Dengue virus
YRIKQQGIL

SEQ ID NO: 264804 - protein, 9 aa, Dengue virus
MVSILASAL

SEQ ID NO: 264805 - protein, 9 aa, Dengue virus
IANQAAVLM

SEQ ID NO: 264806 - protein, 9 aa, Dengue virus
YGWNLVKLM

SEQ ID NO: 264807 - protein, 9 aa, Dengue virus
VWFVPSIKA

SEQ ID NO: 264808 - protein, 9 aa, Dengue virus
YFHRRDLRL

SEQ ID NO: 264809 - protein, 9 aa, Dengue virus
VVSILASSF

SEQ ID NO: 264810 - protein, 9 aa, Dengue virus
YMATLKNVR

SEQ ID NO: 264811 - protein, 9 aa, Dengue virus
DLRLASMAI

SEQ ID NO: 264812 - protein, 9 aa, Dengue virus
FQPESPARV

SEQ ID NO: 264813 - protein, 9 aa, Dengue virus
WVSNASGNI

SEQ ID NO: 264814 - protein, 9 aa, Dengue virus
YGWNLVKLM

SEQ ID NO: 264815 - protein, 9 aa, Dengue virus
YAQMWQLMY

SEQ ID NO: 264816 - protein, 9 aa, Dengue virus
LNTFTNMEA

SEQ ID NO: 264817 - protein, 9 aa, Dengue virus
YGWNLVKLH

SEQ ID NO: 264818 - protein, 9 aa, Dengue virus
YYCAGLKKV

SEQ ID NO: 264819 - protein, 9 aa, Dengue virus
YAVATTIIT

SEQ ID NO: 264820 - protein, 9 aa, Dengue virus
IFITDNVHT

SEQ ID NO: 264821 - protein, 9 aa, Dengue virus
WLVHRQWFL

SEQ ID NO: 264822 - protein, 9 aa, Dengue virus
YAIIGPGLQ

SEQ ID NO: 264823 - protein, 9 aa, Dengue virus
VLLMRTTWA

SEQ ID NO: 264824 - protein, 9 aa, Dengue virus
LTIMDLHPG

SEQ ID NO: 264825 - protein, 9 aa, Dengue virus
VCYVLSGSS

SEQ ID NO: 264826 - protein, 9 aa, Dengue virus
IVASVNTTS

SEQ ID NO: 264827 - protein, 9 aa, Dengue virus
WTLMYFHRR

SEQ ID NO: 264828 - protein, 9 aa, Dengue virus
WVSGATGNI

SEQ ID NO: 264829 - protein, 9 aa, Dengue virus
YVITGTSAD

SEQ ID NO: 264830 - protein, 9 aa, Dengue virus
YTALFSGVS

SEQ ID NO: 264831 - protein, 9 aa, Dengue virus
MGLDKGWPL

SEQ ID NO: 264832 - protein, 9 aa, Dengue virus
IRYQTTATK

SEQ ID NO: 264833 - protein, 9 aa, Dengue virus
VMAFIAFLR

SEQ ID NO: 264834 - protein, 9 aa, Dengue virus
NIVSSVNMV

SEQ ID NO: 264835 - protein, 9 aa, Dengue virus
FTRKVRSNA

SEQ ID NO: 264836 - protein, 9 aa, Dengue virus
VNTTSRLLI

SEQ ID NO: 264837 - protein, 9 aa, Dengue virus
SLTAIANQA

SEQ ID NO: 264838 - protein, 9 aa, Dengue virus
NISLAAIAN

SEQ ID NO: 264839 - protein, 9 aa, Dengue virus
IANQAAILM

SEQ ID NO: 264840 - protein, 9 aa, Dengue virus
RYQTTAVKS

SEQ ID NO: 264841 - protein, 9 aa, Dengue virus
YAVATTFIT

SEQ ID NO: 264842 - protein, 9 aa, Dengue virus
WHVTRGSVI

SEQ ID NO: 264843 - protein, 9 aa, Dengue virus
IANQATVLM

SEQ ID NO: 264844 - protein, 9 aa, Dengue virus
WLSYKVASA

SEQ ID NO: 264845 - protein, 9 aa, Dengue virus
YAQMWSLMY

SEQ ID NO: 264846 - protein, 9 aa, Dengue virus
YRIKQRGIL

SEQ ID NO: 264847 - protein, 9 aa, Dengue virus
YQHALSELP

SEQ ID NO: 264848 - protein, 9 aa, Dengue virus
FCEALTLAT

SEQ ID NO: 264849 - protein, 9 aa, Dengue virus
FQPESPARL

SEQ ID NO: 264850 - protein, 9 aa, Dengue virus
WMSAEGAWR

SEQ ID NO: 264851 - protein, 9 aa, Dengue virus
QLIMKDGRV

SEQ ID NO: 264852 - protein, 9 aa, Dengue virus
VWFVPSIKT

SEQ ID NO: 264853 - protein, 9 aa, Dengue virus
LTLATGPVL

SEQ ID NO: 264854 - protein, 9 aa, Dengue virus
LNGKGPLRM

SEQ ID NO: 264855 - protein, 9 aa, Dengue virus
MINGVVRLL

SEQ ID NO: 264856 - protein, 9 aa, Dengue virus
LMRTTWALC

SEQ ID NO: 264857 - protein, 9 aa, Dengue virus
MANIFRGSY

SEQ ID NO: 264858 - protein, 9 aa, Dengue virus
FLRFLAIPP

SEQ ID NO: 264859 - protein, 9 aa, Dengue virus
VSILLSSLL

SEQ ID NO: 264860 - protein, 9 aa, Dengue virus
LASMAICSA

SEQ ID NO: 264861 - protein, 9 aa, Dengue virus
CVKVLNPYM

SEQ ID NO: 264862 - protein, 9 aa, Dengue virus
MRGAKRMAI

SEQ ID NO: 264863 - protein, 9 aa, Dengue virus
NIVSSVNMV

SEQ ID NO: 264864 - protein, 9 aa, Dengue virus
FNMLKRARN

SEQ ID NO: 264865 - protein, 9 aa, Dengue virus
LGKGWPIHR

SEQ ID NO: 264866 - protein, 9 aa, Dengue virus
FTNMEAQLI

SEQ ID NO: 264867 - protein, 9 aa, Dengue virus
TIAKSKPTL

SEQ ID NO: 264868 - protein, 9 aa, Dengue virus
LTAIANQAT

SEQ ID NO: 264869 - protein, 9 aa, Dengue virus
VMAFIAFLR

SEQ ID NO: 264870 - protein, 9 aa, Dengue virus
CVTTMAKNK

SEQ ID NO: 264871 - protein, 9 aa, Dengue virus
LAAIANQAV

SEQ ID NO: 264872 - protein, 9 aa, Dengue virus
WKLEKASFI

SEQ ID NO: 264873 - protein, 9 aa, Dengue virus
VVLMGLGRG

SEQ ID NO: 264874 - protein, 9 aa, Dengue virus
YFHRRDLRL

SEQ ID NO: 264875 - protein, 9 aa, Dengue virus
YFHRRDLRL

SEQ ID NO: 264876 - protein, 9 aa, Dengue virus
FNMLKRARN

SEQ ID NO: 264877 - protein, 9 aa, Dengue virus
FMALVAFLR

SEQ ID NO: 264878 - protein, 9 aa, Dengue virus
FGKGSLLTC

SEQ ID NO: 264879 - protein, 9 aa, Dengue virus
LLMRTSWAL

SEQ ID NO: 264880 - protein, 9 aa, Dengue virus
YVLSGSSAD

SEQ ID NO: 264881 - protein, 9 aa, Dengue virus
FHTMWHVTR

SEQ ID NO: 264882 - protein, 9 aa, Dengue virus
TRKYLPAII

SEQ ID NO: 264883 - protein, 9 aa, Dengue virus
HRMDLGVPL

SEQ ID NO: 264884 - protein, 9 aa, Dengue virus
LIGLSSRAT

SEQ ID NO: 264885 - protein, 9 aa, Dengue virus
FCEALTLAT

SEQ ID NO: 264886 - protein, 9 aa, Dengue virus
IFITNNVHT

SEQ ID NO: 264887 - protein, 9 aa, Dengue virus
IEESRTIRV

SEQ ID NO: 264888 - protein, 9 aa, Dengue virus
LSSTRVPNY

SEQ ID NO: 264889 - protein, 9 aa, Dengue virus
YWIESSKNQ

SEQ ID NO: 264890 - protein, 9 aa, Dengue virus
WVSNASGNI

SEQ ID NO: 264891 - protein, 9 aa, Dengue virus
GFGVFTTNI

SEQ ID NO: 264892 - protein, 9 aa, Dengue virus
WNTTIAVSM

SEQ ID NO: 264893 - protein, 9 aa, Dengue virus
FNMLKRERN

SEQ ID NO: 264894 - protein, 9 aa, Dengue virus
LIGLTARAT

SEQ ID NO: 264895 - protein, 9 aa, Dengue virus
YAQMWTLMY

SEQ ID NO: 264896 - protein, 9 aa, Dengue virus
VREALKRRL

SEQ ID NO: 264897 - protein, 9 aa, Dengue virus
TVLLKTALL

SEQ ID NO: 264898 - protein, 9 aa, Dengue virus
LRLAANAIC

SEQ ID NO: 264899 - protein, 9 aa, Dengue virus
YAVATTVLT

SEQ ID NO: 264900 - protein, 9 aa, Dengue virus
VRTNAAIGA

SEQ ID NO: 264901 - protein, 9 aa, Dengue virus
LTAIANQAV

SEQ ID NO: 264902 - protein, 9 aa, Dengue virus
TKRILPSIV

SEQ ID NO: 264903 - protein, 9 aa, Dengue virus
LTAIANQAT

SEQ ID NO: 264904 - protein, 9 aa, Dengue virus
FCESLTLAT

SEQ ID NO: 264905 - protein, 9 aa, Dengue virus
FKNAHAKRQ

SEQ ID NO: 264906 - protein, 9 aa, Dengue virus
YMWLGARFL

SEQ ID NO: 264907 - protein, 9 aa, Dengue virus
SLGLLSGRG

SEQ ID NO: 264908 - protein, 9 aa, Dengue virus
FIAFLRFLT

SEQ ID NO: 264909 - protein, 9 aa, Dengue virus
LVTFKNAHA

SEQ ID NO: 264910 - protein, 9 aa, Dengue virus
GSYLAGAGL

SEQ ID NO: 264911 - protein, 9 aa, Dengue virus
YLAGAGLLF

SEQ ID NO: 264912 - protein, 9 aa, Dengue virus
SLRTTTASG

SEQ ID NO: 264913 - protein, 9 aa, Dengue virus
VRSNAALGA

SEQ ID NO: 264914 - protein, 9 aa, Dengue virus
FQPESPARL

SEQ ID NO: 264915 - protein, 9 aa, Dengue virus
FCSHHFHQL

SEQ ID NO: 264916 - protein, 9 aa, Dengue virus
VSRMLLNRF

SEQ ID NO: 264917 - protein, 9 aa, Dengue virus
VVKLLTKPW

SEQ ID NO: 264918 - protein, 9 aa, Dengue virus
MFEATARGA

SEQ ID NO: 264919 - protein, 9 aa, Dengue virus
VLLMRTTWA

SEQ ID NO: 264920 - protein, 9 aa, Dengue virus
WMTTEDMLS

SEQ ID NO: 264921 - protein, 9 aa, Dengue virus
CIKILNPYM

SEQ ID NO: 264922 - protein, 9 aa, Dengue virus
IRYQTTATK

SEQ ID NO: 264923 - protein, 9 aa, Dengue virus
IKKVRTNAA

SEQ ID NO: 264924 - protein, 9 aa, Dengue virus
LSSLLKNDV

SEQ ID NO: 264925 - protein, 9 aa, Dengue virus
WQIEKASLI

SEQ ID NO: 264926 - protein, 9 aa, Dengue virus
FHRRDLRLA

SEQ ID NO: 264927 - protein, 9 aa, Dengue virus
FLRFLAIPP

SEQ ID NO: 264928 - protein, 9 aa, Dengue virus
VSRMLLNRF

SEQ ID NO: 264929 - protein, 9 aa, Dengue virus
LVKLYSGKD

SEQ ID NO: 264930 - protein, 9 aa, Dengue virus
WMTTEDMLK

SEQ ID NO: 264931 - protein, 9 aa, Dengue virus
NLVKLYSGK

SEQ ID NO: 264932 - protein, 9 aa, Dengue virus
TTIAVSMAN

SEQ ID NO: 264933 - protein, 9 aa, Dengue virus
WDVVPTVTQ

SEQ ID NO: 264934 - protein, 9 aa, Dengue virus
VFHTMWHVT

SEQ ID NO: 264935 - protein, 9 aa, Dengue virus
MRLLSPVRV

SEQ ID NO: 264936 - protein, 9 aa, Dengue virus
LKRARNRVS

SEQ ID NO: 264937 - protein, 9 aa, Dengue virus
SILASALLK

SEQ ID NO: 264938 - protein, 9 aa, Dengue virus
YLPAIIREA

SEQ ID NO: 264939 - protein, 9 aa, Dengue virus
VWFVPSIKT

SEQ ID NO: 264940 - protein, 9 aa, Dengue virus
YTTMFGGVS

SEQ ID NO: 264941 - protein, 9 aa, Dengue virus
VVRLLTKPW

SEQ ID NO: 264942 - protein, 9 aa, Dengue virus
YSQVNPLTL

SEQ ID NO: 264943 - protein, 9 aa, Dengue virus
LSGRGPLKL

SEQ ID NO: 264944 - protein, 9 aa, Dengue virus
VVSILASSF

SEQ ID NO: 264945 - protein, 9 aa, Dengue virus
LIMKDGRSL

SEQ ID NO: 264946 - protein, 9 aa, Dengue virus
FLRVLSIPP

SEQ ID NO: 264947 - protein, 9 aa, Dengue virus
YISTRVEMG

SEQ ID NO: 264948 - protein, 9 aa, Dengue virus
VTYSLNTFT

SEQ ID NO: 264949 - protein, 9 aa, Dengue virus
VEAGRTLRV

SEQ ID NO: 264950 - protein, 9 aa, Dengue virus
VNTTSRLLI

SEQ ID NO: 264951 - protein, 9 aa, Dengue virus
FQPESPARL

SEQ ID NO: 264952 - protein, 9 aa, Dengue virus
YAQMWALMY

SEQ ID NO: 264953 - protein, 9 aa, Dengue virus
SQILLMRTS

SEQ ID NO: 264954 - protein, 9 aa, Dengue virus
LIMKDGRSL

SEQ ID NO: 264955 - protein, 9 aa, Dengue virus
IEEGRTLRV

SEQ ID NO: 264956 - protein, 9 aa, Dengue virus
MVSILASAL

SEQ ID NO: 264957 - protein, 9 aa, Dengue virus
MANIFRGSY

SEQ ID NO: 264958 - protein, 9 aa, Dengue virus
LSSLLRNDV

SEQ ID NO: 264959 - protein, 9 aa, Dengue virus
SLTAIANQA

SEQ ID NO: 264960 - protein, 9 aa, Dengue virus
YRGAKRMAI

SEQ ID NO: 264961 - protein, 9 aa, Dengue virus
FQPESPSRL

SEQ ID NO: 264962 - protein, 9 aa, Dengue virus
VRSNAAMGA

SEQ ID NO: 264963 - protein, 9 aa, Dengue virus
YYMATLKNV

SEQ ID NO: 264964 - protein, 9 aa, Dengue virus
WLAYKVASE

SEQ ID NO: 264965 - protein, 9 aa, Dengue virus
LVSLLGSSL

SEQ ID NO: 264966 - protein, 9 aa, Dengue virus
TIAKNKPTL

SEQ ID NO: 264967 - protein, 9 aa, Dengue virus
YISTRVGMG

SEQ ID NO: 264968 - protein, 9 aa, Dengue virus
FQPESPARV

SEQ ID NO: 264969 - protein, 9 aa, Dengue virus
LNGKGPLRM

SEQ ID NO: 264970 - protein, 9 aa, Dengue virus
LVTFKNPHA

SEQ ID NO: 264971 - protein, 9 aa, Dengue virus
VVRLLTKPW

SEQ ID NO: 264972 - protein, 9 aa, Dengue virus
LKGMPIRYQ

SEQ ID NO: 264973 - protein, 9 aa, Dengue virus
WHVTRGAVL

SEQ ID NO: 264974 - protein, 9 aa, Dengue virus
FLRVLSIPP

SEQ ID NO: 264975 - protein, 9 aa, Dengue virus
MVTQIAMTD

SEQ ID NO: 264976 - protein, 9 aa, Dengue virus
RTTTVTGKI

SEQ ID NO: 264977 - protein, 9 aa, Dengue virus
IRYQTPAIR

SEQ ID NO: 264978 - protein, 9 aa, Dengue virus
YSQVNPITL

SEQ ID NO: 264979 - protein, 9 aa, Dengue virus
TLILAPTRV

SEQ ID NO: 264980 - protein, 9 aa, Dengue virus
ISKMLINRF

SEQ ID NO: 264981 - protein, 9 aa, Dengue virus
MGLGRGWPI

SEQ ID NO: 264982 - protein, 9 aa, Dengue virus
YKFQPESPS

SEQ ID NO: 264983 - protein, 9 aa, Dengue virus
FLRFLAIPP

SEQ ID NO: 264984 - protein, 9 aa, Dengue virus
LVTFKNPHA

SEQ ID NO: 264985 - protein, 9 aa, Dengue virus
LRTLILAPT

SEQ ID NO: 264986 - protein, 9 aa, Dengue virus
FCEVLTLAT

SEQ ID NO: 264987 - protein, 9 aa, Dengue virus
MGLGKGWPI

SEQ ID NO: 264988 - protein, 9 aa, Dengue virus
YVMTGRSAD

SEQ ID NO: 264989 - protein, 9 aa, Dengue virus
IRYQTTATK

SEQ ID NO: 264990 - protein, 9 aa, Dengue virus
YRGAKRMAI

SEQ ID NO: 264991 - protein, 9 aa, Dengue virus
MLRHSIENS

SEQ ID NO: 264992 - protein, 9 aa, Dengue virus
FQPESPKRL

SEQ ID NO: 264993 - protein, 9 aa, Dengue virus
YISTRVEMG

SEQ ID NO: 264994 - protein, 9 aa, Dengue virus
LTLATGPVS

SEQ ID NO: 264995 - protein, 9 aa, Dengue virus
LLLMRTSWA

SEQ ID NO: 264996 - protein, 9 aa, Dengue virus
WNLVKLHSG

SEQ ID NO: 264997 - protein, 9 aa, Dengue virus
TLILAPTRV

SEQ ID NO: 264998 - protein, 9 aa, Dengue virus
IENTSANLS

SEQ ID NO: 264999 - protein, 9 aa, Dengue virus
VNMTSKMLL

SEQ ID NO: 265000 - protein, 9 aa, Dengue virus
WVSNASGNI

SEQ ID NO: 265001 - protein, 9 aa, Dengue virus
FLTIPPTAG

SEQ ID NO: 265002 - protein, 9 aa, Dengue virus
FIAFLRFLA

SEQ ID NO: 265003 - protein, 9 aa, Dengue virus
LQWIASAIV

SEQ ID NO: 265004 - protein, 9 aa, Dengue virus
NIFRGSYLA

SEQ ID NO: 265005 - protein, 9 aa, Dengue virus
GFGVFTTNI

SEQ ID NO: 265006 - protein, 9 aa, Dengue virus
MVSILASAL

SEQ ID NO: 265007 - protein, 9 aa, Dengue virus
LAAIANQAT

SEQ ID NO: 265008 - protein, 9 aa, Dengue virus
IKKVRTNAA

SEQ ID NO: 265009 - protein, 9 aa, Dengue virus
YGWNLVKLY

SEQ ID NO: 265010 - protein, 9 aa, Dengue virus
IVSSVNMIS

SEQ ID NO: 265011 - protein, 9 aa, Dengue virus
TSRLLINRF

SEQ ID NO: 265012 - protein, 9 aa, Dengue virus
IENTSANLS

SEQ ID NO: 265013 - protein, 9 aa, Dengue virus
YLPAIVREA

SEQ ID NO: 265014 - protein, 9 aa, Dengue virus
LVTFKNPHA

SEQ ID NO: 265015 - protein, 9 aa, Dengue virus
FLRFLTIPP

SEQ ID NO: 265016 - protein, 9 aa, Dengue virus
TRKYLPAIV

SEQ ID NO: 265017 - protein, 9 aa, Dengue virus
IANQATVLM

SEQ ID NO: 265018 - protein, 9 aa, Dengue virus
YAVATTFIT

SEQ ID NO: 265019 - protein, 9 aa, Dengue virus
VSQLAKRFS

SEQ ID NO: 265020 - protein, 9 aa, Dengue virus
LMRTSWAFC

SEQ ID NO: 265021 - protein, 9 aa, Dengue virus
LSGRGPLKL

SEQ ID NO: 265022 - protein, 9 aa, Dengue virus
IRYQTTAVK

SEQ ID NO: 265023 - protein, 9 aa, Dengue virus
YAQMWALMY

SEQ ID NO: 265024 - protein, 9 aa, Dengue virus
WAFCESLTL

SEQ ID NO: 265025 - protein, 9 aa, Dengue virus
WHVTRGAVL

SEQ ID NO: 265026 - protein, 9 aa, Dengue virus
TIENTSANL

SEQ ID NO: 265027 - protein, 9 aa, Dengue virus
WMTTEDMLS

SEQ ID NO: 265028 - protein, 9 aa, Dengue virus
SLTAIANQA

SEQ ID NO: 265029 - protein, 9 aa, Dengue virus
IRRGLRTLI

SEQ ID NO: 265030 - protein, 9 aa, Dengue virus
IRYQTTAIK

SEQ ID NO: 265031 - protein, 9 aa, Dengue virus
YVITGTSAD

SEQ ID NO: 265032 - protein, 9 aa, Dengue virus
LAKRFSKGL

SEQ ID NO: 265033 - protein, 9 aa, Dengue virus
VWFVPSIKT

SEQ ID NO: 265034 - protein, 9 aa, Dengue virus
IFMTATPPG

SEQ ID NO: 265035 - protein, 9 aa, Dengue virus
IEEGRTLRV

SEQ ID NO: 265036 - protein, 9 aa, Dengue virus
WNTTIAVSM

SEQ ID NO: 265037 - protein, 9 aa, Dengue virus
CIKVLNPYM

SEQ ID NO: 265038 - protein, 9 aa, Dengue virus
CHATFTTRL

SEQ ID NO: 265039 - protein, 9 aa, Dengue virus
LTAIANQAT

SEQ ID NO: 265040 - protein, 9 aa, Dengue virus
FLRFLTIPP

SEQ ID NO: 265041 - protein, 9 aa, Dengue virus
IVSILASSL

SEQ ID NO: 265042 - protein, 9 aa, Dengue virus
WLAYKVASE

SEQ ID NO: 265043 - protein, 9 aa, Dengue virus
IRYQTTAVK

SEQ ID NO: 265044 - protein, 9 aa, Dengue virus
LILAPTRVV

SEQ ID NO: 265045 - protein, 9 aa, Dengue virus
HHFHKIFMK

SEQ ID NO: 265046 - protein, 9 aa, Dengue virus
YAVATTVLT

SEQ ID NO: 265047 - protein, 9 aa, Dengue virus
TFITPMLRH

SEQ ID NO: 265048 - protein, 9 aa, Dengue virus
YFHRRDLRL

SEQ ID NO: 265049 - protein, 9 aa, Dengue virus
MINGVVRLL

SEQ ID NO: 265050 - protein, 9 aa, Dengue virus
VCYVLSGSS

SEQ ID NO: 265051 - protein, 9 aa, Dengue virus
VCYVLSGSS

SEQ ID NO: 265052 - protein, 9 aa, Dengue virus
IRYQTPAIR

SEQ ID NO: 265053 - protein, 9 aa, Dengue virus
YFHRRDLRL

SEQ ID NO: 265054 - protein, 9 aa, Dengue virus
TRRYLPAMV

SEQ ID NO: 265055 - protein, 9 aa, Dengue virus
SVNTTSRLL

SEQ ID NO: 265056 - protein, 9 aa, Dengue virus
VSRGSAKIR

SEQ ID NO: 265057 - protein, 9 aa, Dengue virus
YSLNTFTNM

SEQ ID NO: 265058 - protein, 9 aa, Dengue virus
FKLTYQNKV

SEQ ID NO: 265059 - protein, 9 aa, Dengue virus
YGWNLVKLH

SEQ ID NO: 265060 - protein, 9 aa, Dengue virus
WHVTRGSVI

SEQ ID NO: 265061 - protein, 9 aa, Dengue virus
MVSILASAL

SEQ ID NO: 265062 - protein, 9 aa, Dengue virus
IFVADNVHT

SEQ ID NO: 265063 - protein, 9 aa, Dengue virus
LLMMRTTWA

SEQ ID NO: 265064 - protein, 9 aa, Dengue virus
FCSHHFHQL

SEQ ID NO: 265065 - protein, 9 aa, Dengue virus
TTIVTPMLR

SEQ ID NO: 265066 - protein, 9 aa, Dengue virus
YGWNLVKLY

SEQ ID NO: 265067 - protein, 9 aa, Dengue virus
VWFVPSIKT

SEQ ID NO: 265068 - protein, 9 aa, Dengue virus
KRFSRGMLQ

SEQ ID NO: 265069 - protein, 9 aa, Dengue virus
TKRILPSIV

SEQ ID NO: 265070 - protein, 9 aa, Dengue virus
LAAIANQAA

SEQ ID NO: 265071 - protein, 9 aa, Dengue virus
YGWNLVRLQ

SEQ ID NO: 265072 - protein, 9 aa, Dengue virus
LVMKDGRKL

SEQ ID NO: 265073 - protein, 9 aa, Dengue virus
FKLTYQNKV

SEQ ID NO: 265074 - protein, 9 aa, Dengue virus
WNTTIAVST

SEQ ID NO: 265075 - protein, 9 aa, Dengue virus
GCYSQVNPI

SEQ ID NO: 265076 - protein, 9 aa, Dengue virus
LVTFKTAHA

SEQ ID NO: 265077 - protein, 9 aa, Dengue virus
TIENTSANL

SEQ ID NO: 265078 - protein, 9 aa, Dengue virus
YISTRVGMG

SEQ ID NO: 265079 - protein, 9 aa, Dengue virus
YVITGTSAD

SEQ ID NO: 265080 - protein, 9 aa, Dengue virus
SRTIRVLKM

SEQ ID NO: 265081 - protein, 9 aa, Dengue virus
VFHTMWHVT

SEQ ID NO: 265082 - protein, 9 aa, Dengue virus
FTNMEVQLI

SEQ ID NO: 265083 - protein, 9 aa, Dengue virus
TIENTTANI

SEQ ID NO: 265084 - protein, 9 aa, Dengue virus
YMWLGARFL

SEQ ID NO: 265085 - protein, 9 aa, Dengue virus
WVSNASGNI

SEQ ID NO: 265086 - protein, 9 aa, Dengue virus
WLVHKQWFL

SEQ ID NO: 265087 - protein, 9 aa, Dengue virus
LILAPTRVV

SEQ ID NO: 265088 - protein, 9 aa, Dengue virus
WNTTIAVSM

SEQ ID NO: 265089 - protein, 9 aa, Dengue virus
YAVATTFIT

SEQ ID NO: 265090 - protein, 9 aa, Dengue virus
TRLLSSTRV

SEQ ID NO: 265091 - protein, 9 aa, Dengue virus
IRYQTPAVK

SEQ ID NO: 265092 - protein, 9 aa, Dengue virus
WNTTIAVST

SEQ ID NO: 265093 - protein, 9 aa, Dengue virus
IRRGLRTLI

SEQ ID NO: 265094 - protein, 9 aa, Dengue virus
SQILLMRTS

SEQ ID NO: 265095 - protein, 9 aa, Dengue virus
YSQVNPLTL

SEQ ID NO: 265096 - protein, 9 aa, Dengue virus
IAVSMANIF

SEQ ID NO: 265097 - protein, 9 aa, Dengue virus
VWFVPSIKS

SEQ ID NO: 265098 - protein, 9 aa, Dengue virus
YAQMWSLMY

SEQ ID NO: 265099 - protein, 9 aa, Dengue virus
TTTVSGKLI

SEQ ID NO: 265100 - protein, 9 aa, Dengue virus
VRSNAAIGA

SEQ ID NO: 265101 - protein, 9 aa, Dengue virus
LLRNDVPLA

SEQ ID NO: 265102 - protein, 9 aa, Dengue virus
CHATFTMRL

SEQ ID NO: 265103 - protein, 9 aa, Dengue virus
YAQMWALMY

SEQ ID NO: 265104 - protein, 9 aa, Dengue virus
YGVLFSGVS

SEQ ID NO: 265105 - protein, 9 aa, Dengue virus
LRGLPIRYQ

SEQ ID NO: 265106 - protein, 9 aa, Dengue virus
LMRTSWAFC

SEQ ID NO: 265107 - protein, 9 aa, Dengue virus
YKFQPESPA

SEQ ID NO: 265108 - protein, 9 aa, Dengue virus
LILAPTRVV

SEQ ID NO: 265109 - protein, 9 aa, Dengue virus
FGRAKGSRA

SEQ ID NO: 265110 - protein, 9 aa, Dengue virus
VRSNAALGA

SEQ ID NO: 265111 - protein, 9 aa, Dengue virus
VKRFSSELL

SEQ ID NO: 265112 - protein, 9 aa, Dengue virus
YGVLFSGVS

SEQ ID NO: 265113 - protein, 9 aa, Dengue virus
SVNMISRML

SEQ ID NO: 265114 - protein, 9 aa, Dengue virus
YAQMWTLMY

SEQ ID NO: 265115 - protein, 9 aa, Dengue virus
VLSIPPTAG

SEQ ID NO: 265116 - protein, 9 aa, Dengue virus
YSQVNPLTL

SEQ ID NO: 265117 - protein, 9 aa, Dengue virus
SQILLMRTS

SEQ ID NO: 265118 - protein, 9 aa, Dengue virus
CVKVLNPYM

SEQ ID NO: 265119 - protein, 9 aa, Dengue virus
LLMRTSWAF

SEQ ID NO: 265120 - protein, 9 aa, Dengue virus
SVNMISRML

SEQ ID NO: 265121 - protein, 9 aa, Dengue virus
VWFVPSIKA

SEQ ID NO: 265122 - protein, 9 aa, Dengue virus
FLAIPPTAG

SEQ ID NO: 265123 - protein, 9 aa, Dengue virus
LFGKGSLLT

SEQ ID NO: 265124 - protein, 9 aa, Dengue virus
ITFLRVLSI

SEQ ID NO: 265125 - protein, 9 aa, Dengue virus
LIGLTSRAT

SEQ ID NO: 265126 - protein, 9 aa, Dengue virus
FQADSPKRL

SEQ ID NO: 265127 - protein, 9 aa, Dengue virus
VWFVPSIKS

SEQ ID NO: 265128 - protein, 9 aa, Dengue virus
CVKILNPYM

SEQ ID NO: 265129 - protein, 9 aa, Dengue virus
VNTTSRLLL

SEQ ID NO: 265130 - protein, 9 aa, Dengue virus
LRLAANAIC

SEQ ID NO: 265131 - protein, 9 aa, Dengue virus
FSGQGPMKL

SEQ ID NO: 265132 - protein, 9 aa, Dengue virus
YGWNLVRLQ

SEQ ID NO: 265133 - protein, 9 aa, Dengue virus
WNTTIAVSM

SEQ ID NO: 265134 - protein, 9 aa, Dengue virus
RYQTTAIKA

SEQ ID NO: 265135 - protein, 9 aa, Dengue virus
LIGLSSRAT

SEQ ID NO: 265136 - protein, 9 aa, Dengue virus
YAQMWALMY

SEQ ID NO: 265137 - protein, 9 aa, Dengue virus
FTMRLLSPV

SEQ ID NO: 265138 - protein, 9 aa, Dengue virus
MMRTTWALC

SEQ ID NO: 265139 - protein, 9 aa, Dengue virus
VFTTNIWLK

SEQ ID NO: 265140 - protein, 9 aa, Dengue virus
IRRGLRTLI

SEQ ID NO: 265141 - protein, 9 aa, Dengue virus
FLTIPPTAG

SEQ ID NO: 265142 - protein, 9 aa, Dengue virus
TRLLSSTRV

SEQ ID NO: 265143 - protein, 9 aa, Dengue virus
SQILLMRTT

SEQ ID NO: 265144 - protein, 9 aa, Dengue virus
VVSILASSF

SEQ ID NO: 265145 - protein, 9 aa, Dengue virus
LRLAANAIC

SEQ ID NO: 265146 - protein, 9 aa, Dengue virus
IRYQTPAIR

SEQ ID NO: 265147 - protein, 9 aa, Dengue virus
YAVATTIIT

SEQ ID NO: 265148 - protein, 9 aa, Dengue virus
LVTFKNAHA

SEQ ID NO: 265149 - protein, 9 aa, Dengue virus
YFHRRDLRL

SEQ ID NO: 265150 - protein, 9 aa, Dengue virus
LKRVRNRVS

SEQ ID NO: 265151 - protein, 9 aa, Dengue virus
VNMVSRMLL

SEQ ID NO: 265152 - protein, 9 aa, Dengue virus
ITLATGPLS

SEQ ID NO: 265153 - protein, 9 aa, Dengue virus
LTIMDLHPG

SEQ ID NO: 265154 - protein, 9 aa, Dengue virus
VQLLLMRTS

SEQ ID NO: 265155 - protein, 9 aa, Dengue virus
FGRAKGSRA

SEQ ID NO: 265156 - protein, 9 aa, Dengue virus
RYQTTAVKS

SEQ ID NO: 265157 - protein, 9 aa, Dengue virus
WKLARASFI

SEQ ID NO: 265158 - protein, 9 aa, Dengue virus
IVSSVNTIS

SEQ ID NO: 265159 - protein, 9 aa, Dengue virus
IFITNNVHT

SEQ ID NO: 265160 - protein, 9 aa, Dengue virus
IRYQTTAIK

SEQ ID NO: 265161 - protein, 9 aa, Dengue virus
TRLLSSTRV

SEQ ID NO: 265162 - protein, 9 aa, Dengue virus
FLRVLSIPP

SEQ ID NO: 265163 - protein, 9 aa, Dengue virus
SQILLMRTT

SEQ ID NO: 265164 - protein, 9 aa, Dengue virus
FCEVLTLAT

SEQ ID NO: 265165 - protein, 9 aa, Dengue virus
WKLARASFI

SEQ ID NO: 265166 - protein, 9 aa, Dengue virus
VRTNAAIGA

SEQ ID NO: 265167 - protein, 9 aa, Dengue virus
FCKKVRSNA

SEQ ID NO: 265168 - protein, 9 aa, Dengue virus
TIITPMLRH

SEQ ID NO: 265169 - protein, 9 aa, Dengue virus
STRVPNYNL

SEQ ID NO: 265170 - protein, 9 aa, Dengue virus
LIGLTSRAT

SEQ ID NO: 265171 - protein, 9 aa, Dengue virus
FCEVLTLAT

SEQ ID NO: 265172 - protein, 9 aa, Dengue virus
IRYQTPAVK

SEQ ID NO: 265173 - protein, 9 aa, Dengue virus
FLRFLTIPP

SEQ ID NO: 265174 - protein, 9 aa, Dengue virus
LTIMDLHPG

SEQ ID NO: 265175 - protein, 9 aa, Dengue virus
IVSAVNMTS

SEQ ID NO: 265176 - protein, 9 aa, Dengue virus
FLRVLSIPP

SEQ ID NO: 265177 - protein, 9 aa, Dengue virus
LMRTSWAFC

SEQ ID NO: 265178 - protein, 9 aa, Dengue virus
FTNMEAQLI

SEQ ID NO: 265179 - protein, 9 aa, Dengue virus
TLILAPTRV

SEQ ID NO: 265180 - protein, 9 aa, Dengue virus
LRTLILAPT

SEQ ID NO: 265181 - protein, 9 aa, Dengue virus
FHTMWHVTR

SEQ ID NO: 265182 - protein, 9 aa, Dengue virus
FQADSPKRL

SEQ ID NO: 265183 - protein, 9 aa, Dengue virus
LVTFKNPHA

SEQ ID NO: 265184 - protein, 9 aa, Dengue virus
LRTLILAPT

SEQ ID NO: 265185 - protein, 9 aa, Dengue virus
FLTIPPTAG

SEQ ID NO: 265186 - protein, 9 aa, Dengue virus
YYMATLKNV

SEQ ID NO: 265187 - protein, 9 aa, Dengue virus
IRYQTPAIR

SEQ ID NO: 265188 - protein, 9 aa, Dengue virus
FGRAKGSRA

SEQ ID NO: 265189 - protein, 9 aa, Dengue virus
YKFQPESPK

SEQ ID NO: 265190 - protein, 9 aa, Dengue virus
IKKVRTNAA

SEQ ID NO: 265191 - protein, 9 aa, Dengue virus
VSILLSSLL

SEQ ID NO: 265192 - protein, 9 aa, Dengue virus
WAFCESLTL

SEQ ID NO: 265193 - protein, 9 aa, Dengue virus
FKLTYQNKV

SEQ ID NO: 265194 - protein, 9 aa, Dengue virus
VLTLATGPI

SEQ ID NO: 265195 - protein, 9 aa, Dengue virus
VRSNAALGA

SEQ ID NO: 265196 - protein, 9 aa, Dengue virus
FTTNIWLRL

SEQ ID NO: 265197 - protein, 9 aa, Dengue virus
VRSNAALGA

SEQ ID NO: 265198 - protein, 9 aa, Dengue virus
MMRTTWALC

SEQ ID NO: 265199 - protein, 9 aa, Dengue virus
ISRMLLNRF

SEQ ID NO: 265200 - protein, 9 aa, Dengue virus
VNMISRMLI

SEQ ID NO: 265201 - protein, 9 aa, Dengue virus
YLPAIVREA

SEQ ID NO: 265202 - protein, 9 aa, Dengue virus
YAVATTFIT

SEQ ID NO: 265203 - protein, 9 aa, Dengue virus
YSQVNPLTL

SEQ ID NO: 265204 - protein, 9 aa, Dengue virus
ISRMLLNRF

SEQ ID NO: 265205 - protein, 9 aa, Dengue virus
LRTLILAPT

SEQ ID NO: 265206 - protein, 9 aa, Dengue virus
LRLAANAIC

SEQ ID NO: 265207 - protein, 9 aa, Dengue virus
LVAFLRFLA

SEQ ID NO: 265208 - protein, 9 aa, Dengue virus
SQILLMRTS

SEQ ID NO: 265209 - protein, 9 aa, Dengue virus
TRLLSSTRV

SEQ ID NO: 265210 - protein, 9 aa, Dengue virus
LVSLLGSSL

SEQ ID NO: 265211 - protein, 9 aa, Dengue virus
LIGLTSRAT

SEQ ID NO: 265212 - protein, 9 aa, Dengue virus
YAVATTVLT

SEQ ID NO: 265213 - protein, 9 aa, Dengue virus
YKFQADSPK

SEQ ID NO: 265214 - protein, 9 aa, Dengue virus
SLGLLSGRG

SEQ ID NO: 265215 - protein, 9 aa, Dengue virus
WLSYKVASA

SEQ ID NO: 265216 - protein, 9 aa, Dengue virus
INKVRSNAA

SEQ ID NO: 265217 - protein, 9 aa, Dengue virus
VNMISRMLL

SEQ ID NO: 265218 - protein, 9 aa, Dengue virus
LKRVRNRVS

SEQ ID NO: 265219 - protein, 9 aa, Dengue virus
VRLQSGVDV

SEQ ID NO: 265220 - protein, 9 aa, Dengue virus
LIGLSSRAT

SEQ ID NO: 265221 - protein, 9 aa, Dengue virus
YKFQPESPA

SEQ ID NO: 265222 - protein, 9 aa, Dengue virus
WFSRGNSLS

SEQ ID NO: 265223 - protein, 9 aa, Dengue virus
IRYQTPAIR

SEQ ID NO: 265224 - protein, 9 aa, Dengue virus
VLTLATGPI

SEQ ID NO: 265225 - protein, 9 aa, Dengue virus
LLMRTSWAF

SEQ ID NO: 265226 - protein, 9 aa, Dengue virus
IFVIDNVHT

SEQ ID NO: 265227 - protein, 9 aa, Dengue virus
IVSILASSL

SEQ ID NO: 265228 - protein, 9 aa, Dengue virus
KRFSLGLLS

SEQ ID NO: 265229 - protein, 9 aa, Dengue virus
FQADSPKKL

SEQ ID NO: 265230 - protein, 9 aa, Dengue virus
WAFCESLTL

SEQ ID NO: 265231 - protein, 9 aa, Dengue virus
FQADSPKKL

SEQ ID NO: 265232 - protein, 9 aa, Dengue virus
TMRLLSPVR

SEQ ID NO: 265233 - protein, 9 aa, Dengue virus
LMMRTTWAL

SEQ ID NO: 265234 - protein, 9 aa, Dengue virus
LIGLTSRAT

SEQ ID NO: 265235 - protein, 9 aa, Dengue virus
AVSMANIFR

SEQ ID NO: 265236 - protein, 9 aa, Dengue virus
YAVATTVLT

SEQ ID NO: 265237 - protein, 9 aa, Dengue virus
YSQVNPLTL

SEQ ID NO: 265238 - protein, 9 aa, Dengue virus
FLRFLAIPP

SEQ ID NO: 265239 - protein, 9 aa, Dengue virus
YAVATTIIT

SEQ ID NO: 265240 - protein, 9 aa, Dengue virus
MMRTTWALC

SEQ ID NO: 265241 - protein, 9 aa, Dengue virus
RFLAIPPTA

SEQ ID NO: 265242 - protein, 9 aa, Dengue virus
LRTLVLAPT

SEQ ID NO: 265243 - protein, 9 aa, Dengue virus
LNTFTNMEA

SEQ ID NO: 265244 - protein, 9 aa, Dengue virus
RYQTTAVKS

SEQ ID NO: 265245 - protein, 9 aa, Dengue virus
FQADSPKRL

SEQ ID NO: 265246 - protein, 9 aa, Dengue virus
YFHRRDLRL

SEQ ID NO: 265247 - protein, 9 aa, Dengue virus
LMRTSWAFC

SEQ ID NO: 265248 - protein, 9 aa, Dengue virus
YAQMWTLMY

SEQ ID NO: 265249 - protein, 9 aa, Dengue virus
YFHRRDLRL

SEQ ID NO: 265250 - protein, 9 aa, Dengue virus
WAFCEALTL

SEQ ID NO: 265251 - protein, 9 aa, Dengue virus
YISTRVEMG

SEQ ID NO: 265252 - protein, 9 aa, Dengue virus
YAQMWSLMY

SEQ ID NO: 265253 - protein, 9 aa, Dengue virus
LKGLPIRYQ

SEQ ID NO: 265254 - protein, 9 aa, Dengue virus
YGWNIVKLM

SEQ ID NO: 265255 - protein, 9 aa, Dengue virus
IVSILASSL

SEQ ID NO: 265256 - protein, 9 aa, Dengue virus
IVSILASSL

SEQ ID NO: 265257 - protein, 9 aa, Dengue virus
LRLASMAIC

SEQ ID NO: 265258 - protein, 9 aa, Dengue virus
SVNMVSRML

SEQ ID NO: 265259 - protein, 9 aa, Dengue virus
LIGLTSRAT

SEQ ID NO: 265260 - protein, 9 aa, Dengue virus
LVTFKNPHA

SEQ ID NO: 265261 - protein, 9 aa, Dengue virus
IVSAVNMTS

SEQ ID NO: 265262 - protein, 9 aa, Dengue virus
YGWNLVRLQ

SEQ ID NO: 265263 - protein, 9 aa, Dengue virus
YSQVNPLTL

SEQ ID NO: 265264 - protein, 9 aa, Dengue virus
YYMATLKNV

SEQ ID NO: 265265 - protein, 9 aa, Dengue virus
CIKVLNPYM

SEQ ID NO: 265266 - protein, 9 aa, Dengue virus
WAFCESLTL

SEQ ID NO: 265267 - protein, 9 aa, Dengue virus
FLRVLSIPP

SEQ ID NO: 265268 - protein, 9 aa, Dengue virus
VFHTMWHVT

SEQ ID NO: 265269 - protein, 9 aa, Dengue virus
VKRFSTGLL

SEQ ID NO: 265270 - protein, 9 aa, Dengue virus
YGWNLVKLH

SEQ ID NO: 265271 - protein, 9 aa, Dengue virus
FQPESPKRL

SEQ ID NO: 265272 - protein, 9 aa, Dengue virus
VRSNAAMGA

SEQ ID NO: 265273 - protein, 9 aa, Dengue virus
IFMTATPPG

SEQ ID NO: 265274 - protein, 9 aa, Dengue virus
YKFQADSPS

SEQ ID NO: 265275 - protein, 9 aa, Dengue virus
FGKGSLITC

SEQ ID NO: 265276 - protein, 9 aa, Dengue virus
YLPAIVREA

SEQ ID NO: 265277 - protein, 9 aa, Dengue virus
VSILLSSLL

SEQ ID NO: 265278 - protein, 9 aa, Dengue virus
ITLATGPLS

SEQ ID NO: 265279 - protein, 9 aa, Dengue virus
PIRYQTTAV

SEQ ID NO: 265280 - protein, 9 aa, Dengue virus
MMRTTWALC

SEQ ID NO: 265281 - protein, 9 aa, Dengue virus
IFRGSYLAG

SEQ ID NO: 265282 - protein, 9 aa, Dengue virus
YAQMWTLMY

SEQ ID NO: 265283 - protein, 9 aa, Dengue virus
FLRFLTIPP

SEQ ID NO: 265284 - protein, 9 aa, Dengue virus
VITLATGPL

SEQ ID NO: 265285 - protein, 9 aa, Dengue virus
FQADSPKRL

SEQ ID NO: 265286 - protein, 9 aa, Dengue virus
LKGMPIRYQ

SEQ ID NO: 265287 - protein, 9 aa, Dengue virus
YFHRRDLRL

SEQ ID NO: 265288 - protein, 9 aa, Dengue virus
LKGLPIRYQ

SEQ ID NO: 265289 - protein, 9 aa, Dengue virus
YAVATTIVT

SEQ ID NO: 265290 - protein, 9 aa, Dengue virus
VKLMSGKDV

SEQ ID NO: 265291 - protein, 9 aa, Dengue virus
TFKTAHAKK

SEQ ID NO: 265292 - protein, 9 aa, Dengue virus
NIVSSVNMI

SEQ ID NO: 265293 - protein, 9 aa, Dengue virus
MVTFKVPHA

SEQ ID NO: 265294 - protein, 9 aa, Dengue virus
LVTFKNPHA

SEQ ID NO: 265295 - protein, 9 aa, Dengue virus
WNTTIAVSM

SEQ ID NO: 265296 - protein, 9 aa, Dengue virus
VNTISKMLL

SEQ ID NO: 265297 - protein, 9 aa, Dengue virus
YLPAIVREA

SEQ ID NO: 265298 - protein, 9 aa, Dengue virus
LFGKGSLVT

SEQ ID NO: 265299 - protein, 9 aa, Dengue virus
IFMTATPPG

SEQ ID NO: 265300 - protein, 9 aa, Dengue virus
SVNMISRML

SEQ ID NO: 265301 - protein, 9 aa, Dengue virus
LVSLLGSSL

SEQ ID NO: 265302 - protein, 9 aa, Dengue virus
YKFQPESPA

SEQ ID NO: 265303 - protein, 9 aa, Dengue virus
LSSLLKNDV

SEQ ID NO: 265304 - protein, 9 aa, Dengue virus
IRYQTPAIR

SEQ ID NO: 265305 - protein, 9 aa, Dengue virus
YLPAIIREA

SEQ ID NO: 265306 - protein, 9 aa, Dengue virus
YKFQADSPK

SEQ ID NO: 265307 - protein, 9 aa, Dengue virus
IVSILASSL

SEQ ID NO: 265308 - protein, 9 aa, Dengue virus
RYQTTAVKS

SEQ ID NO: 265309 - protein, 9 aa, Dengue virus
VKRFSTGLL

SEQ ID NO: 265310 - protein, 9 aa, Dengue virus
VNMTSKMLL

SEQ ID NO: 265311 - protein, 9 aa, Dengue virus
PIRYQTTAV

SEQ ID NO: 265312 - protein, 9 aa, Dengue virus
FLAIPPTAG

SEQ ID NO: 265313 - protein, 9 aa, Dengue virus
YGWNLVRLQ

SEQ ID NO: 265314 - protein, 9 aa, Dengue virus
SVNMISRML

SEQ ID NO: 265315 - protein, 9 aa, Dengue virus
FKTAHAKKQ

SEQ ID NO: 265316 - protein, 9 aa, Dengue virus
WKLARASFI

SEQ ID NO: 265317 - protein, 9 aa, Dengue virus
TRLLSSTRV

SEQ ID NO: 265318 - protein, 9 aa, Dengue virus
FQADSPKRL

SEQ ID NO: 265319 - protein, 9 aa, Dengue virus
SKMLLNRFT

SEQ ID NO: 265320 - protein, 9 aa, Dengue virus
CVKILNPYM

SEQ ID NO: 265321 - protein, 9 aa, Dengue virus
FLRFLAIPP

SEQ ID NO: 265322 - protein, 9 aa, Dengue virus
FLAIPPTAG

SEQ ID NO: 265323 - protein, 9 aa, Dengue virus
RYQTTATKT

SEQ ID NO: 265324 - protein, 9 aa, Dengue virus
YAVATTFIT

SEQ ID NO: 265325 - protein, 9 aa, Dengue virus
YAVATTVLT

SEQ ID NO: 265326 - protein, 9 aa, Dengue virus
TLILAPTRV

SEQ ID NO: 265327 - protein, 9 aa, Dengue virus
SQILLMRTT

SEQ ID NO: 265328 - protein, 9 aa, Dengue virus
YAQMWSLMY

SEQ ID NO: 265329 - protein, 9 aa, Dengue virus
LIGLSSRAT

SEQ ID NO: 265330 - protein, 9 aa, Dengue virus
VQLLLMRTS

SEQ ID NO: 265331 - protein, 9 aa, Dengue virus
YGWNLVRLQ

SEQ ID NO: 265332 - protein, 9 aa, Dengue virus
TLILAPTRV

SEQ ID NO: 265333 - protein, 9 aa, Dengue virus
IAVSMANIF

SEQ ID NO: 265334 - protein, 9 aa, Dengue virus
VQLLLMRTS

SEQ ID NO: 265335 - protein, 9 aa, Dengue virus
FNMLKRARN

SEQ ID NO: 265336 - protein, 9 aa, Dengue virus
FGRAKGSRA

SEQ ID NO: 265337 - protein, 9 aa, Dengue virus
FKLTYQNKV

SEQ ID NO: 265338 - protein, 9 aa, Dengue virus
LSSLLKNDV

SEQ ID NO: 265339 - protein, 9 aa, Dengue virus
YGWNLVKLM

SEQ ID NO: 265340 - protein, 9 aa, Dengue virus
LRLASNAIC

SEQ ID NO: 265341 - protein, 9 aa, Dengue virus
LVSLLGSSL

SEQ ID NO: 265342 - protein, 9 aa, Dengue virus
LSSLLRNDV

SEQ ID NO: 265343 - protein, 9 aa, Dengue virus
LVTFKTAHA

SEQ ID NO: 265344 - protein, 9 aa, Dengue virus
IVSAVNMTS

SEQ ID NO: 265345 - protein, 9 aa, Dengue virus
YFHRRDLRL

SEQ ID NO: 265346 - protein, 9 aa, Dengue virus
ITFLRVLSI

SEQ ID NO: 265347 - protein, 9 aa, Dengue virus
YGWNLVKLM

SEQ ID NO: 265348 - protein, 9 aa, Dengue virus
FTNMEAQLI

SEQ ID NO: 265349 - protein, 9 aa, Dengue virus
YKFQADSPK

SEQ ID NO: 265350 - protein, 9 aa, Dengue virus
MRLLSPVRV

SEQ ID NO: 265351 - protein, 9 aa, Dengue virus
YAVATTIIT

SEQ ID NO: 265352 - protein, 9 aa, Dengue virus
FTNMEAQLI

SEQ ID NO: 265353 - protein, 9 aa, Dengue virus
VRSNAAIGA

SEQ ID NO: 265354 - protein, 9 aa, Dengue virus
WKLARASFI

SEQ ID NO: 265355 - protein, 9 aa, Dengue virus
VNTTSRLLI

SEQ ID NO: 265356 - protein, 9 aa, Dengue virus
YFHRRDLRL

SEQ ID NO: 265357 - protein, 9 aa, Dengue virus
YMATLKNVR

SEQ ID NO: 265358 - protein, 9 aa, Dengue virus
FKLTYQNKV

SEQ ID NO: 265359 - protein, 9 aa, Dengue virus
YAQMWTLMY

SEQ ID NO: 265360 - protein, 9 aa, Dengue virus
LIGLTSRAT

SEQ ID NO: 265361 - protein, 9 aa, Dengue virus
ISRMLINRF

SEQ ID NO: 265362 - protein, 9 aa, Dengue virus
FLAIPPTAG

SEQ ID NO: 265363 - protein, 9 aa, Dengue virus
VNMTSKMLL

SEQ ID NO: 265364 - protein, 9 aa, Dengue virus
SLGLLSGRG

SEQ ID NO: 265365 - protein, 9 aa, Dengue virus
YLPAIIREA

SEQ ID NO: 265366 - protein, 9 aa, Dengue virus
LQGQGPMKM

SEQ ID NO: 265367 - protein, 9 aa, Dengue virus
VNMTSKMLL

SEQ ID NO: 265368 - protein, 9 aa, Dengue virus
LVAFLRFLA

SEQ ID NO: 265369 - protein, 9 aa, Dengue virus
IFITNNVHT

SEQ ID NO: 265370 - protein, 9 aa, Dengue virus
TLILAPTRV

SEQ ID NO: 265371 - protein, 9 aa, Dengue virus
YGWNIVKLH

SEQ ID NO: 265372 - protein, 9 aa, Dengue virus
VRSNAALGA

SEQ ID NO: 265373 - protein, 9 aa, Dengue virus
IFTTNIWMK

SEQ ID NO: 265374 - protein, 9 aa, Dengue virus
VLTLATGPI

SEQ ID NO: 265375 - protein, 9 aa, Dengue virus
VWFVPSIKA

SEQ ID NO: 265376 - protein, 9 aa, Dengue virus
YTALFSGVS

SEQ ID NO: 265377 - protein, 9 aa, Dengue virus
YAQMWSLMY

SEQ ID NO: 265378 - protein, 9 aa, Dengue virus
IRYQTPAIR

SEQ ID NO: 265379 - protein, 9 aa, Dengue virus
WFSRGNSLS

SEQ ID NO: 265380 - protein, 9 aa, Dengue virus
YLPAIVREA

SEQ ID NO: 265381 - protein, 9 aa, Dengue virus
YAVATTIVT

SEQ ID NO: 265382 - protein, 9 aa, Dengue virus
LIGLSSRAT

SEQ ID NO: 265383 - protein, 9 aa, Dengue virus
WNTTIAVSM

SEQ ID NO: 265384 - protein, 9 aa, Dengue virus
FCKKVRSNA

SEQ ID NO: 265385 - protein, 9 aa, Dengue virus
YISTRVEMG

SEQ ID NO: 265386 - protein, 9 aa, Dengue virus
VSRMLLNRF

SEQ ID NO: 265387 - protein, 9 aa, Dengue virus
FTNMEAQLI

SEQ ID NO: 265388 - protein, 9 aa, Dengue virus
LRTLILAPT

SEQ ID NO: 265389 - protein, 9 aa, Dengue virus
YKFQPESPA

SEQ ID NO: 265390 - protein, 9 aa, Dengue virus
IFRGSYLAG

SEQ ID NO: 265391 - protein, 9 aa, Dengue virus
LRTLILAPT

SEQ ID NO: 265392 - protein, 9 aa, Dengue virus
IRYQTPAVK

SEQ ID NO: 265393 - protein, 9 aa, Dengue virus
FLRFLTIPP

SEQ ID NO: 265394 - protein, 9 aa, Dengue virus
LVTFKNPHA

SEQ ID NO: 265395 - protein, 9 aa, Dengue virus
HATFTTRLL

SEQ ID NO: 265396 - protein, 9 aa, Dengue virus
VNTTSRLLL

SEQ ID NO: 265397 - protein, 9 aa, Dengue virus
YISTRVGMG

SEQ ID NO: 265398 - protein, 9 aa, Dengue virus
TLILAPTRV

SEQ ID NO: 265399 - protein, 9 aa, Dengue virus
YISTRVGMG

SEQ ID NO: 265400 - protein, 9 aa, Dengue virus
YTALFSGVS

SEQ ID NO: 265401 - protein, 9 aa, Dengue virus
VRSNAAMGA

SEQ ID NO: 265402 - protein, 9 aa, Dengue virus
VKLMSGKDV

SEQ ID NO: 265403 - protein, 9 aa, Dengue virus
LILAPTRVV

SEQ ID NO: 265404 - protein, 9 aa, Dengue virus
CIKILNPYM

SEQ ID NO: 265405 - protein, 9 aa, Dengue virus
LIGLTSRAT

SEQ ID NO: 265406 - protein, 9 aa, Dengue virus
ISKMLINRF

SEQ ID NO: 265407 - protein, 9 aa, Dengue virus
FGKAKGSRA

SEQ ID NO: 265408 - protein, 9 aa, Dengue virus
IKKVRTNAA

SEQ ID NO: 265409 - protein, 9 aa, Dengue virus
LIGLSSRAT

SEQ ID NO: 265410 - protein, 9 aa, Dengue virus
IVSILASSL

SEQ ID NO: 265411 - protein, 9 aa, Dengue virus
FLAIPPTAG

SEQ ID NO: 265412 - protein, 9 aa, Dengue virus
NIVSSVNMV

SEQ ID NO: 265413 - protein, 9 aa, Dengue virus
TLILAPTRV

SEQ ID NO: 265414 - protein, 9 aa, Dengue virus
FCEVLTLAT

SEQ ID NO: 265415 - protein, 9 aa, Dengue virus
VFHTMWHVT

SEQ ID NO: 265416 - protein, 9 aa, Dengue virus
LIGLSSRAT

SEQ ID NO: 265417 - protein, 9 aa, Dengue virus
YAQMWSLMY

SEQ ID NO: 265418 - protein, 9 aa, Dengue virus
MLKRVRNRV

SEQ ID NO: 265419 - protein, 9 aa, Dengue virus
YGWNIVKLH

SEQ ID NO: 265420 - protein, 9 aa, Dengue virus
YFHRRDLRL

SEQ ID NO: 265421 - protein, 9 aa, Dengue virus
SQILLMRTT

SEQ ID NO: 265422 - protein, 9 aa, Dengue virus
YAVATTFIT

SEQ ID NO: 265423 - protein, 9 aa, Dengue virus
FHTMWHVTR

SEQ ID NO: 265424 - protein, 9 aa, Dengue virus
VSILLSSLL

SEQ ID NO: 265425 - protein, 9 aa, Dengue virus
FLTIPPTAG

SEQ ID NO: 265426 - protein, 9 aa, Dengue virus
VKRFSTGLL

SEQ ID NO: 265427 - protein, 9 aa, Dengue virus
VWFVPSIKA

SEQ ID NO: 265428 - protein, 9 aa, Dengue virus
YAVATTVLT

SEQ ID NO: 265429 - protein, 9 aa, Dengue virus
YTALFSGVS

SEQ ID NO: 265430 - protein, 9 aa, Dengue virus
MVTFKVPHA

SEQ ID NO: 265431 - protein, 9 aa, Dengue virus
LILAPTRVV

SEQ ID NO: 265432 - protein, 9 aa, Dengue virus
IFITNNVHT

SEQ ID NO: 265433 - protein, 9 aa, Dengue virus
TLILAPTRV

SEQ ID NO: 265434 - protein, 9 aa, Dengue virus
YQFQADSPK

SEQ ID NO: 265435 - protein, 9 aa, Dengue virus
YVSAIAQAK

SEQ ID NO: 265436 - protein, 9 aa, Dengue virus
LVTFKNPHA

SEQ ID NO: 265437 - protein, 9 aa, Dengue virus
YAIIGPGLQ

SEQ ID NO: 265438 - protein, 9 aa, Dengue virus
VNMISRMLI

SEQ ID NO: 265439 - protein, 9 aa, Dengue virus
WNTTIAVST

SEQ ID NO: 265440 - protein, 9 aa, Dengue virus
YKFQADSPS

SEQ ID NO: 265441 - protein, 9 aa, Dengue virus
IRYQTPAIR

SEQ ID NO: 265442 - protein, 9 aa, Dengue virus
YAVATTFIT

SEQ ID NO: 265443 - protein, 9 aa, Dengue virus
LTAIANQAA

SEQ ID NO: 265444 - protein, 9 aa, Dengue virus
FLRFLAIPP

SEQ ID NO: 265445 - protein, 9 aa, Dengue virus
IFVIDNVHT

SEQ ID NO: 265446 - protein, 9 aa, Dengue virus
VRSNAALGA

SEQ ID NO: 265447 - protein, 9 aa, Dengue virus
YAQMWSLMY

SEQ ID NO: 265448 - protein, 9 aa, Dengue virus
FTMRLLSPV

SEQ ID NO: 265449 - protein, 9 aa, Dengue virus
SQILLMRTS

SEQ ID NO: 265450 - protein, 9 aa, Dengue virus
LSSLLRNDV

SEQ ID NO: 265451 - protein, 9 aa, Dengue virus
RYQTTAVKS

SEQ ID NO: 265452 - protein, 9 aa, Dengue virus
WNTTIAVST

SEQ ID NO: 265453 - protein, 9 aa, Dengue virus
IFMTATPPG

SEQ ID NO: 265454 - protein, 9 aa, Dengue virus
LVAFLRFLA

SEQ ID NO: 265455 - protein, 9 aa, Dengue virus
FQADSPKRL

SEQ ID NO: 265456 - protein, 9 aa, Dengue virus
IFTTNIWLK

SEQ ID NO: 265457 - protein, 9 aa, Dengue virus
TFITPMLRH

SEQ ID NO: 265458 - protein, 9 aa, Dengue virus
LMRTSWALC

SEQ ID NO: 265459 - protein, 9 aa, Dengue virus
IVASVNTTS

SEQ ID NO: 265460 - protein, 9 aa, Dengue virus
LRLASNAIC

SEQ ID NO: 265461 - protein, 9 aa, Dengue virus
FLRVLSIPP

SEQ ID NO: 265462 - protein, 9 aa, Dengue virus
FCEALTLAT

SEQ ID NO: 265463 - protein, 9 aa, Dengue virus
VRSNAAIGA

SEQ ID NO: 265464 - protein, 9 aa, Dengue virus
WFSRGNSLS

SEQ ID NO: 265465 - protein, 9 aa, Dengue virus
WLAYKVASE

SEQ ID NO: 265466 - protein, 9 aa, Dengue virus
YKVASAGIS

SEQ ID NO: 265467 - protein, 9 aa, Dengue virus
TFKTAHAKK

SEQ ID NO: 265468 - protein, 9 aa, Dengue virus
LKGMPIRYQ

SEQ ID NO: 265469 - protein, 9 aa, Dengue virus
NLVRLQSGV

SEQ ID NO: 265470 - protein, 9 aa, Dengue virus
VTRLENIMW

SEQ ID NO: 265471 - protein, 9 aa, Dengue virus
VNTTSRLLL

SEQ ID NO: 265472 - protein, 9 aa, Dengue virus
LIGLSSRAT

SEQ ID NO: 265473 - protein, 9 aa, Dengue virus
VRSNAAIGA

SEQ ID NO: 265474 - protein, 9 aa, Dengue virus
FQADSPKKL

SEQ ID NO: 265475 - protein, 9 aa, Dengue virus
FLAIPPTAG

SEQ ID NO: 265476 - protein, 9 aa, Dengue virus
LIGLTSRAT

SEQ ID NO: 265477 - protein, 9 aa, Dengue virus
TRLLSSTRV

SEQ ID NO: 265478 - protein, 9 aa, Dengue virus
HRRDLRLAS

SEQ ID NO: 265479 - protein, 9 aa, Dengue virus
YSQVNPLTL

SEQ ID NO: 265480 - protein, 9 aa, Dengue virus
YAVATTVLT

SEQ ID NO: 265481 - protein, 9 aa, Dengue virus
VVSILASSF

SEQ ID NO: 265482 - protein, 9 aa, Dengue virus
FLAIPPTAG

SEQ ID NO: 265483 - protein, 9 aa, Dengue virus
RYQTTATKT

SEQ ID NO: 265484 - protein, 9 aa, Dengue virus
YYMATLKNV

SEQ ID NO: 265485 - protein, 9 aa, Dengue virus
YYMATLKNV

SEQ ID NO: 265486 - protein, 9 aa, Dengue virus
LTKRFSLGL

SEQ ID NO: 265487 - protein, 9 aa, Dengue virus
VRSNAAMGA

SEQ ID NO: 265488 - protein, 9 aa, Dengue virus
MFSTNIWLK

SEQ ID NO: 265489 - protein, 9 aa, Dengue virus
FLAIPPTAG

SEQ ID NO: 265490 - protein, 9 aa, Dengue virus
WNTTIAVST

SEQ ID NO: 265491 - protein, 9 aa, Dengue virus
FLAIPPTAG

SEQ ID NO: 265492 - protein, 9 aa, Dengue virus
WLAYKVAAE

SEQ ID NO: 265493 - protein, 9 aa, Dengue virus
YAVATTFIT

SEQ ID NO: 265494 - protein, 9 aa, Dengue virus
VWFVPSIKA

SEQ ID NO: 265495 - protein, 9 aa, Dengue virus
FNMLKRERN

SEQ ID NO: 265496 - protein, 9 aa, Dengue virus
FQADSPSKL

SEQ ID NO: 265497 - protein, 9 aa, Dengue virus
VWFVPSIKS

SEQ ID NO: 265498 - protein, 9 aa, Dengue virus
ISRMLINRF

SEQ ID NO: 265499 - protein, 9 aa, Dengue virus
IVSILASSL

SEQ ID NO: 265500 - protein, 9 aa, Dengue virus
VWFVPSIKA

SEQ ID NO: 265501 - protein, 9 aa, Dengue virus
LVSLLGSSL

SEQ ID NO: 265502 - protein, 9 aa, Dengue virus
YISTRVEMG

SEQ ID NO: 265503 - protein, 9 aa, Dengue virus
ITLATGPLS

SEQ ID NO: 265504 - protein, 9 aa, Dengue virus
MMRTTWALC

SEQ ID NO: 265505 - protein, 9 aa, Dengue virus
WLSYKVASA

SEQ ID NO: 265506 - protein, 9 aa, Dengue virus
YFHRRDLRL

SEQ ID NO: 265507 - protein, 9 aa, Dengue virus
FKLTYQNKV

SEQ ID NO: 265508 - protein, 9 aa, Dengue virus
FLTIPPTAG

SEQ ID NO: 265509 - protein, 9 aa, Dengue virus
LIGLTSRAT

SEQ ID NO: 265510 - protein, 9 aa, Dengue virus
CHATFTTRL

SEQ ID NO: 265511 - protein, 9 aa, Dengue virus
MVTFKVPHA

SEQ ID NO: 265512 - protein, 9 aa, Dengue virus
ITLATGPLS

SEQ ID NO: 265513 - protein, 9 aa, Dengue virus
IRYQTTAVK

SEQ ID NO: 265514 - protein, 9 aa, Dengue virus
VCYVLSGSS

SEQ ID NO: 265515 - protein, 9 aa, Dengue virus
LMRTSWAFC

SEQ ID NO: 265516 - protein, 9 aa, Dengue virus
IFTTNIWMK

SEQ ID NO: 265517 - protein, 9 aa, Dengue virus
RYQTTAIKA

SEQ ID NO: 265518 - protein, 9 aa, Dengue virus
FQADSPKRL

SEQ ID NO: 265519 - protein, 9 aa, Dengue virus
CHATFTTRL

SEQ ID NO: 265520 - protein, 9 aa, Dengue virus
VKRFSTGLL

SEQ ID NO: 265521 - protein, 9 aa, Dengue virus
LNTFTNMEA

SEQ ID NO: 265522 - protein, 9 aa, Dengue virus
IRYQTPAIR

SEQ ID NO: 265523 - protein, 9 aa, Dengue virus
YLPAMVREA

SEQ ID NO: 265524 - protein, 9 aa, Dengue virus
VSSVNTISK

SEQ ID NO: 265525 - protein, 9 aa, Dengue virus
YAVATTIIT

SEQ ID NO: 265526 - protein, 9 aa, Dengue virus
FLRVLSIPP

SEQ ID NO: 265527 - protein, 9 aa, Dengue virus
TLILAPTRV

SEQ ID NO: 265528 - protein, 9 aa, Dengue virus
VWFVPSIKS

SEQ ID NO: 265529 - protein, 9 aa, Dengue virus
YGWNLVKLH

SEQ ID NO: 265530 - protein, 9 aa, Dengue virus
YFHRRDLRL

SEQ ID NO: 265531 - protein, 9 aa, Dengue virus
IRYQTPAVK

SEQ ID NO: 265532 - protein, 9 aa, Dengue virus
FQADSPKKL

SEQ ID NO: 265533 - protein, 9 aa, Dengue virus
WAFCEALTL

SEQ ID NO: 265534 - protein, 9 aa, Dengue virus
YAQMWALMY

SEQ ID NO: 265535 - protein, 9 aa, Dengue virus
MISRMLLNR

SEQ ID NO: 265536 - protein, 9 aa, Dengue virus
CIKVLNPYM

SEQ ID NO: 265537 - protein, 9 aa, Dengue virus
WLAYKVASE

SEQ ID NO: 265538 - protein, 9 aa, Dengue virus
YLPAMVREA

SEQ ID NO: 265539 - protein, 9 aa, Dengue virus
CIKVLNPYM

SEQ ID NO: 265540 - protein, 9 aa, Dengue virus
VSILLSSLL

SEQ ID NO: 265541 - protein, 9 aa, Dengue virus
YKFQADSPK

SEQ ID NO: 265542 - protein, 9 aa, Dengue virus
SVNMVSRML

SEQ ID NO: 265543 - protein, 9 aa, Dengue virus
ITLATGPLS

SEQ ID NO: 265544 - protein, 9 aa, Dengue virus
WLSYKVASA

SEQ ID NO: 265545 - protein, 9 aa, Dengue virus
LIGLSSRAT

SEQ ID NO: 265546 - protein, 9 aa, Dengue virus
NIVSSVNTI

SEQ ID NO: 265547 - protein, 9 aa, Dengue virus
FCEVLTLAT

SEQ ID NO: 265548 - protein, 9 aa, Dengue virus
YLPAIIREA

SEQ ID NO: 265549 - protein, 9 aa, Dengue virus
IVSSVNMIS

SEQ ID NO: 265550 - protein, 9 aa, Dengue virus
VRTNAAIGA

SEQ ID NO: 265551 - protein, 9 aa, Dengue virus
VRSNAALGA

SEQ ID NO: 265552 - protein, 9 aa, Dengue virus
SQILLMRTS

SEQ ID NO: 265553 - protein, 9 aa, Dengue virus
LRTLILAPT

SEQ ID NO: 265554 - protein, 9 aa, Dengue virus
LVTFKNPHA

SEQ ID NO: 265555 - protein, 9 aa, Dengue virus
WLAYKVASE

SEQ ID NO: 265556 - protein, 9 aa, Dengue virus
FQADSPKRL

SEQ ID NO: 265557 - protein, 9 aa, Dengue virus
LFGKGSLVT

SEQ ID NO: 265558 - protein, 9 aa, Dengue virus
LILAPTRVV

SEQ ID NO: 265559 - protein, 9 aa, Dengue virus
YAVATTIVT

SEQ ID NO: 265560 - protein, 9 aa, Dengue virus
ITLATGPLS

SEQ ID NO: 265561 - protein, 9 aa, Dengue virus
VATTFITPM

SEQ ID NO: 265562 - protein, 9 aa, Dengue virus
LFSGQGPMK

SEQ ID NO: 265563 - protein, 9 aa, Dengue virus
LRLASNAIC

SEQ ID NO: 265564 - protein, 9 aa, Dengue virus
WNTTIAVST

SEQ ID NO: 265565 - protein, 9 aa, Dengue virus
VWFVPSIKA

SEQ ID NO: 265566 - protein, 9 aa, Dengue virus
LIGLTARAT

SEQ ID NO: 265567 - protein, 9 aa, Dengue virus
FGKAKGSRA

SEQ ID NO: 265568 - protein, 9 aa, Dengue virus
MVSILASAL

SEQ ID NO: 265569 - protein, 9 aa, Dengue virus
VWFVPSIKA

SEQ ID NO: 265570 - protein, 9 aa, Dengue virus
VVSILASSF

SEQ ID NO: 265571 - protein, 9 aa, Dengue virus
YYMATLKNV

SEQ ID NO: 265572 - protein, 9 aa, Dengue virus
FHRRDLRLA

SEQ ID NO: 265573 - protein, 9 aa, Dengue virus
YGWNLVKLM

SEQ ID NO: 265574 - protein, 9 aa, Dengue virus
YAQMWQLMY

SEQ ID NO: 265575 - protein, 9 aa, Dengue virus
YGWNLVKLH

SEQ ID NO: 265576 - protein, 9 aa, Dengue virus
YAVATTIIT

SEQ ID NO: 265577 - protein, 9 aa, Dengue virus
YAIIGPGLQ

SEQ ID NO: 265578 - protein, 9 aa, Dengue virus
VLLMRTTWA

SEQ ID NO: 265579 - protein, 9 aa, Dengue virus
YVLSGSSAD

SEQ ID NO: 265580 - protein, 9 aa, Dengue virus
YTALFSGVS

SEQ ID NO: 265581 - protein, 9 aa, Dengue virus
RYQTTATKT

SEQ ID NO: 265582 - protein, 9 aa, Dengue virus
YAVATTFIT

SEQ ID NO: 265583 - protein, 9 aa, Dengue virus
WLSYKVASA

SEQ ID NO: 265584 - protein, 9 aa, Dengue virus
YAQMWSLMY

SEQ ID NO: 265585 - protein, 9 aa, Dengue virus
FCEALTLAT

SEQ ID NO: 265586 - protein, 9 aa, Dengue virus
VWFVPSIKT

SEQ ID NO: 265587 - protein, 9 aa, Dengue virus
LMRTTWALC

SEQ ID NO: 265588 - protein, 9 aa, Dengue virus
RFLAIPPTA

SEQ ID NO: 265589 - protein, 9 aa, Dengue virus
CVKVLNPYM

SEQ ID NO: 265590 - protein, 9 aa, Dengue virus
FNMLKRARN

SEQ ID NO: 265591 - protein, 9 aa, Dengue virus
FTNMEAQLI

SEQ ID NO: 265592 - protein, 9 aa, Dengue virus
LKRARNRVS

SEQ ID NO: 265593 - protein, 9 aa, Dengue virus
LFGKGSLLT

SEQ ID NO: 265594 - protein, 9 aa, Dengue virus
VQLLLMRTS

SEQ ID NO: 265595 - protein, 9 aa, Dengue virus
YVLSGSSAD

SEQ ID NO: 265596 - protein, 9 aa, Dengue virus
VFHTMWHVT

SEQ ID NO: 265597 - protein, 9 aa, Dengue virus
LIGLSSRAT

SEQ ID NO: 265598 - protein, 9 aa, Dengue virus
FCEALTLAT

SEQ ID NO: 265599 - protein, 9 aa, Dengue virus
TRLLSSTRV

SEQ ID NO: 265600 - protein, 9 aa, Dengue virus
YWIESSKNQ

SEQ ID NO: 265601 - protein, 9 aa, Dengue virus
LKRERNRVS

SEQ ID NO: 265602 - protein, 9 aa, Dengue virus
YAQMWTLMY

SEQ ID NO: 265603 - protein, 9 aa, Dengue virus
VRTNAAIGA

SEQ ID NO: 265604 - protein, 9 aa, Dengue virus
FCESLTLAT

SEQ ID NO: 265605 - protein, 9 aa, Dengue virus
FKNAHAKRQ

SEQ ID NO: 265606 - protein, 9 aa, Dengue virus
LVTFKNAHA

SEQ ID NO: 265607 - protein, 9 aa, Dengue virus
IFRGSYLAG

SEQ ID NO: 265608 - protein, 9 aa, Dengue virus
VRSNAALGA

SEQ ID NO: 265609 - protein, 9 aa, Dengue virus
YKFQPESPA

SEQ ID NO: 265610 - protein, 9 aa, Dengue virus
VSRMLLNRF

SEQ ID NO: 265611 - protein, 9 aa, Dengue virus
IKILNPYMP

SEQ ID NO: 265612 - protein, 9 aa, Dengue virus
IRYQTTATK

SEQ ID NO: 265613 - protein, 9 aa, Dengue virus
IKKVRTNAA

SEQ ID NO: 265614 - protein, 9 aa, Dengue virus
YFHRRDLRL

SEQ ID NO: 265615 - protein, 9 aa, Dengue virus
FLRFLAIPP

SEQ ID NO: 265616 - protein, 9 aa, Dengue virus
VFHTMWHVT

SEQ ID NO: 265617 - protein, 9 aa, Dengue virus
MRLLSPVRV

SEQ ID NO: 265618 - protein, 9 aa, Dengue virus
VWFVPSIKT

SEQ ID NO: 265619 - protein, 9 aa, Dengue virus
VVSILASSF

SEQ ID NO: 265620 - protein, 9 aa, Dengue virus
FLRVLSIPP

SEQ ID NO: 265621 - protein, 9 aa, Dengue virus
YISTRVEMG

SEQ ID NO: 265622 - protein, 9 aa, Dengue virus
VNTTSRLLI

SEQ ID NO: 265623 - protein, 9 aa, Dengue virus
YAQMWALMY

SEQ ID NO: 265624 - protein, 9 aa, Dengue virus
VSILASALL

SEQ ID NO: 265625 - protein, 9 aa, Dengue virus
VRSNAAMGA

SEQ ID NO: 265626 - protein, 9 aa, Dengue virus
YYMATLKNV

SEQ ID NO: 265627 - protein, 9 aa, Dengue virus
LVSLLGSSL

SEQ ID NO: 265628 - protein, 9 aa, Dengue virus
YISTRVGMG

SEQ ID NO: 265629 - protein, 9 aa, Dengue virus
VLSIPPTAG

SEQ ID NO: 265630 - protein, 9 aa, Dengue virus
IRYQTPAIR

SEQ ID NO: 265631 - protein, 9 aa, Dengue virus
TLILAPTRV

SEQ ID NO: 265632 - protein, 9 aa, Dengue virus
ISKMLINRF

SEQ ID NO: 265633 - protein, 9 aa, Dengue virus
FLRFLAIPP

SEQ ID NO: 265634 - protein, 9 aa, Dengue virus
LVTFKNPHA

SEQ ID NO: 265635 - protein, 9 aa, Dengue virus
LRTLILAPT

SEQ ID NO: 265636 - protein, 9 aa, Dengue virus
VLTLATGPI

SEQ ID NO: 265637 - protein, 9 aa, Dengue virus
LRGLPIRYQ

SEQ ID NO: 265638 - protein, 9 aa, Dengue virus
YKFQPESPK

SEQ ID NO: 265639 - protein, 9 aa, Dengue virus
LLMRTSWAF

SEQ ID NO: 265640 - protein, 9 aa, Dengue virus
TLILAPTRV

SEQ ID NO: 265641 - protein, 9 aa, Dengue virus
RFLTIPPTA

SEQ ID NO: 265642 - protein, 9 aa, Dengue virus
MVSILASAL

SEQ ID NO: 265643 - protein, 9 aa, Dengue virus
IKKVRTNAA

SEQ ID NO: 265644 - protein, 9 aa, Dengue virus
SVNMISRML

SEQ ID NO: 265645 - protein, 9 aa, Dengue virus
YLPAIVREA

SEQ ID NO: 265646 - protein, 9 aa, Dengue virus
LVTFKNPHA

SEQ ID NO: 265647 - protein, 9 aa, Dengue virus
FLRFLTIPP

SEQ ID NO: 265648 - protein, 9 aa, Dengue virus
YLPAIVREA

SEQ ID NO: 265649 - protein, 9 aa, Dengue virus
YAVATTFIT

SEQ ID NO: 265650 - protein, 9 aa, Dengue virus
SQILLMRTS

SEQ ID NO: 265651 - protein, 9 aa, Dengue virus
IRYQTTAVK

SEQ ID NO: 265652 - protein, 9 aa, Dengue virus
RYQTTAIKA

SEQ ID NO: 265653 - protein, 9 aa, Dengue virus
VWFVPSIKT

SEQ ID NO: 265654 - protein, 9 aa, Dengue virus
WNTTIAVSM

SEQ ID NO: 265655 - protein, 9 aa, Dengue virus
CIKVLNPYM

SEQ ID NO: 265656 - protein, 9 aa, Dengue virus
FTTRLLSST

SEQ ID NO: 265657 - protein, 9 aa, Dengue virus
LRFLTIPPT

SEQ ID NO: 265658 - protein, 9 aa, Dengue virus
IVSILASSL

SEQ ID NO: 265659 - protein, 9 aa, Dengue virus
WLAYKVASE

SEQ ID NO: 265660 - protein, 9 aa, Dengue virus
RYQTTAVKS

SEQ ID NO: 265661 - protein, 9 aa, Dengue virus
TLILAPTRV

SEQ ID NO: 265662 - protein, 9 aa, Dengue virus
YAVATTVLT

SEQ ID NO: 265663 - protein, 9 aa, Dengue virus
YVLSGSSAD

SEQ ID NO: 265664 - protein, 9 aa, Dengue virus
VCYVLSGSS

SEQ ID NO: 265665 - protein, 9 aa, Dengue virus
IRYQTPAIR

SEQ ID NO: 265666 - protein, 9 aa, Dengue virus
VNTTSRLLI

SEQ ID NO: 265667 - protein, 9 aa, Dengue virus
FKLTYQNKV

SEQ ID NO: 265668 - protein, 9 aa, Dengue virus
YGWNLVKLH

SEQ ID NO: 265669 - protein, 9 aa, Dengue virus
SILASALLK

SEQ ID NO: 265670 - protein, 9 aa, Dengue virus
MMRTTWALC

SEQ ID NO: 265671 - protein, 9 aa, Dengue virus
YGWNLVKLY

SEQ ID NO: 265672 - protein, 9 aa, Dengue virus
VWFVPSIKT

SEQ ID NO: 265673 - protein, 9 aa, Dengue virus
FKLTYQNKV

SEQ ID NO: 265674 - protein, 9 aa, Dengue virus
LVTFKTAHA

SEQ ID NO: 265675 - protein, 9 aa, Dengue virus
YISTRVGMG

SEQ ID NO: 265676 - protein, 9 aa, Dengue virus
LILAPTRVV

SEQ ID NO: 265677 - protein, 2556 aa, Norovirus
  MOD_RES (14)..(29): Any amino acid
  MOD_RES (45)..(54): Any amino acid
  MOD_RES (67)..(67): Any amino acid
  MOD_RES (79)..(85): Any amino acid
  MOD_RES (99)..(104): Any amino acid
  MOD_RES (189)..(189): Any amino acid
  MOD_RES (331)..(344): Any amino acid
  MOD_RES (358)..(358): Any amino acid
  MOD_RES (382)..(386): Any amino acid
  MOD_RES (397)..(401): Any amino acid
  MOD_RES (411)..(420): Any amino acid
  MOD_RES (432)..(440): Any amino acid
  MOD_RES (450)..(466): Any amino acid
  MOD_RES (480)..(491): Any amino acid
  MOD_RES (507)..(516): Any amino acid
  MOD_RES (551)..(556): Any amino acid
  MOD_RES (581)..(583): Any amino acid
  MOD_RES (619)..(628): Any amino acid
  MOD_RES (638)..(650): Any amino acid
  MOD_RES (663)..(683): Any amino acid
  MOD_RES (693)..(707): Any amino acid
  MOD_RES (725)..(799): Any amino acid
  MOD_RES (809)..(817): Any amino acid
  MOD_RES (830)..(875): Any amino acid
  MOD_RES (969)..(978): Any amino acid
  MOD_RES (1006)..(1009): Any amino acid
  MOD_RES (1018)..(1020): Any amino acid
  MOD_RES (1043)..(1061): Any amino acid
  MOD_RES (1070)..(1078): Any amino acid
  MOD_RES (1093)..(1099): Any amino acid
  MOD_RES (1157)..(1161): Any amino acid
  MOD_RES (1183)..(1183): Any amino acid
  MOD_RES (1208)..(1210): Any amino acid
  MOD_RES (1226)..(1226): Any amino acid
  MOD_RES (1246)..(1247): Any amino acid
  MOD_RES (1266)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1397)..(1404): Any amino acid
  MOD_RES (1419)..(1429): Any amino acid
  MOD_RES (1445)..(1487): Any amino acid
  MOD_RES (1504)..(1529): Any amino acid
  MOD_RES (1544)..(1556): Any amino acid
  MOD_RES (1572)..(1630): Any amino acid
  MOD_RES (1644)..(1674): Any amino acid
  MOD_RES (1683)..(1814): Any amino acid
  MOD_RES (1826)..(1852): Any amino acid
  MOD_RES (1861)..(1883): Any amino acid
  MOD_RES (1900)..(1900): Any amino acid
  MOD_RES (1919)..(2257): Any amino acid
  MOD_RES (2266)..(2276): Any amino acid
  MOD_RES (2307)..(2556): Any amino acid
MKMASNDASAAAVXXXXXXXXXXXXXXXXSSMAVTFKRALGARPXXXXXXXXXXRPPRPPTPELVKXIPPPPPNGEDEXXXXXXXKDGVSGLPELSTVXXXXXXNTAFSVPPLNQRENRDAKEPLTGTILEMWDGEIYHYGLYVERGLVLGVHKPPAAISLAKVELTPLSLFWRPVYTPQYLISPDTLXKLHGETFPYTAFDNNCYAFCCWVLDLNDSWLSRRMIQRTTGFFRPYQDWNRKPLPTMDDSKLKKVANIFLCTLSSLFTRPIKDIIGKLRPLNIINILASCDWTFAGIVESLILLAELFGVFWTPPDVSAMIAPLLGDFELQXXXXXXXXXXXXXXGGIGLVLGFTKEKXGKMLSSAASTLRACKDLGAYGLEXXXXXMKWFFPKKEEXXXXXMVRSIEDAVXXXXXXXXXXMTTLLKDKDSLXXXXXXXXXEEEKARKLSXXXXXXXXXXXXXXXXXRIAAARSLVHRAKXXXXXXXXXXXXMISGRPGIGKTHLARXXXXXXXXXXTGDQRVGLIPRNGVDHWDAYKGERVVLWDDYGMSXXXXXXLRLQELADTCPLTLNCDRIENKGKXXXSDVIIITTNLANPAPLDYVNFEACSRRIDFLVYAEXXXXXXXXXXFPGQPDMWKXXXXXXXXXXXXXLAPQGGFDKNGNXXXXXXXXXXXXXXXXXXXXXGLLHERLDEXXXXXXXXXXXXXXXNKVLAFRQLAAENKYGLXXXXXXXXXXXXXXXXXXXXXXXXXXXXXXXXXXXXXXXXXXXXXXXXXXXXXXXXXXXXXXXXXXXXXXXXXXXARIRYYVKCXXXXXXXXXQIAGAAFVTTRIXXXXXXXXXXXXXXXXXXXXXXXXXXXXXXXXXXXXXXXXXXXXXXEGKKGKNKTGRGKKHTAFSSKGLSDEEYDEYKRIREERNGKYSIEEYLQDRDKYYEEVAIARATEEDFCEEEEAKIRQRIFRPTRKQRKEERAXXXXXXXXXXRKRNPEDFKPKGKLWADDDRSVDYNEKXXXXAPPSIWSRXXXFGSGWGFWVSPSLFITSTHVIPXXXXXXXXXXXXXXXXXXXGEFCRLRFXXXXXXXXXGMILEEGAPEGTVVXXXXXXXTGELMPLAARMGTHATMKIQGRTVGGQMGMLLTGSNAKSMDLGTTPGDCGCPYIYKRXXXXXVIGVHTAAARGGNTVICATQGXEGEATLEGGGGQNKGTYCGAPILGXXXAPKLSTKTKFWRSSTXPLPPGTYEPAYLGGKDPRVXXGPSLQQVMRDQLKPFTEPXXXXXXXXXXXXXXXXXXXXXXXXXXXXXXXXXXQACASLDKTTSSGHPHXXXXXXXXXXXXXXXXLADQASKANLMFEXXXXXXPVYTGALKDELVKTDKXXXKIKKRLLWGSDLATMXRCARAFGGLMDXXXXXXXXLPIRVGMNMNEDGPXXXXXXXXXXXHYDADYSRWDSTQQRXXXXXXXXXXXXXXXXXXXXXXXXXXXXXXXXXXXXXXXXXXXEGLPSGVPCTSQWNSIXXXXXXXXXXXXXXXXXXXXXXXXXXFSFYGDDEIVSTDIXXXXXXXXXXXXXYGLKPTRPDKTEGPLXXXXXXXXXXXXXXXXXXXXXXXXXXXXXXXXXXXXXXXXXXXXXXXXXXXXXXXXXXXQLMSLLGEAALHGXXXXXXXXXXXXXXXXXXXXXXXXXXXXXXXRWMRFSDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFTAGKIXXXXXXXXXXXXXXXXXXXXXXXXXXXDVRQLEPVXXXXXXXXXXXXXXXXXXXXXXXKLIAMLYTPLRANNAGXDVFTVSCRVLTRPSPDFDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYFRFDSWXXXXXXXXXXXNGTGRRRALMAQAIIGAIAATAAGSAVGAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265678 - protein, 2556 aa, Norovirus
  MOD_RES (1)..(1): Any amino acid
  MOD_RES (14)..(29): Any amino acid
  MOD_RES (45)..(54): Any amino acid
  MOD_RES (67)..(67): Any amino acid
  MOD_RES (79)..(85): Any amino acid
  MOD_RES (99)..(104): Any amino acid
  MOD_RES (189)..(189): Any amino acid
  MOD_RES (203)..(213): Any amino acid
  MOD_RES (313)..(319): Any amino acid
  MOD_RES (331)..(344): Any amino acid
  MOD_RES (358)..(358): Any amino acid
  MOD_RES (382)..(386): Any amino acid
  MOD_RES (397)..(401): Any amino acid
  MOD_RES (411)..(420): Any amino acid
  MOD_RES (432)..(440): Any amino acid
  MOD_RES (450)..(466): Any amino acid
  MOD_RES (480)..(491): Any amino acid
  MOD_RES (507)..(516): Any amino acid
  MOD_RES (551)..(556): Any amino acid
  MOD_RES (581)..(583): Any amino acid
  MOD_RES (619)..(628): Any amino acid
  MOD_RES (638)..(651): Any amino acid
  MOD_RES (663)..(683): Any amino acid
  MOD_RES (693)..(707): Any amino acid
  MOD_RES (725)..(799): Any amino acid
  MOD_RES (809)..(817): Any amino acid
  MOD_RES (830)..(875): Any amino acid
  MOD_RES (896)..(896): Any amino acid
  MOD_RES (969)..(978): Any amino acid
  MOD_RES (1006)..(1009): Any amino acid
  MOD_RES (1018)..(1020): Any amino acid
  MOD_RES (1043)..(1061): Any amino acid
  MOD_RES (1070)..(1078): Any amino acid
  MOD_RES (1093)..(1099): Any amino acid
  MOD_RES (1157)..(1161): Any amino acid
  MOD_RES (1183)..(1196): Any amino acid
  MOD_RES (1208)..(1210): Any amino acid
  MOD_RES (1226)..(1226): Any amino acid
  MOD_RES (1246)..(1247): Any amino acid
  MOD_RES (1266)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1397)..(1404): Any amino acid
  MOD_RES (1419)..(1429): Any amino acid
  MOD_RES (1445)..(1487): Any amino acid
  MOD_RES (1504)..(1529): Any amino acid
  MOD_RES (1544)..(1556): Any amino acid
  MOD_RES (1572)..(1630): Any amino acid
  MOD_RES (1644)..(1674): Any amino acid
  MOD_RES (1683)..(1814): Any amino acid
  MOD_RES (1826)..(1852): Any amino acid
  MOD_RES (1861)..(1883): Any amino acid
  MOD_RES (1900)..(1900): Any amino acid
  MOD_RES (1919)..(2257): Any amino acid
  MOD_RES (2266)..(2276): Any amino acid
  MOD_RES (2307)..(2556): Any amino acid
XKMASNDASAAAAXXXXXXXXXXXXXXXXSNMAVTLKRALGARHXXXXXXXXXXGPSRPPTPELIKXVPPPPPNGEDDXXXXXXXKDGVSGLPDLSTVXXXXXXSTAFSVPPLSQRENRDAREPLTGTIIEMWDGEIYHYGLYVERGLILGVHKPPAAISLARVELTPLSLYWRPVYASQYLISPDALXRLHGESFPYTAFDXXXXXXXXXXXDLNDSWLCRRMISRTTDFFKPYQDWNRKPLPTTDDSKLKKAANIFLCALSSLFTRPIKDIIGKLRPLNILNILATCDWTFAGIVESLILMAALFGVFWTXXXXXXXIAPLLGDYELQXXXXXXXXXXXXXXGGIGMVLGFTAEKXGRVMKSAVDGLRACKDLGNYALDXXXXXKKYFFGGDQTXXXXXILRAIEDAVXXXXXXXXXXMTALVRDKQSAXXXXXXXXXEEEKARRLSXXXXXXXXXXXXXXXXXRIAAARSLLHKAKXXXXXXXXXXXXMISGKPGIGKTHMARXXXXXXXXXXSGDQRVGLVPREAVDHWDAYRGEEVMLWDDYGMGXXXXXXLTLQELADTCPVSLNCDRIENKGMXXXSDAIIITTNLVGPAPVDFVNLGPVCRRIDFLVYADXXXXXXXXXXSPGDTTALKXXXXXXXXXXXXXXAPQGGFDNQGNXXXXXXXXXXXXXXXXXXXXXALTMERQDEXXXXXXXXXXXXXXXNRVSAFRKLAADNKYGIXXXXXXXXXXXXXXXXXXXXXXXXXXXXXXXXXXXXXXXXXXXXXXXXXXXXXXXXXXXXXXXXXXXXXXXXXXXARIRYYVRCXXXXXXXXXQVAGASFVVNRIXXXXXXXXXXXXXXXXXXXXXXXXXXXXXXXXXXXXXXXXXXXXXXEDKKGKNKAGRGRKHTAFSSXGLSDEEYDEFKRIREERQGRYTIEEYLQDRDRYYEEVAVAKATEENFCEEEEIKIRQRIFRPTKKQRKEERVXXXXXXXXXXRKRNPDDFQPKGNLWADDTRSVDYNERXXXXAPPSVWSRXXXLGTGWGFWVSSNLLITTTHVLPXXXXXXXXXXXXXXXXXXXGEFCRFRFXXXXXXXXXGLVLEEGAPEGTVAXXXXXXXSGELLPLAVRMGTHATMRIQGRLVHGQMGMLLTGANAKNMDLGTIPGDCGAPYVHKRXXXXXVAGVHAAATKSGNTVVCAVQAXXXXXXXXXXXXXXLGHYAGHEIVRXXXGPALSTKTKFWRSSPXALPPGVYEPAYLGGRDPRVXXGPSLQQVMRDQLRPFTEPXXXXXXXXXXXXXXXXXXXXXXXXXXXXXXXXXXDACQSLDKTTSSGSPHXXXXXXXXXXXXXXXXLGEQASKANLMYEXXXXXXPVYTAALKDELVKPEKXXXKVKKRLLWGSDLGTMXRAARAFGGLMEXXXXXXXXLPVRVGMNSIEDGPXXXXXXXXXXXHFDADYSAWDSTQNRXXXXXXXXXXXXXXXXXXXXXXXXXXXXXXXXXXXXXXXXXXXEGLPSGFPCTSQVNSIXXXXXXXXXXXXXXXXXXXXXXXXXXFSFDGDDEIVSTDVXXXXXXXXXXXXXYGLVPTRPDKSEGPIXXXXXXXXXXXXXXXXXXXXXXXXXXXXXXXXXXXXXXXXXXXXXXXXXXXXXXXXXXXQLISLLGEASLHGXXXXXXXXXXXXXXXXXXXXXXXXXXXXXXXRWMRFHDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFTAGKLXXXXXXXXXXXXXXXXXXXXXXXXXXXDVRTLEPVXXXXXXXXXXXXXXXXXXXXXXXRLVAMLYTPLRSNGSGXVFTVSCRVLTRPAPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYFRFESWXXXXXXXXXXXNGAGRRRALMAQAVLGAIAASAAGSALGAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265679 - protein, 2556 aa, Norovirus
  MOD_RES (1)..(2): Any amino acid
  MOD_RES (14)..(29): Any amino acid
  MOD_RES (45)..(54): Any amino acid
  MOD_RES (67)..(67): Any amino acid
  MOD_RES (79)..(85): Any amino acid
  MOD_RES (99)..(104): Any amino acid
  MOD_RES (137)..(141): Any amino acid
  MOD_RES (153)..(155): Any amino acid
  MOD_RES (189)..(189): Any amino acid
  MOD_RES (203)..(218): Any amino acid
  MOD_RES (234)..(238): Any amino acid
  MOD_RES (266)..(269): Any amino acid
  MOD_RES (313)..(344): Any amino acid
  MOD_RES (358)..(358): Any amino acid
  MOD_RES (382)..(386): Any amino acid
  MOD_RES (397)..(401): Any amino acid
  MOD_RES (411)..(420): Any amino acid
  MOD_RES (432)..(440): Any amino acid
  MOD_RES (450)..(466): Any amino acid
  MOD_RES (480)..(491): Any amino acid
  MOD_RES (507)..(516): Any amino acid
  MOD_RES (551)..(556): Any amino acid
  MOD_RES (581)..(583): Any amino acid
  MOD_RES (619)..(628): Any amino acid
  MOD_RES (638)..(652): Any amino acid
  MOD_RES (663)..(683): Any amino acid
  MOD_RES (693)..(707): Any amino acid
  MOD_RES (725)..(799): Any amino acid
  MOD_RES (809)..(817): Any amino acid
  MOD_RES (830)..(875): Any amino acid
  MOD_RES (894)..(898): Any amino acid
  MOD_RES (922)..(925): Any amino acid
  MOD_RES (969)..(978): Any amino acid
  MOD_RES (1006)..(1009): Any amino acid
  MOD_RES (1018)..(1020): Any amino acid
  MOD_RES (1043)..(1061): Any amino acid
  MOD_RES (1070)..(1078): Any amino acid
  MOD_RES (1093)..(1099): Any amino acid
  MOD_RES (1157)..(1161): Any amino acid
  MOD_RES (1183)..(1196): Any amino acid
  MOD_RES (1208)..(1210): Any amino acid
  MOD_RES (1226)..(1226): Any amino acid
  MOD_RES (1235)..(1247): Any amino acid
  MOD_RES (1266)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1397)..(1404): Any amino acid
  MOD_RES (1419)..(1429): Any amino acid
  MOD_RES (1445)..(1487): Any amino acid
  MOD_RES (1504)..(1529): Any amino acid
  MOD_RES (1544)..(1556): Any amino acid
  MOD_RES (1572)..(1630): Any amino acid
  MOD_RES (1644)..(1674): Any amino acid
  MOD_RES (1683)..(1814): Any amino acid
  MOD_RES (1826)..(1852): Any amino acid
  MOD_RES (1861)..(1883): Any amino acid
  MOD_RES (1900)..(1900): Any amino acid
  MOD_RES (1919)..(2257): Any amino acid
  MOD_RES (2266)..(2276): Any amino acid
  MOD_RES (2307)..(2556): Any amino acid
XXNGSNDAFAAAVXXXXXXXXXXXXXXXXSNMAVTFKRALGARSXXXXXXXXXXKPPRPPTPELAKXTPPPPPNGEEEXXXXXXXKDGVSGLPELTTVXXXXXXNTVLSVPPLYQRENRDAKEPLTGTNLEMWDGEXXXXXLYVDRGLVLGVXXXPAAISFAKVELATLSLFWRPVYTPQYLISPDSLXRLHGEAFPYTAFDXXXXXXXXXXXXXXXXWLNRRMIQRTTGFFKXXXXXNRKPLPTVDDSKLKKVANLVLCALSSLXXXXIKDIIGKLKPLNILNILATCDWTFAGVAESLILLAELSGVFWTXXXXXXXXXXXXXXXXXXXXXXXXXXXXXXXXGGIGLAIGFTRDKXTKMMKNAVDTLRAATQLGQYGLEXXXXXMKWFFPKKDEXXXXXTVRAIEDAVXXXXXXXXXXLTTLLKDKNSLXXXXXXXXXEEEKARTLSXXXXXXXXXXXXXXXXXRISMARSALAKAQXXXXXXXXXXXXMMCGPPGIGKTKAAEXXXXXXXXXXRPGGKVGLVPRNGVDHWDGYHGERILLWDDYGMTXXXXXXNKLQAIADSAPLTLNCDRIEKKGMXXXSDAIVITTNAPSPAPLDYVNFEACSRRVDFLVYAEXXXXXXXXXXSPGDTSALKXXXXXXXXXXXXXXXPQGGFDKNGKXXXXXXXXXXXXXXXXXXXXXGLVHERRDEXXXXXXXXXXXXXXXNKIAAFRQMAAENKYGMXXXXXXXXXXXXXXXXXXXXXXXXXXXXXXXXXXXXXXXXXXXXXXXXXXXXXXXXXXXXXXXXXXXXXXXXXXXARARYYISCXXXXXXXXXQVAGAAFVTSRIXXXXXXXXXXXXXXXXXXXXXXXXXXXXXXXXXXXXXXXXXXXXXXEGKKGKNKSGRGKKHAAFXXXXXSDEEYDEFKKLREEKEGKYSIEEXXXXRDRYYEELAIARATEEDFCEEDEARIRRRIFRPTSKQRKEERGXXXXXXXXXXRKRRPDDFQPKGKLWADDNRSVNYNEKXXXXAPPTLWSRXXXFGTGWGFWVSPTVFITTTHVVPXXXXXXXXXXXXXXXXXXXGEFTQFRFXXXXXXXXXGMVLEEGAPEGTVCXXXXXXXTGEMIPLAVRMGTHASMKIQGKMLGGQSGMLLTGANAKGMDLGTGPGDCGAPYVYKRXXXXXVCGVHTAAAHGENTVICAIPNXXXXXXXXXXXXXXKGHYAGHEIIKXXXAPALSSKTKFWRSSNXSLPPGTYEXXXXXXXXXXXXXGPSLQQVMREQLKPFAEPXXXXXXXXXXXXXXXXXXXXXXXXXXXXXXXXXXQACVSLDKTTSSGYPHXXXXXXXXXXXXXXXXLADQAAHANNMYEXXXXXXPIYTAALKDELVKTEKXXXRIKKRLLWGSDLSTMXRCARAFGPFCDXXXXXXXXLPCRVGMNTIEDGPXXXXXXXXXXXHFDADYTKWDSTQQRXXXXXXXXXXXXXXXXXXXXXXXXXXXXXXXXXXXXXXXXXXXDGLPPGVPCTSQLNSIXXXXXXXXXXXXXXXXXXXXXXXXXXYSFYGDDEIVSTDLXXXXXXXXXXXXXYGLKPTRPDKTEGPIXXXXXXXXXXXXXXXXXXXXXXXXXXXXXXXXXXXXXXXXXXXXXXXXXXXXXXXXXXXQLMALLGEAALHEXXXXXXXXXXXXXXXXXXXXXXXXXXXXXXXKWMRFSDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAGNAFTAGKVXXXXXXXXXXXXXXXXXXXXXXXXXXXDVRTLEPIXXXXXXXXXXXXXXXXXXXXXXXRILAYLYTPLRANNSGXVVFTDSCRVLTRPTPDFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYFRFEAWXXXXXXXXXXXNGTGRRRVLMAQAIFGAIAASAAGSILGAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265680 - protein, 2556 aa, Norovirus
  MOD_RES (1)..(3): Any amino acid
  MOD_RES (14)..(29): Any amino acid
  MOD_RES (45)..(54): Any amino acid
  MOD_RES (67)..(67): Any amino acid
  MOD_RES (79)..(85): Any amino acid
  MOD_RES (97)..(107): Any amino acid
  MOD_RES (122)..(159): Any amino acid
  MOD_RES (175)..(179): Any amino acid
  MOD_RES (189)..(189): Any amino acid
  MOD_RES (198)..(243): Any amino acid
  MOD_RES (265)..(269): Any amino acid
  MOD_RES (290)..(295): Any amino acid
  MOD_RES (311)..(344): Any amino acid
  MOD_RES (358)..(358): Any amino acid
  MOD_RES (382)..(386): Any amino acid
  MOD_RES (397)..(401): Any amino acid
  MOD_RES (410)..(420): Any amino acid
  MOD_RES (432)..(440): Any amino acid
  MOD_RES (450)..(466): Any amino acid
  MOD_RES (480)..(491): Any amino acid
  MOD_RES (507)..(516): Any amino acid
  MOD_RES (551)..(556): Any amino acid
  MOD_RES (581)..(583): Any amino acid
  MOD_RES (594)..(610): Any amino acid
  MOD_RES (619)..(628): Any amino acid
  MOD_RES (638)..(653): Any amino acid
  MOD_RES (663)..(683): Any amino acid
  MOD_RES (693)..(707): Any amino acid
  MOD_RES (725)..(799): Any amino acid
  MOD_RES (809)..(817): Any amino acid
  MOD_RES (830)..(875): Any amino acid
  MOD_RES (888)..(901): Any amino acid
  MOD_RES (922)..(925): Any amino acid
  MOD_RES (969)..(978): Any amino acid
  MOD_RES (1006)..(1009): Any amino acid
  MOD_RES (1018)..(1024): Any amino acid
  MOD_RES (1043)..(1061): Any amino acid
  MOD_RES (1070)..(1078): Any amino acid
  MOD_RES (1093)..(1105): Any amino acid
  MOD_RES (1157)..(1161): Any amino acid
  MOD_RES (1181)..(1196): Any amino acid
  MOD_RES (1208)..(1210): Any amino acid
  MOD_RES (1226)..(1226): Any amino acid
  MOD_RES (1235)..(1247): Any amino acid
  MOD_RES (1266)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1397)..(1404): Any amino acid
  MOD_RES (1419)..(1429): Any amino acid
  MOD_RES (1445)..(1492): Any amino acid
  MOD_RES (1504)..(1529): Any amino acid
  MOD_RES (1538)..(1556): Any amino acid
  MOD_RES (1572)..(1630): Any amino acid
  MOD_RES (1644)..(1674): Any amino acid
  MOD_RES (1683)..(1817): Any amino acid
  MOD_RES (1826)..(1852): Any amino acid
  MOD_RES (1861)..(1883): Any amino acid
  MOD_RES (1900)..(1900): Any amino acid
  MOD_RES (1919)..(2257): Any amino acid
  MOD_RES (2266)..(2285): Any amino acid
  MOD_RES (2307)..(2556): Any amino acid
XXXASNDASATAVXXXXXXXXXXXXXXXXSSMAVTLKRALGARTXXXXXXXXXXSPSRPPTPELVRXIPPPPHNGEDEXXXXXXXENGISGLPELSXXXXXXXXXXXFSVPPLGQRENRDAXXXXXXXXXXXXXXXXXXXXXXXXXXXXXXXXXXXXXXSLARVELAPLSLYWRXXXXXQHLISPDTLXKLHGEAFPXXXXXXXXXXXXXXXXXXXXXXXXXXXXXXXXXXXXXXXXXXXXXXPTMDDPKVKKVANVFLCALSSXXXXXIKDLIGKVRPLNVINILASCXXXXXXKAESLILLAELSGVFXXXXXXXXXXXXXXXXXXXXXXXXXXXXXXXXXXGGVGMVLGFTKERXSKLLSSAASSLKACREIGNYGIEXXXXXVKWFFPTKDEXXXXXMVRAIEDAXXXXXXXXXXXVTQLVRDKQAAXXXXXXXXXEEERARKLSXXXXXXXXXXXXXXXXXRISAARSLVHKAKXXXXXXXXXXXXMLSGRPGIGKTPLARXXXXXXXXXXSGDQRIGLTPRNGIDYSHAYKREEAVLRLDYVLSXXXXXXLRLQAIADTSPLSLNCDRIENEGKXXXSDTIIITTNLXXXXXXXXXXXXXXXXXVDFLVYCSXXXXXXXXXXSPGDTGALKXXXXXXXXXXXXXXXXQGGFDQNGNXXXXXXXXXXXXXXXXXXXXXGLVHERKDEXXXXXXXXXXXXXXXNKIAAFRQLAADNNYGFXXXXXXXXXXXXXXXXXXXXXXXXXXXXXXXXXXXXXXXXXXXXXXXXXXXXXXXXXXXXXXXXXXXXXXXXXXXARARYYVSCXXXXXXXXXQIAGAAFITTRIXXXXXXXXXXXXXXXXXXXXXXXXXXXXXXXXXXXXXXXXXXXXXXEGKKGKNKKGRGXXXXXXXXXXXXXXEYDEYKRIREERQGRYTIEEXXXXRDRYYEELAIARATEENFCEEEIAEIRQWVFRPTKKQRKEERTXXXXXXXXXXRRRKPDDFQPKGKLCLDDTRSVAYIKRXXXXAPPSLWSRXXXXXXXWGFWVSSTLFITTTHVIPXXXXXXXXXXXXXXXXXXXGEFCKMRFXXXXXXXXXGLILEEGCPEGTVCXXXXXXXXXXXXXLAVRMGAIASMRVQGKVIGGQMGMLLTGSNAKNMDLGTLPGDCGCPYVYKRXXXXXAIGVHTAATRGGNTVICAIXXXXXXXXXXXXXXXXHGTYAGHEIVKXXXGPTLSTKTKFWKSSPXPLPPGVYEXXXXXXXXXXXXXGLSLQQVLRDQLKPFTAPXXXXXXXXXXXXXXXXXXXXXXXXXXXXXXXXXXDACMSLDKTTSSGHPYXXXXXXXXXXXXXXXXLANQASRANLMYEXXXXXXPMYTAALKDELVKTDRXXXTIKKRLLWGADLGTVXRSARAFGGLLDXXXXXXXXLPIKVGMNAIEDGPXXXXXXXXXXXHYDADYSAWDSTQQRXXXXXXXXXXXXXXXXXXXXXXXXXXXXXXXXXXXXXXXXXXXXXXXXGVPCTSQWNSFXXXXXXXXXXXXXXXXXXXXXXXXXXFSFYGDDYXXXXXXXXXXXXXXXXXXXYGLIPTRPDKTDGPIXXXXXXXXXXXXXXXXXXXXXXXXXXXXXXXXXXXXXXXXXXXXXXXXXXXXXXXXXXXQLLCLLGESSLHGXXXXXXXXXXXXXXXXXXXXXXXXXXXXXXXAWMRFHDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAFAAGKIXXXXXXXXXXXXXXXXXXXXXXXXXXXDVRQLEPIXXXXXXXXXXXXXXXXXXXXXXXRLLAYLYTPLRANSGEXDVFTDSCRVLTRPSPDFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGHFRFDSWXXXXXXXXXXXXXXXXXXXXMAQAVIGAIAASTACSAVGAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265681 - protein, 2556 aa, Norovirus
  MOD_RES (1)..(5): Any amino acid
  MOD_RES (14)..(36): Any amino acid
  MOD_RES (45)..(70): Any amino acid
  MOD_RES (79)..(85): Any amino acid
  MOD_RES (95)..(107): Any amino acid
  MOD_RES (121)..(159): Any amino acid
  MOD_RES (175)..(189): Any amino acid
  MOD_RES (198)..(250): Any amino acid
  MOD_RES (265)..(270): Any amino acid
  MOD_RES (285)..(344): Any amino acid
  MOD_RES (358)..(358): Any amino acid
  MOD_RES (379)..(401): Any amino acid
  MOD_RES (410)..(420): Any amino acid
  MOD_RES (432)..(466): Any amino acid
  MOD_RES (480)..(491): Any amino acid
  MOD_RES (507)..(516): Any amino acid
  MOD_RES (551)..(556): Any amino acid
  MOD_RES (581)..(583): Any amino acid
  MOD_RES (593)..(610): Any amino acid
  MOD_RES (619)..(628): Any amino acid
  MOD_RES (638)..(654): Any amino acid
  MOD_RES (663)..(683): Any amino acid
  MOD_RES (693)..(707): Any amino acid
  MOD_RES (725)..(799): Any amino acid
  MOD_RES (809)..(817): Any amino acid
  MOD_RES (830)..(877): Any amino acid
  MOD_RES (888)..(901): Any amino acid
  MOD_RES (920)..(927): Any amino acid
  MOD_RES (955)..(960): Any amino acid
  MOD_RES (969)..(978): Any amino acid
  MOD_RES (990)..(991): Any amino acid
  MOD_RES (1001)..(1009): Any amino acid
  MOD_RES (1018)..(1024): Any amino acid
  MOD_RES (1034)..(1034): Any amino acid
  MOD_RES (1043)..(1061): Any amino acid
  MOD_RES (1070)..(1079): Any amino acid
  MOD_RES (1093)..(1109): Any amino acid
  MOD_RES (1130)..(1161): Any amino acid
  MOD_RES (1179)..(1196): Any amino acid
  MOD_RES (1208)..(1210): Any amino acid
  MOD_RES (1219)..(1252): Any amino acid
  MOD_RES (1266)..(1307): Any amino acid
  MOD_RES (1316)..(1350): Any amino acid
  MOD_RES (1367)..(1369): Any amino acid
  MOD_RES (1383)..(1388): Any amino acid
  MOD_RES (1397)..(1409): Any amino acid
  MOD_RES (1419)..(1429): Any amino acid
  MOD_RES (1445)..(1493): Any amino acid
  MOD_RES (1504)..(1529): Any amino acid
  MOD_RES (1538)..(1556): Any amino acid
  MOD_RES (1568)..(1630): Any amino acid
  MOD_RES (1644)..(1674): Any amino acid
  MOD_RES (1683)..(1817): Any amino acid
  MOD_RES (1826)..(1852): Any amino acid
  MOD_RES (1861)..(1883): Any amino acid
  MOD_RES (1900)..(1900): Any amino acid
  MOD_RES (1910)..(2285): Any amino acid
  MOD_RES (2307)..(2556): Any amino acid
XXXXXNDASVAAVXXXXXXXXXXXXXXXXXXXXXXXKRALGTRPXXXXXXXXXXXXXXXXXXXXXXXXXXPPPNGEGEXXXXXXXKEGVSGLPEXXXXXXXXXXXXXFSVPPFNQRENRDXXXXXXXXXXXXXXXXXXXXXXXXXXXXXXXXXXXXXXXSLAKVELTTLSLFWRXXXXXXXXXXXXXXXKLHGESFPXXXXXXXXXXXXXXXXXXXXXXXXXXXXXXXXXXXXXXXXXXXXXXXXXXXXXLKKVANVILCALSSXXXXXXKDIIGKLRPLNVINXXXXXXXXXXXXXXXXXXXXXXXXXXXXXXXXXXXXXXXXXXXXXXXXXXXXXXXXXXXXGGIGLAIGFTKDKXGRLLKSAADGLRACRDLGAYXXXXXXXXXXXXXXXXXXXXXXXLVRAIEDAXXXXXXXXXXXITQVVRDRQSTXXXXXXXXXXXXXXXXXXXXXXXXXXXXXXXXXXXRNAMARAALAKAQXXXXXXXXXXXXMISGRPGVGKTHMARXXXXXXXXXXNGDKRVGLTPRNGVGHWDAYKEERVVLWDDYGMAXXXXXXLTLQELGDTAPVSLNCDRSANKGKXXXSEVIIITTNXXXXXXXXXXXXXXXXXXVDFLVYCTXXXXXXXXXXHPGDTNAIKXXXXXXXXXXXXXXXXXGGFDKNANXXXXXXXXXXXXXXXXXXXXXGLLHERMDEXXXXXXXXXXXXXXXNKVFAFRQLAADNRYGFXXXXXXXXXXXXXXXXXXXXXXXXXXXXXXXXXXXXXXXXXXXXXXXXXXXXXXXXXXXXXXXXXXXXXXXXXXXARVRYYVKCXXXXXXXXXQIAGASFVVHRIXXXXXXXXXXXXXXXXXXXXXXXXXXXXXXXXXXXXXXXXXXXXXXXXKKGKSKTGRGXXXXXXXXXXXXXXEYDEYKKIREDRNGKYSIXXXXXXXXKYYEELAIAQATEENFCEEEEVKIRQRXXXXXXKQRKEERSXXXXXXXXXXRKRKADDFQPKXXLWADDSRSVXXXXXXXXXAPSSIWSRXXXXXXXWGCWVSPTLXVTSTHVIPXXXXXXXXXXXXXXXXXXXGEFTLFRFXXXXXXXXXXMILEEGCPEGVVCXXXXXXXXXXXXXXXXXMGAVATMKIQGKAVGGQMGMXXXXXXXXXXXXXXXXXXXXXXXXXXXXXXXXVFGVHTAAARGENTVICXXXXXXXXXXXXXXXXXXRGTYAGHPILRXXXSPKLSTKTXXXXXXXXXXXXXXXXXXXXXXXXXXXXXXXXXXQIMRDQLKPFADPXXXXXXXXXXXXXXXXXXXXXXXXXXXXXXXXXXXXXXXXXXTTSSGFPYXXXXXXXXXXXXXXXXXXXXXXXXXXXXXXXXXXXPLYTAALKDELVKTSKXXXTIKKRLLWGADLSXXXXXXRSFGGLMDXXXXXXXXXXXXXGMNVNENGRXXXXXXXXXXXLYDADYSRWDPTQQRXXXXXXXXXXXXXXXXXXXXXXXXXXXXXXXXXXXXXXXXXXXXXXXXXVPCTSQRNSIXXXXXXXXXXXXXXXXXXXXXXXXXXYSFYGDDYXXXXXXXXXXXXXXXXXXXIGLRPTRPDKSXXXXXXXXXXXXXXXXXXXXXXXXXXXXXXXXXXXXXXXXXXXXXXXXXXXXXXXXXXXXXXXQLLSLLGESALHGXXXXXXXXXXXXXXXXXXXXXXXXXXXXXXXRWMRVSDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNALTAGKIXXXXXXXXXXXXXXXXXXXXXXXXXXXGVRQLEPVXXXXXXXXXXXXXXXXXXXXXXXRLLAYLYTPLRANSPTXDVFTVSLRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAIIGAIAATAAGSAVSAGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265682 - protein, 2556 aa, Norovirus
  MOD_RES (14)..(29): Any amino acid
  MOD_RES (44)..(54): Any amino acid
  MOD_RES (67)..(67): Any amino acid
  MOD_RES (79)..(86): Any amino acid
  MOD_RES (99)..(104): Any amino acid
  MOD_RES (189)..(189): Any amino acid
  MOD_RES (331)..(344): Any amino acid
  MOD_RES (358)..(360): Any amino acid
  MOD_RES (382)..(386): Any amino acid
  MOD_RES (397)..(401): Any amino acid
  MOD_RES (412)..(440): Any amino acid
  MOD_RES (450)..(469): Any amino acid
  MOD_RES (480)..(491): Any amino acid
  MOD_RES (504)..(517): Any amino acid
  MOD_RES (550)..(558): Any amino acid
  MOD_RES (581)..(583): Any amino acid
  MOD_RES (619)..(650): Any amino acid
  MOD_RES (663)..(683): Any amino acid
  MOD_RES (693)..(707): Any amino acid
  MOD_RES (725)..(799): Any amino acid
  MOD_RES (809)..(884): Any amino acid
  MOD_RES (968)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1207)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1396)..(1409): Any amino acid
  MOD_RES (1419)..(1429): Any amino acid
  MOD_RES (1444)..(1487): Any amino acid
  MOD_RES (1503)..(1529): Any amino acid
  MOD_RES (1544)..(1556): Any amino acid
  MOD_RES (1572)..(1634): Any amino acid
  MOD_RES (1644)..(1814): Any amino acid
  MOD_RES (1825)..(1883): Any amino acid
  MOD_RES (1900)..(1901): Any amino acid
  MOD_RES (1920)..(2275): Any amino acid
  MOD_RES (2308)..(2556): Any amino acid
MKMASNDASAAAVXXXXXXXXXXXXXXXXSSMAVTFKRALGARXXXXXXXXXXXRPPRPPTPELVKXIPPPPPNGEDEXXXXXXXXDGVSGLPELSTVXXXXXXNTAFSVPPLNQRENRDAKEPLTGTILEMWDGEIYHYGLYVERGLVLGVHKPPAAISLAKVELTPLSLFWRPVYTPQYLISPDTLXKLHGETFPYTAFDNNCYAFCCWVLDLNDSWLSRRMIQRTTGFFRPYQDWNRKPLPTMDDSKLKKVANIFLCTLSSLFTRPIKDIIGKLRPLNIINILASCDWTFAGIVESLILLAELFGVFWTPPDVSAMIAPLLGDFELQXXXXXXXXXXXXXXGGIGLVLGFTKEKXXXMLSSAASTLRACKDLGAYGLEXXXXXMKWFFPKKEEXXXXXMVRSIEDAVLXXXXXXXXXXXXXXXXXXXXXXXXXXXXXEEEKARKLSXXXXXXXXXXXXXXXXXXXXAARSLVHRAKXXXXXXXXXXXXMISGRPGIGKTHXXXXXXXXXXXXXXGDQRVGLIPRNGVDHWDAYKGERVVLWDDYGMXXXXXXXXXLQELADTCPLTLNCDRIENKGKXXXSDVIIITTNLANPAPLDYVNFEACSRRIDFLVYAEXXXXXXXXXXXXXXXXXXXXXXXXXXXXXXXXLAPQGGFDKNGNXXXXXXXXXXXXXXXXXXXXXGLLHERLDEXXXXXXXXXXXXXXXNKVLAFRQLAAENKYGLXXXXXXXXXXXXXXXXXXXXXXXXXXXXXXXXXXXXXXXXXXXXXXXXXXXXXXXXXXXXXXXXXXXXXXXXXXXARIRYYVKCXXXXXXXXXXXXXXXXXXXXXXXXXXXXXXXXXXXXXXXXXXXXXXXXXXXXXXXXXXXXXXXXXXXXXXXXXXXXGRGKKHTAFSSKGLSDEEYDEYKRIREERNGKYSIEEYLQDRDKYYEEVAIARATEEDFCEEEEAKIRQRIFRPTRKQRKEERXXXXXXXXXXXRKRNPEDFKPKGKLWADDDRSVXXXXXXXXXXXXXXXXXXXXFGSGWGFWVSPSLXXXXXXXXXXXXXXXXXXXXXXXXXXXXXXXXXXXXXXXXXXXXXGMILEEGAPEGTVVXXXXXXXTGELMPLAARMGTHATMKIQGRTVGGQMGMLLTGSNAKSMDLGTTPGDCGCPYIYKRXXXXXVIGVHTAAARGGNTVICATQGGEGEATLEGGGGQNKGTYCGAPILXXXXAPKLSTKTKFWRSSTXPLPPGTYEPAYLGGKDPRVXXGPSLQQVMRDQLKPFTXXXXXXXXXXXXXXXXXXXXXXXXXXXXXXXXXXXXQACASLDKTTSSGHPHXXXXXXXXXXXXXXXXLADQASKANLMFEXXXXXXPVYTGALKDELVKTDKXXXKIKKRLLWGSDLATMXRCARAFGGLMXXXXXXXXXXXXXXGMNMNEDGPXXXXXXXXXXXHYDADYSRWDSTQQXXXXXXXXXXXXXXXXXXXXXXXXXXXXXXXXXXXXXXXXXXXXEGLPSGVPCTSQWNSXXXXXXXXXXXXXXXXXXXXXXXXXXXFSFYGDDEIVSTDIXXXXXXXXXXXXXYGLKPTRPDKTEGPLXXXXXXXXXXXXXXXXXXXXXXXXXXXXXXXXXXXXXXXXXXXXXXXXXXXXXXXXXXXXXXXLLGEAALHGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFTAGKXXXXXXXXXXXXXXXXXXXXXXXXXXXXXXXXXXXXXXXXXXXXXXXXXXXXXXXXXXXKLIAMLYTPLRANNAGXXVFTVSCRVLTRPSPDFDFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNGTGRRRALMAQAIIGAIAATAAGSAVGAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265683 - protein, 2556 aa, Norovirus
  MOD_RES (14)..(29): Any amino acid
  MOD_RES (44)..(54): Any amino acid
  MOD_RES (67)..(67): Any amino acid
  MOD_RES (79)..(86): Any amino acid
  MOD_RES (99)..(104): Any amino acid
  MOD_RES (189)..(189): Any amino acid
  MOD_RES (204)..(212): Any amino acid
  MOD_RES (316)..(318): Any amino acid
  MOD_RES (331)..(344): Any amino acid
  MOD_RES (358)..(360): Any amino acid
  MOD_RES (382)..(386): Any amino acid
  MOD_RES (397)..(401): Any amino acid
  MOD_RES (412)..(440): Any amino acid
  MOD_RES (450)..(469): Any amino acid
  MOD_RES (480)..(491): Any amino acid
  MOD_RES (504)..(517): Any amino acid
  MOD_RES (550)..(558): Any amino acid
  MOD_RES (581)..(583): Any amino acid
  MOD_RES (619)..(650): Any amino acid
  MOD_RES (663)..(683): Any amino acid
  MOD_RES (693)..(707): Any amino acid
  MOD_RES (725)..(799): Any amino acid
  MOD_RES (809)..(884): Any amino acid
  MOD_RES (968)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1183)..(1196): Any amino acid
  MOD_RES (1207)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1396)..(1409): Any amino acid
  MOD_RES (1419)..(1429): Any amino acid
  MOD_RES (1444)..(1487): Any amino acid
  MOD_RES (1503)..(1529): Any amino acid
  MOD_RES (1544)..(1556): Any amino acid
  MOD_RES (1572)..(1634): Any amino acid
  MOD_RES (1644)..(1814): Any amino acid
  MOD_RES (1825)..(1883): Any amino acid
  MOD_RES (1900)..(1901): Any amino acid
  MOD_RES (1920)..(2275): Any amino acid
  MOD_RES (2308)..(2556): Any amino acid
MKMGSNDASAAAAXXXXXXXXXXXXXXXXSNMAVTLKRALGARXXXXXXXXXXXGPPRPPTPELIKXVPPPPPNGEDDXXXXXXXXDGVSGLPDLSTVXXXXXXSTAFSVPPLNQRENRDAKEPLTGTIIEMWDGEIYHYGLYVERGLILGVHKPPAAISLARVELTPLSLYWRPVYAPQYLISPDALXRLHGESFPYTAFDNXXXXXXXXXLDLNDSWLCRRMIQRTTDFFKPYQDWNRKPLPTTDDSKLKKAANIFLCALSSLFTRPIKDIIGKLRPLNILNILATCDWTFAGIVESLILMAELSGVFWTPPDXXXMIAPLLGDYELQXXXXXXXXXXXXXXGGIGMVLGFTAEKXXXVMKSAVDGLRACKDLGNYALDXXXXXKKYFFGGDQTXXXXXILRAIEDAVLXXXXXXXXXXXXXXXXXXXXXXXXXXXXXEEEKARRLSXXXXXXXXXXXXXXXXXXXXAARSLLHKAKXXXXXXXXXXXXMISGKPGIGKTHXXXXXXXXXXXXXXGDQRVGLVPREGVDHWDAYRGEEVMLWDDYGMXXXXXXXXXLQAIADTCPVSLNCDRIENKGMXXXSDAIIITTNLVGPAPVDFVNLGPVCRRIDFLVYADXXXXXXXXXXXXXXXXXXXXXXXXXXXXXXXXLAPQGGFDNQGNXXXXXXXXXXXXXXXXXXXXXALTMERQDEXXXXXXXXXXXXXXXNRVSAFRKLAADNKYGIXXXXXXXXXXXXXXXXXXXXXXXXXXXXXXXXXXXXXXXXXXXXXXXXXXXXXXXXXXXXXXXXXXXXXXXXXXXARIRYYVRCXXXXXXXXXXXXXXXXXXXXXXXXXXXXXXXXXXXXXXXXXXXXXXXXXXXXXXXXXXXXXXXXXXXXXXXXXXXXGRGRKHTAFSSKGLSDEEYDEFKRIREERQGRYTIEEYLQDRDRYYEEVAVAKATEENFCEEEEIKIRQRIFRPTKKQRKEERXXXXXXXXXXXRKRNPDDFQPKGNLWADDTRSVXXXXXXXXXXXXXXXXXXXXLGTGWGFWVSSNLXXXXXXXXXXXXXXXXXXXXXXXXXXXXXXXXXXXXXXXXXXXXXGLVLEEGAPEGTVAXXXXXXXSGELLPLAVRMGTHATMRIQGRLVHGQMGMLLTGANAKNMDLGTIPGDCGAPYVHKRXXXXXVAGVHAAATKSGNTVVCAVQAXXXXXXXXXXXXXXLGHYAGHEIVXXXXGPALSTKTKFWRSSPXALPPGVYEPAYLGGRDPRVXXGPSLQQVMRDQLRPFTXXXXXXXXXXXXXXXXXXXXXXXXXXXXXXXXXXXXDACQSLDKTTSSGSPHXXXXXXXXXXXXXXXXLGEQASKANLMYEXXXXXXPVYTAALKDELVKPEKXXXKVKKRLLWGSDLGTMXRAARAFGPFCXXXXXXXXXXXXXXGMNSIEDGPXXXXXXXXXXXHFDADYSKWDSTQQXXXXXXXXXXXXXXXXXXXXXXXXXXXXXXXXXXXXXXXXXXXXEGLPSGFPCTSQVNSXXXXXXXXXXXXXXXXXXXXXXXXXXXFSFDGDDEIVSTDVXXXXXXXXXXXXXYGLVPTRPDKSEGPIXXXXXXXXXXXXXXXXXXXXXXXXXXXXXXXXXXXXXXXXXXXXXXXXXXXXXXXXXXXXXXXLLGEASLHGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFAAGKXXXXXXXXXXXXXXXXXXXXXXXXXXXXXXXXXXXXXXXXXXXXXXXXXXXXXXXXXXXRLVAMLYTPLRSNGSGXXFTVSCRVLTRPAPDFEFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNGAGRRRALMAQAVLGAIAASAAGSALGAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265684 - protein, 2556 aa, Norovirus
  MOD_RES (1)..(1): Any amino acid
  MOD_RES (14)..(29): Any amino acid
  MOD_RES (40)..(54): Any amino acid
  MOD_RES (67)..(67): Any amino acid
  MOD_RES (79)..(86): Any amino acid
  MOD_RES (99)..(104): Any amino acid
  MOD_RES (138)..(140): Any amino acid
  MOD_RES (154)..(154): Any amino acid
  MOD_RES (189)..(189): Any amino acid
  MOD_RES (204)..(217): Any amino acid
  MOD_RES (235)..(237): Any amino acid
  MOD_RES (267)..(268): Any amino acid
  MOD_RES (314)..(344): Any amino acid
  MOD_RES (358)..(360): Any amino acid
  MOD_RES (382)..(386): Any amino acid
  MOD_RES (397)..(401): Any amino acid
  MOD_RES (412)..(440): Any amino acid
  MOD_RES (450)..(469): Any amino acid
  MOD_RES (480)..(491): Any amino acid
  MOD_RES (504)..(517): Any amino acid
  MOD_RES (550)..(558): Any amino acid
  MOD_RES (581)..(583): Any amino acid
  MOD_RES (619)..(650): Any amino acid
  MOD_RES (663)..(683): Any amino acid
  MOD_RES (693)..(707): Any amino acid
  MOD_RES (725)..(799): Any amino acid
  MOD_RES (809)..(884): Any amino acid
  MOD_RES (895)..(897): Any amino acid
  MOD_RES (966)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1183)..(1196): Any amino acid
  MOD_RES (1207)..(1210): Any amino acid
  MOD_RES (1226)..(1226): Any amino acid
  MOD_RES (1236)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1396)..(1409): Any amino acid
  MOD_RES (1419)..(1429): Any amino acid
  MOD_RES (1444)..(1487): Any amino acid
  MOD_RES (1503)..(1529): Any amino acid
  MOD_RES (1544)..(1556): Any amino acid
  MOD_RES (1572)..(1634): Any amino acid
  MOD_RES (1644)..(1814): Any amino acid
  MOD_RES (1825)..(1883): Any amino acid
  MOD_RES (1900)..(1901): Any amino acid
  MOD_RES (1920)..(2275): Any amino acid
  MOD_RES (2308)..(2556): Any amino acid
XKMASNDAFAAAVXXXXXXXXXXXXXXXXSNMAVTLKRAXXXXXXXXXXXXXXXKPPRPPTPELAKXTPPPPPNGEEEXXXXXXXXDGVSGLPELTTVXXXXXXNTALSVPPLSQRESRDAKEPLTGTNLEMWDGEIXXXGLYVDRGLVLGVHXPPAAISFAKVELATLSLFWRPVYTPQYPISPDTLXRLHGEAFPYTAFDNXXXXXXXXXXXXXXSWLSRRMIQRTTGFFKPXXXWNRKPLPTVDDPKLKKVANIVLCALSSLFXXPIKDIIGKLKPLNILNILASCDWTFAGVAESLILLAELSGVFWTPXXXXXXXXXXXXXXXXXXXXXXXXXXXXXXXGGIGLAIGFTRDKXXXMMKNAVDSLRAATQLGQYGLEXXXXXMKWFFPKKDEXXXXXTVRAIEDAVLXXXXXXXXXXXXXXXXXXXXXXXXXXXXXEEERVRELSXXXXXXXXXXXXXXXXXXXXMARSALAKAQXXXXXXXXXXXXMMCGPPGIGKTKXXXXXXXXXXXXXXPGGKVGLVPRNAVDHWDGYHGERIVLWDDYGMXXXXXXXXXLQAIADSAPLTLNCDRIEKKGLXXXSDAIVITTNAPGPAPVDHVNFEACSRRVDFLVYAEXXXXXXXXXXXXXXXXXXXXXXXXXXXXXXXXLAPQGGFDKNGKXXXXXXXXXXXXXXXXXXXXXGLVHERRDEXXXXXXXXXXXXXXXNKIAAFRKLAAENKYGMXXXXXXXXXXXXXXXXXXXXXXXXXXXXXXXXXXXXXXXXXXXXXXXXXXXXXXXXXXXXXXXXXXXXXXXXXXXARARYYISCXXXXXXXXXXXXXXXXXXXXXXXXXXXXXXXXXXXXXXXXXXXXXXXXXXXXXXXXXXXXXXXXXXXXXXXXXXXXGRGKKHAAFSXXXLRDEEYDEYKRIREERQGKYSIEEYLRDRDRYYEELAIARATEEDFCEEEIARLRQWNFQPTRKQRKEXXXXXXXXXXXXXRKRRPDDFQPKGKLWADDNRSVXXXXXXXXXXXXXXXXXXXXFGSGWGFWVSPTVXXXXXXXXXXXXXXXXXXXXXXXXXXXXXXXXXXXXXXXXXXXXXGMVLEEGAPEGTVCXXXXXXXTGEMIPLAVRMGTHASMKIQGKMLGGQSGMLLTGANAKGMDLGTGPGDCGAPYVYKRXXXXXVCGVHTAAARGENTVVCATQGXXXXXXXXXXXXXXKGHYAGHEIIXXXXAPALSSKTKFWRSSNXSLPPGTYEPXXXXXXXXXXXXGPSLQQVMREQLKPFTXXXXXXXXXXXXXXXXXXXXXXXXXXXXXXXXXXXXDACMSLDKTTSSGYPHXXXXXXXXXXXXXXXXLADQAAHANNMYEXXXXXXPIYTAALKDELVKTEKXXXRIKKRLLWGSDLSTMXRCARSFGGLMXXXXXXXXXXXXXXGMNTIEDGPXXXXXXXXXXXHFDADYTAWDSTQNXXXXXXXXXXXXXXXXXXXXXXXXXXXXXXXXXXXXXXXXXXXXDGPPSGVPCTSQLNSXXXXXXXXXXXXXXXXXXXXXXXXXXXYSFYGDDEIVSTDLXXXXXXXXXXXXXYGLRPTRPDKTEGPIXXXXXXXXXXXXXXXXXXXXXXXXXXXXXXXXXXXXXXXXXXXXXXXXXXXXXXXXXXXXXXXLLGEAALHEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNALTAGKXXXXXXXXXXXXXXXXXXXXXXXXXXXXXXXXXXXXXXXXXXXXXXXXXXXXXXXXXXXRILAYLYTPLRANNSGXXVFTDSCRVLTRPTPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNGTGRRRVLMAQAIFGAIAASAAGSILGAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265685 - protein, 2556 aa, Norovirus
  MOD_RES (1)..(2): Any amino acid
  MOD_RES (14)..(29): Any amino acid
  MOD_RES (40)..(54): Any amino acid
  MOD_RES (67)..(67): Any amino acid
  MOD_RES (79)..(86): Any amino acid
  MOD_RES (98)..(104): Any amino acid
  MOD_RES (131)..(158): Any amino acid
  MOD_RES (176)..(177): Any amino acid
  MOD_RES (189)..(189): Any amino acid
  MOD_RES (199)..(242): Any amino acid
  MOD_RES (266)..(268): Any amino acid
  MOD_RES (291)..(291): Any amino acid
  MOD_RES (312)..(344): Any amino acid
  MOD_RES (358)..(360): Any amino acid
  MOD_RES (382)..(386): Any amino acid
  MOD_RES (397)..(401): Any amino acid
  MOD_RES (411)..(440): Any amino acid
  MOD_RES (450)..(469): Any amino acid
  MOD_RES (480)..(491): Any amino acid
  MOD_RES (504)..(517): Any amino acid
  MOD_RES (550)..(558): Any amino acid
  MOD_RES (581)..(583): Any amino acid
  MOD_RES (593)..(593): Any amino acid
  MOD_RES (603)..(609): Any amino acid
  MOD_RES (619)..(652): Any amino acid
  MOD_RES (663)..(683): Any amino acid
  MOD_RES (693)..(707): Any amino acid
  MOD_RES (725)..(799): Any amino acid
  MOD_RES (809)..(900): Any amino acid
  MOD_RES (923)..(924): Any amino acid
  MOD_RES (964)..(978): Any amino acid
  MOD_RES (1001)..(1022): Any amino acid
  MOD_RES (1034)..(1078): Any amino acid
  MOD_RES (1093)..(1104): Any amino acid
  MOD_RES (1157)..(1161): Any amino acid
  MOD_RES (1182)..(1196): Any amino acid
  MOD_RES (1206)..(1210): Any amino acid
  MOD_RES (1226)..(1226): Any amino acid
  MOD_RES (1236)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1369): Any amino acid
  MOD_RES (1385)..(1385): Any amino acid
  MOD_RES (1396)..(1409): Any amino acid
  MOD_RES (1419)..(1429): Any amino acid
  MOD_RES (1444)..(1487): Any amino acid
  MOD_RES (1503)..(1529): Any amino acid
  MOD_RES (1540)..(1556): Any amino acid
  MOD_RES (1572)..(1634): Any amino acid
  MOD_RES (1644)..(1814): Any amino acid
  MOD_RES (1824)..(1883): Any amino acid
  MOD_RES (1900)..(1906): Any amino acid
  MOD_RES (1920)..(2285): Any amino acid
  MOD_RES (2308)..(2556): Any amino acid
XXNASNDASATAVXXXXXXXXXXXXXXXXSSMAVTLKRAXXXXXXXXXXXXXXXSPSRPPTPELVRXIPPPPPNGEGEXXXXXXXXNGISGLPELSTXXXXXXXNTVFSIPPLNQGKSRDAREPLTGTILXXXXXXXXXXXXXXXXXXXXXXXXXXXXISLARVELAPLSLYWRPXXTPQYLISPDSLXKLHGESFPYXXXXXXXXXXXXXXXXXXXXXXXXXXXXXXXXXXXXXXXXXXXXLPTMDDSKVKKVANLFLCALSSLXXXPIKDLIGKVRPLNVINILASCDXTFAGKVESLILLADLFGVFWXXXXXXXXXXXXXXXXXXXXXXXXXXXXXXXXXGGVGLAIGFTKDKXXXLLSSAASTLKACREIGNYGIEXXXXXMKWFFPTKDEXXXXXMVRAIEDAVXXXXXXXXXXXXXXXXXXXXXXXXXXXXXXEEEKARTLSXXXXXXXXXXXXXXXXXXXXAARSLVHKAKXXXXXXXXXXXXMISGRPGIGKTPXXXXXXXXXXXXXXGDQRIGLVPRNGVDHWDGYKGQRAVLRLDYVLXXXXXXXXXIQELADTAPVSLNCDRIEKKGMXXXSDTIIITTNXTSPAPLDYVXXXXXXXRVDFLVYCSXXXXXXXXXXXXXXXXXXXXXXXXXXXXXXXXXXPQGGFDQNGNXXXXXXXXXXXXXXXXXXXXXGLVHERKDEXXXXXXXXXXXXXXXNKIAAFRKLAADNNYGFXXXXXXXXXXXXXXXXXXXXXXXXXXXXXXXXXXXXXXXXXXXXXXXXXXXXXXXXXXXXXXXXXXXXXXXXXXXARARYYVSCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEYDEYKRLREERGGKYTIEEYXXDRDRYYEELAIARATEDNFCEEDEAKIRRRVFRPTRKQRXXXXXXXXXXXXXXXRRRNADDFQPKGKLWADDDRNVXXXXXXXXXXXXXXXXXXXXXXTGWGFWVSSSLXXXXXXXXXXXXXXXXXXXXXXXXXXXXXXXXXXXXXXXXXXXXXGLILEEGCPEGTVCXXXXXXXXXXXXPLAVRMGAIASMRIQGKVMHGQSGMLLTGSNAKNMDLGTFPGDCGCPYVYKRXXXXXGIGVHTAATRSGNTVVCAIQXXXXXXXXXXXXXXXHGTYCGAPIXXXXXGPTLSTKTKFWKSSPXPLPPGVYEPXXXXXXXXXXXXCPSLQQVLRDQLKPFAXXXXXXXXXXXXXXXXXXXXXXXXXXXXXXXXXXXXQACVSLDKTTSSGHPYXXXXXXXXXXXXXXXXLANQASRANLMYEXXXXXXPMYTAALKDELVKTDRXXXTIKKRLLWGADLGTVXRCARAFGGLLXXXXXXXXXXXXXXGMNAIEDGPXXXXXXXXXXXHYDADYSAWDSTQNXXXXXXXXXXXXXXXXXXXXXXXXXXXXXXXXXXXXXXXXXXXXEGLPSGVPCTSQRNSXXXXXXXXXXXXXXXXXXXXXXXXXXXFSFYGDDDIVXXXXXXXXXXXXXXXXXYGLIPTRPDKTDGPIXXXXXXXXXXXXXXXXXXXXXXXXXXXXXXXXXXXXXXXXXXXXXXXXXXXXXXXXXXXXXXXLLGESSLHGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAGNAFTAGXXXXXXXXXXXXXXXXXXXXXXXXXXXXXXXXXXXXXXXXXXXXXXXXXXXXXXXXXXXXRLLAYLYTPLRANSGEXXXXXXXCRVLTRPSPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAVIGAIAASTAGSAVSAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265686 - protein, 2556 aa, Norovirus
  MOD_RES (1)..(2): Any amino acid
  MOD_RES (14)..(30): Any amino acid
  MOD_RES (40)..(69): Any amino acid
  MOD_RES (79)..(86): Any amino acid
  MOD_RES (96)..(108): Any amino acid
  MOD_RES (123)..(158): Any amino acid
  MOD_RES (176)..(178): Any amino acid
  MOD_RES (188)..(189): Any amino acid
  MOD_RES (199)..(245): Any amino acid
  MOD_RES (266)..(269): Any amino acid
  MOD_RES (286)..(299): Any amino acid
  MOD_RES (309)..(344): Any amino acid
  MOD_RES (358)..(360): Any amino acid
  MOD_RES (382)..(386): Any amino acid
  MOD_RES (396)..(401): Any amino acid
  MOD_RES (411)..(469): Any amino acid
  MOD_RES (480)..(491): Any amino acid
  MOD_RES (504)..(517): Any amino acid
  MOD_RES (548)..(558): Any amino acid
  MOD_RES (581)..(583): Any amino acid
  MOD_RES (593)..(609): Any amino acid
  MOD_RES (619)..(653): Any amino acid
  MOD_RES (663)..(683): Any amino acid
  MOD_RES (693)..(707): Any amino acid
  MOD_RES (725)..(799): Any amino acid
  MOD_RES (809)..(900): Any amino acid
  MOD_RES (921)..(926): Any amino acid
  MOD_RES (955)..(978): Any amino acid
  MOD_RES (1001)..(1023): Any amino acid
  MOD_RES (1034)..(1078): Any amino acid
  MOD_RES (1093)..(1108): Any amino acid
  MOD_RES (1131)..(1161): Any amino acid
  MOD_RES (1181)..(1196): Any amino acid
  MOD_RES (1206)..(1210): Any amino acid
  MOD_RES (1220)..(1248): Any amino acid
  MOD_RES (1263)..(1306): Any amino acid
  MOD_RES (1316)..(1350): Any amino acid
  MOD_RES (1367)..(1369): Any amino acid
  MOD_RES (1384)..(1386): Any amino acid
  MOD_RES (1396)..(1409): Any amino acid
  MOD_RES (1419)..(1429): Any amino acid
  MOD_RES (1444)..(1491): Any amino acid
  MOD_RES (1503)..(1529): Any amino acid
  MOD_RES (1539)..(1556): Any amino acid
  MOD_RES (1566)..(1634): Any amino acid
  MOD_RES (1644)..(1883): Any amino acid
  MOD_RES (1900)..(1910): Any amino acid
  MOD_RES (1920)..(2285): Any amino acid
  MOD_RES (2308)..(2556): Any amino acid
XXMASNDASAADVXXXXXXXXXXXXXXXXXNVAVTLKRAXXXXXXXXXXXXXXXXXXXXXXXXXXXXXXPPPSNGEDDXXXXXXXXEGVSGLPELXXXXXXXXXXXXXSVPPLNQRESRDAKXXXXXXXXXXXXXXXXXXXXXXXXXXXXXXXXXXXXISLAKVELTTLSLFWRPXXXPQYLISPDSXXKLHGEAFPYXXXXXXXXXXXXXXXXXXXXXXXXXXXXXXXXXXXXXXXXXXXXXXXMDDSKLKKVANVFLCALSSLXXXXIKDIIGKLRPLNVINIXXXXXXXXXXXXXXLILLADLFGXXXXXXXXXXXXXXXXXXXXXXXXXXXXXXXXXXXXGEIGMVLGFTKERXXXLLKSAADTLRAAKDLGAYGLDXXXXXVKWFFPKKEXXXXXXLVRAIEDAVXXXXXXXXXXXXXXXXXXXXXXXXXXXXXXXXXXXXXXXXXXXXXXXXXXXXXXXXXXXMARAALAKAQXXXXXXXXXXXXIISRRPGIGKTHXXXXXXXXXXXXXXGDQRVGLVPREGVGHWDAYKEEEVLLWDDYXXXXXXXXXXXLQELGDTAPLSLNCDRSANKGKXXXSEAIVITTNXXXXXXXXXXXXXXXXXRVDFLVYCTXXXXXXXXXXXXXXXXXXXXXXXXXXXXXXXXXXXQGGFDKSGNXXXXXXXXXXXXXXXXXXXXXGLLHERMDEXXXXXXXXXXXXXXXDKVSAFRKLAADNKYSLXXXXXXXXXXXXXXXXXXXXXXXXXXXXXXXXXXXXXXXXXXXXXXXXXXXXXXXXXXXXXXXXXXXXXXXXXXXARVRYYVKCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEYDEFKKIREERNGRYSIEXXXXXXDKYYEEVAVARATEEDFAEEEEVKIRQRXXXXXXXXXXXXXXXXXXXXXXXXEKRKPDDFKPRGKLWADDSREVXXXXXXXXXXXXXXXXXXXXXXXGWAFWVSPSLXXXXXXXXXXXXXXXXXXXXXXXXXXXXXXXXXXXXXXXXXXXXXGMILEEGCPEGVVCXXXXXXXXXXXXXXXXRMGAVASMKIQGRLMHGQSGMLXXXXXXXXXXXXXXXXXXXXXXXXXXXXXXXVIGVHTAAARAGNTVICATXXXXXXXXXXXXXXXXRGTYCGAPIXXXXXAPKFSTKTKXXXXXXXXXXXXXXXXXXXXXXXXXXXXXLSLQQIMRDQLKPFXXXXXXXXXXXXXXXXXXXXXXXXXXXXXXXXXXXXXXXXXXXXKTTSSGDPHXXXXXXXXXXXXXXXXXXXXXXXXXXXXXXXXXXXPLYTAALKDELVKTSKXXXTIKKRLLWGADLSTXXXCVRAFGGLMXXXXXXXXXXXXXXGLNMNEDGPXXXXXXXXXXXSFDADYSRWDSIQQXXXXXXXXXXXXXXXXXXXXXXXXXXXXXXXXXXXXXXXXXXXXXXXXPGVPCTSQWDSXXXXXXXXXXXXXXXXXXXXXXXXXXXYSFYGDDYIXXXXXXXXXXXXXXXXXXIGLVPTRPDXXXXXXXXXXXXXXXXXXXXXXXXXXXXXXXXXXXXXXXXXXXXXXXXXXXXXXXXXXXXXXXXXXXXXLLGESALHGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLAYLYTPLRANSPTXXXXXXXXXXXTRPSQDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAIIGAIAATAACSAVGAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265687 - protein, 2556 aa, Norovirus
  MOD_RES (13)..(29): Any amino acid
  MOD_RES (44)..(54): Any amino acid
  MOD_RES (67)..(68): Any amino acid
  MOD_RES (79)..(87): Any amino acid
  MOD_RES (99)..(110): Any amino acid
  MOD_RES (189)..(189): Any amino acid
  MOD_RES (331)..(344): Any amino acid
  MOD_RES (358)..(370): Any amino acid
  MOD_RES (382)..(386): Any amino acid
  MOD_RES (397)..(401): Any amino acid
  MOD_RES (413)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (619)..(650): Any amino acid
  MOD_RES (663)..(707): Any amino acid
  MOD_RES (725)..(884): Any amino acid
  MOD_RES (968)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1202)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1385): Any amino acid
  MOD_RES (1396)..(1429): Any amino acid
  MOD_RES (1443)..(1487): Any amino acid
  MOD_RES (1501)..(1530): Any amino acid
  MOD_RES (1544)..(1556): Any amino acid
  MOD_RES (1572)..(1814): Any amino acid
  MOD_RES (1825)..(1883): Any amino acid
  MOD_RES (1900)..(1900): Any amino acid
  MOD_RES (1920)..(2274): Any amino acid
  MOD_RES (2304)..(2556): Any amino acid
MKMASNDASAAAXXXXXXXXXXXXXXXXXSSMAVTFKRALGARXXXXXXXXXXXRPPRPPTPELVKXXPPPPPNGEDEXXXXXXXXXGVSGLPELSTVXXXXXXXXXXXXPPLNQRENRDAKEPLTGTILEMWDGEIYHYGLYVERGLVLGVHKPPAAISLAKVELTPLSLFWRPVYTPQYLISPDTLXKLHGETFPYTAFDNNCYAFCCWVLDLNDSWLSRRMIQRTTGFFRPYQDWNRKPLPTMDDSKLKKVANIFLCTLSSLFTRPIKDIIGKLRPLNIINILASCDWTFAGIVESLILLAELFGVFWTPPDVSAMIAPLLGDFELQXXXXXXXXXXXXXXGGIGLVLGFTKEKXXXXXXXXXXXXXACKDLGAYGLEXXXXXMKWFFPKKEEXXXXXMVRSIEDAVLDXXXXXXXXXXXXXXXXXXXXXXXXXXXXXXXXXXXXXXXXXXXXXXXXXXXXXXXXXXXXXXXXXXXXXXXXXXXXXXXMISGRPGIGKTXXXXXXXXXXXXXXXGDQRVGLIPRNGVDHWDAYKXERVVLWDDYGMXXXXXXXXXXXXXXXXXPLTLNCDRIENKGKXXXXXXIIITTNLANPAPLDYVNFEACSRRIDFLVYAEXXXXXXXXXXXXXXXXXXXXXXXXXXXXXXXXLAPQGGFDKNGNXXXXXXXXXXXXXXXXXXXXXXXXXXXXXXXXXXXXXXXXXXXXXNKVLAFRQLAAENKYGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGKKHTAFSSKGLSDEEYDEYKRIREERNGKYSIEEYLQDRDKYYEEVAIARATEEDFCEEEEAKIRQRIFRPTRKQRKEERXXXXXXXXXXXRKRNPEDFKPKGKLWADDDRSVXXXXXXXXXXXXXXXXXXXXFGSGWGFWVSPSLXXXXXXXXXXXXXXXXXXXXXXXXXXXXXXXXXXXXXXXXXXXXXGMILEEGAPEGTVVXXXXXXXTGELMPLAARMGTHATMKIQGRTVGGQMGMLLTGSNAKSMDLGTTPGDCGCPYIYKRXXXXXVIGVHTAAARGGNTVICATQGGEGEATLEGGGGQNKGHYAXXXXXXXXXAPKLSTKTKFWRSSTXPLPPGTYEPAYLGGKDPRVXXGPSLQQVMRDQLKPFTXXXXXXXXXXXXXXXXXXXXXXXXXXXXXXXXXXXXQACASLDKTTSSGHPHXXXXXXXXXXXXXXXXLADQASKANLMFEXXXXXXPVYTGALKDELVKTDKXXXXIKKRLLWGSDLATMXRCARAFGGLMXXXXXXXXXXXXXXXXXXXXXXXXXXXXXXXXXXHYDADYSRWDSTQXXXXXXXXXXXXXXXXXXXXXXXXXXXXXXXXXXXXXXXXXXXXXEGLPSGVPCTSQWXXXXXXXXXXXXXXXXXXXXXXXXXXXXXXSFYGDDEIVSTDIXXXXXXXXXXXXXYGLKPTRPDKTEGPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFTAGKXXXXXXXXXXXXXXXXXXXXXXXXXXXXXXXXXXXXXXXXXXXXXXXXXXXXXXXXXXXKLIAMLYTPLRANNAGXDVFTVSCRVLTRPSPDFDFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGNGTGRRRALMAQAIIGAIAATAAGSAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265688 - protein, 2556 aa, Norovirus
  MOD_RES (13)..(29): Any amino acid
  MOD_RES (44)..(54): Any amino acid
  MOD_RES (67)..(68): Any amino acid
  MOD_RES (79)..(87): Any amino acid
  MOD_RES (99)..(110): Any amino acid
  MOD_RES (189)..(189): Any amino acid
  MOD_RES (205)..(211): Any amino acid
  MOD_RES (331)..(344): Any amino acid
  MOD_RES (358)..(370): Any amino acid
  MOD_RES (382)..(386): Any amino acid
  MOD_RES (397)..(401): Any amino acid
  MOD_RES (413)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (619)..(650): Any amino acid
  MOD_RES (663)..(707): Any amino acid
  MOD_RES (725)..(884): Any amino acid
  MOD_RES (968)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1183)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1385): Any amino acid
  MOD_RES (1396)..(1429): Any amino acid
  MOD_RES (1443)..(1487): Any amino acid
  MOD_RES (1501)..(1533): Any amino acid
  MOD_RES (1544)..(1556): Any amino acid
  MOD_RES (1572)..(1814): Any amino acid
  MOD_RES (1825)..(1883): Any amino acid
  MOD_RES (1900)..(1900): Any amino acid
  MOD_RES (1920)..(2274): Any amino acid
  MOD_RES (2304)..(2556): Any amino acid
MKMASNDAFAAAXXXXXXXXXXXXXXXXXSNMAVTLKRALGARXXXXXXXXXXXGPPRPPTPELIKXXPPPPPNGEDDXXXXXXXXXGVSGLPDLSTVXXXXXXXXXXXXPPLSQRENRDAKEPLTGTIIEMWDGEIYHYGLYVERGLILGVHKPPAAISLARVELTPLSLYWRPVYAPQYLISPDALXRLHGESFPYTAFDNNXXXXXXXVLDLNDSWLCRRMIQRTTGFFRPYQDWNRKPLPTTDDSKLKKAANIFLCALSSLFTRPIKDIIGKLRPLNILNILATCDWTFAGIVESLILMADLFGVFWTPPVVSAMIAPLLGDYELQXXXXXXXXXXXXXXGGIGMVLGFTAEKXXXXXXXXXXXXXACKDLGNYALDXXXXXKKYFFGGDQTXXXXXILRAIEDAVLDXXXXXXXXXXXXXXXXXXXXXXXXXXXXXXXXXXXXXXXXXXXXXXXXXXXXXXXXXXXXXXXXXXXXXXXXXXXXXXXMISGKPGIGKTXXXXXXXXXXXXXXXGDQRVGLVPRNGVDHWDAYRXEEVMLWDDYGMXXXXXXXXXXXXXXXXXPVSLNCDRIENKGMXXXXXXIIITTNLVGPAPVDFVNLGPVCRRIDFLVYADXXXXXXXXXXXXXXXXXXXXXXXXXXXXXXXXLAPQGGFDNQGNXXXXXXXXXXXXXXXXXXXXXXXXXXXXXXXXXXXXXXXXXXXXXNRVSAFRKLAADNKYGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGRKHTAFSSKGLSDEEYDEFKRIREERQGKYTIEEYLQDRDRYYEEVAVAKATEENFCEEEEIKIRQRIFRPTKKQRKEERXXXXXXXXXXXRKRNPDDFQPKGNLWADDTRSVXXXXXXXXXXXXXXXXXXXXLGTGWGFWVSSNLXXXXXXXXXXXXXXXXXXXXXXXXXXXXXXXXXXXXXXXXXXXXXGLVLEEGAPEGTVAXXXXXXXSGELIPLAVRMGTHATMRIQGRLVHGQMGMLLTGANAKNMDLGTIPGDCGAPYVHKRXXXXXVAGVHAAATKSGNTVVCAVQAXXXXXXXXXXXXXXXXXXXXXXXXXXXXGPALSTKTKFWRSSPXALPPGTYEPAYLGGRDPRVXXGPSLQQVMRDQLRPFTXXXXXXXXXXXXXXXXXXXXXXXXXXXXXXXXXXXXDACQSLDKTTSSGSPHXXXXXXXXXXXXXXXXLGDQASKANLMYEXXXXXXPVYTAALKDELVKPEKXXXXVKKRLLWGSDLGTMXRAARAFGPFCXXXXXXXXXXXXXXXXXXXXXXXXXXXXXXXXXXHFDADYTAWDSTQXXXXXXXXXXXXXXXXXXXXXXXXXXXXXXXXXXXXXXXXXXXXXEGLPSGFPCTSQVXXXXXXXXXXXXXXXXXXXXXXXXXXXXXXXXXGDDEIVSTDVXXXXXXXXXXXXXYGLVPTRPDKSEGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFAAGKXXXXXXXXXXXXXXXXXXXXXXXXXXXXXXXXXXXXXXXXXXXXXXXXXXXXXXXXXXXRLVAMLYTPLRSNGSGXVFTVSCRVLTRPAPDFEFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGNGAGRRRALMAQAIFGAIAASAAGSILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265689 - protein, 2556 aa, Norovirus
  MOD_RES (13)..(29): Any amino acid
  MOD_RES (41)..(54): Any amino acid
  MOD_RES (67)..(68): Any amino acid
  MOD_RES (79)..(87): Any amino acid
  MOD_RES (99)..(110): Any amino acid
  MOD_RES (139)..(139): Any amino acid
  MOD_RES (189)..(189): Any amino acid
  MOD_RES (205)..(216): Any amino acid
  MOD_RES (315)..(344): Any amino acid
  MOD_RES (358)..(370): Any amino acid
  MOD_RES (382)..(386): Any amino acid
  MOD_RES (397)..(401): Any amino acid
  MOD_RES (413)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (619)..(650): Any amino acid
  MOD_RES (663)..(707): Any amino acid
  MOD_RES (725)..(884): Any amino acid
  MOD_RES (896)..(896): Any amino acid
  MOD_RES (967)..(978): Any amino acid
  MOD_RES (1001)..(1020): Any amino acid
  MOD_RES (1034)..(1078): Any amino acid
  MOD_RES (1093)..(1099): Any amino acid
  MOD_RES (1157)..(1161): Any amino acid
  MOD_RES (1183)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1385): Any amino acid
  MOD_RES (1396)..(1429): Any amino acid
  MOD_RES (1443)..(1487): Any amino acid
  MOD_RES (1501)..(1533): Any amino acid
  MOD_RES (1544)..(1556): Any amino acid
  MOD_RES (1572)..(1814): Any amino acid
  MOD_RES (1825)..(1883): Any amino acid
  MOD_RES (1900)..(1900): Any amino acid
  MOD_RES (1920)..(2274): Any amino acid
  MOD_RES (2304)..(2556): Any amino acid
MKMASNDASAVAXXXXXXXXXXXXXXXXXSNMAVTLKRALXXXXXXXXXXXXXXKPPRPPTPELAKXXPPPPPNGEEEXXXXXXXXXGVSGLPELTTVXXXXXXXXXXXXPPLNQRESRDAKEPLTGTNLEMWDGEIYXYGLYVDRGLVLGVHKPPAAISFAKVELATLSLFWRPVYTPQYLISPDSLXRLHGEAFPYTAFDNNXXXXXXXXXXXXDSWLSRRMIQRTTGFFRPYQDWNRKPLPTVDDSKVKKVANIVLCALSSLFTRPIKDIIGKLKPLNILNILASCDWSFAGVAESLILLAALFGVFWTPPXXXXXXXXXXXXXXXXXXXXXXXXXXXXXXGGIGLAIGFTRDKXXXXXXXXXXXXXAATQLGQYGLEXXXXXMKWFFPKKDEXXXXXTVRAIEDAVLDXXXXXXXXXXXXXXXXXXXXXXXXXXXXXXXXXXXXXXXXXXXXXXXXXXXXXXXXXXXXXXXXXXXXXXXXXXXXXXXMMCGPPGIGKTXXXXXXXXXXXXXXXPGGKVGLVPREAVDHWDGYHXERIVLWDDYGMXXXXXXXXXXXXXXXXXPLTLNCDRIEKKGLXXXXXXIVITTNAPSPAPLDFVNFEACSRRVDFLVYAEXXXXXXXXXXXXXXXXXXXXXXXXXXXXXXXXLAPQGGFDKNGKXXXXXXXXXXXXXXXXXXXXXXXXXXXXXXXXXXXXXXXXXXXXXNKIAAFRQLAAENKYGMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGCGKKHTAFSSXGLRDEEYDEYKRIREERGGKYSIEEYLQDRDRYYEELAIARATEEDFCEEDEARIRQRIFRPTSKLRKEDXXXXXXXXXXXXRKRRPDDFQPKGKLWADDNRSVXXXXXXXXXXXXXXXXXXXXFGSGWGFWVSPTVXXXXXXXXXXXXXXXXXXXXXXXXXXXXXXXXXXXXXXXXXXXXXGMVLEEGAPEGTVCXXXXXXXTGEMLPLAVRMGTHASMKIQGKMLGGQSGMLLTGANAKGMDLGTGPGDCGAPYVYKRXXXXXVCGVHTAATRGENTVICATQGXXXXXXXXXXXXXXXXXXXXXXXXXXXXAPALSTKTKFWRSSNXSLPPGVYEPAYLGGKDPRIXXGPSLQQVMREQLKPFTXXXXXXXXXXXXXXXXXXXXXXXXXXXXXXXXXXXXQACMSLDKTTSSGYPHXXXXXXXXXXXXXXXXLAEQAAHANNMYEXXXXXXPMYTAALKDELVKTEKXXXXIKKRLLWGSDLSTMXRCARAFGGLLXXXXXXXXXXXXXXXXXXXXXXXXXXXXXXXXXXHFDADYSAWDSTQXXXXXXXXXXXXXXXXXXXXXXXXXXXXXXXXXXXXXXXXXXXXXDGLPSGVPCTSQLXXXXXXXXXXXXXXXXXXXXXXXXXXXXXXXXXGDDEIVSTDLXXXXXXXXXXXXXYGLRPTRPDKTEGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNALTAGKXXXXXXXXXXXXXXXXXXXXXXXXXXXXXXXXXXXXXXXXXXXXXXXXXXXXXXXXXXXRIVAMLYTPLRANNSGXVVFTVSCRVLTRPTPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMGNGTGRRRVLMAQAVIGAIAASAAGSALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265690 - protein, 2556 aa, Norovirus
  MOD_RES (1)..(1): Any amino acid
  MOD_RES (13)..(29): Any amino acid
  MOD_RES (41)..(54): Any amino acid
  MOD_RES (67)..(68): Any amino acid
  MOD_RES (79)..(87): Any amino acid
  MOD_RES (99)..(110): Any amino acid
  MOD_RES (132)..(157): Any amino acid
  MOD_RES (189)..(189): Any amino acid
  MOD_RES (200)..(220): Any amino acid
  MOD_RES (231)..(241): Any amino acid
  MOD_RES (266)..(267): Any amino acid
  MOD_RES (313)..(344): Any amino acid
  MOD_RES (358)..(370): Any amino acid
  MOD_RES (382)..(386): Any amino acid
  MOD_RES (397)..(401): Any amino acid
  MOD_RES (412)..(491): Any amino acid
  MOD_RES (503)..(517): Any amino acid
  MOD_RES (538)..(538): Any amino acid
  MOD_RES (550)..(566): Any amino acid
  MOD_RES (581)..(592): Any amino acid
  MOD_RES (619)..(650): Any amino acid
  MOD_RES (663)..(707): Any amino acid
  MOD_RES (725)..(898): Any amino acid
  MOD_RES (965)..(978): Any amino acid
  MOD_RES (1001)..(1021): Any amino acid
  MOD_RES (1034)..(1078): Any amino acid
  MOD_RES (1093)..(1103): Any amino acid
  MOD_RES (1157)..(1161): Any amino acid
  MOD_RES (1183)..(1210): Any amino acid
  MOD_RES (1226)..(1226): Any amino acid
  MOD_RES (1242)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1372): Any amino acid
  MOD_RES (1385)..(1385): Any amino acid
  MOD_RES (1396)..(1429): Any amino acid
  MOD_RES (1441)..(1487): Any amino acid
  MOD_RES (1501)..(1556): Any amino acid
  MOD_RES (1572)..(1814): Any amino acid
  MOD_RES (1825)..(1883): Any amino acid
  MOD_RES (1900)..(1900): Any amino acid
  MOD_RES (1920)..(2285): Any amino acid
  MOD_RES (2304)..(2556): Any amino acid
XKRGSNDASAAAXXXXXXXXXXXXXXXXXSSMAVTLKRALXXXXXXXXXXXXXXSPPRPPTPELVRXXPPPPHNGEDEXXXXXXXXXGISGLPELSTVXXXXXXXXXXXXPPLNQRESRDAREPLTGTILEXXXXXXXXXXXXXXXXXXXXXXXXXXAISLARVELAPLSLYWRPVYTPQHLISPDTLXKLHGESFPYTXXXXXXXXXXXXXXXXXXXXXSRRMIQRTTDXXXXXXXXXXXPLPTMDDSKLKKVANVVLCALSSLXXRPIKDLIGKVRPLNVINILASCDWTFAGIVESLILLAELSGVFWTXXXXXXXXXXXXXXXXXXXXXXXXXXXXXXXXGGVGMVLGFTKERXXXXXXXXXXXXXACREIGNYGIEXXXXXMKWFFPTKDEXXXXXMVRAIEDAVLXXXXXXXXXXXXXXXXXXXXXXXXXXXXXXXXXXXXXXXXXXXXXXXXXXXXXXXXXXXXXXXXXXXXXXXXXXXXXXXXILSGPPGIGKTXXXXXXXXXXXXXXXGDQRIGLVPRESIDHWDGYHXERVVLWYEYGMXXXXXXXXXXXXXXXXXPLTLNCDRIEKKGMXXXXXXXXXXXXLTSPAPLDYVNFEACSRRVDFLVYCSXXXXXXXXXXXXXXXXXXXXXXXXXXXXXXXXLAPQGGFDKNANXXXXXXXXXXXXXXXXXXXXXXXXXXXXXXXXXXXXXXXXXXXXXNKIAAFRKMAADNRYGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSDEEYDEFKRIREEKQGRYTIEEYLQDRDRYYEELAIARATEEDFCEEEIAKIRQRIFRPTSKLRKXXXXXXXXXXXXXXRRRKLDDFQPKVKLWADDSRSVXXXXXXXXXXXXXXXXXXXXXGTGWGFWVSSSLXXXXXXXXXXXXXXXXXXXXXXXXXXXXXXXXXXXXXXXXXXXXXGLVLEEGCPEGTVCXXXXXXXXXXXLPLAVRMGAIASMRIQGKTIGGQMGMLLTGSNAKNMDLGTFPGDCGCPYVYKRXXXXXGIGVHAAAARSGNTVVCATQGXXXXXXXXXXXXXXXXXXXXXXXXXXXXGPALSTKTKFWKSSPXPLPPGVYEPAYLGGRXXXXXXGPSLQQVLRDQLKPFAXXXXXXXXXXXXXXXXXXXXXXXXXXXXXXXXXXXXDACMSLDKTTSSGHPYXXXXXXXXXXXXXXXXLADQASRANLMYEXXXXXXPIYTAALKDELVKTSKXXXXXXKRLLWGADLGTVXRCARSFGGLMXXXXXXXXXXXXXXXXXXXXXXXXXXXXXXXXXXHYDADYTAWDSXXXXXXXXXXXXXXXXXXXXXXXXXXXXXXXXXXXXXXXXXXXXXXXEGLPSGVPCTSQRXXXXXXXXXXXXXXXXXXXXXXXXXXXXXXXXXXXXXXXXXXXXXXXXXXXXXXXXYGLIPTRPDKTDGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAGNAFTAGKXXXXXXXXXXXXXXXXXXXXXXXXXXXXXXXXXXXXXXXXXXXXXXXXXXXXXXXXXXXRLIAYLYTPLRANSGEXDVFTDSCRVLTRPSPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAVLGAIAASTAGSALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265691 - protein, 2556 aa, Norovirus
  MOD_RES (1)..(1): Any amino acid
  MOD_RES (13)..(29): Any amino acid
  MOD_RES (41)..(56): Any amino acid
  MOD_RES (67)..(68): Any amino acid
  MOD_RES (79)..(110): Any amino acid
  MOD_RES (124)..(157): Any amino acid
  MOD_RES (177)..(178): Any amino acid
  MOD_RES (189)..(189): Any amino acid
  MOD_RES (200)..(244): Any amino acid
  MOD_RES (266)..(268): Any amino acid
  MOD_RES (287)..(298): Any amino acid
  MOD_RES (310)..(344): Any amino acid
  MOD_RES (358)..(370): Any amino acid
  MOD_RES (382)..(386): Any amino acid
  MOD_RES (397)..(401): Any amino acid
  MOD_RES (412)..(491): Any amino acid
  MOD_RES (502)..(517): Any amino acid
  MOD_RES (538)..(538): Any amino acid
  MOD_RES (549)..(567): Any amino acid
  MOD_RES (581)..(601): Any amino acid
  MOD_RES (619)..(652): Any amino acid
  MOD_RES (663)..(707): Any amino acid
  MOD_RES (725)..(899): Any amino acid
  MOD_RES (922)..(925): Any amino acid
  MOD_RES (965)..(978): Any amino acid
  MOD_RES (1001)..(1023): Any amino acid
  MOD_RES (1034)..(1078): Any amino acid
  MOD_RES (1093)..(1108): Any amino acid
  MOD_RES (1132)..(1161): Any amino acid
  MOD_RES (1182)..(1210): Any amino acid
  MOD_RES (1223)..(1247): Any amino acid
  MOD_RES (1264)..(1305): Any amino acid
  MOD_RES (1316)..(1333): Any amino acid
  MOD_RES (1344)..(1350): Any amino acid
  MOD_RES (1367)..(1372): Any amino acid
  MOD_RES (1385)..(1385): Any amino acid
  MOD_RES (1396)..(1429): Any amino acid
  MOD_RES (1440)..(1487): Any amino acid
  MOD_RES (1501)..(1556): Any amino acid
  MOD_RES (1567)..(1814): Any amino acid
  MOD_RES (1825)..(1883): Any amino acid
  MOD_RES (1900)..(1904): Any amino acid
  MOD_RES (1920)..(2285): Any amino acid
  MOD_RES (2304)..(2556): Any amino acid
XKMASNDASATAXXXXXXXXXXXXXXXXXSGMAVTFKRALXXXXXXXXXXXXXXXXSRPPTPELVKXXPPPPPNGEGEXXXXXXXXXXXXXXXXXXXXXXXXXXXXXXXXPPLNQGKSRDAKEXXXXXXXXXXXXXXXXXXXXXXXXXXXXXXXXXXAISLAKVELTTLSLFWRPVXXSQYLISPDTLXKLHGEAFPYTXXXXXXXXXXXXXXXXXXXXXXXXXXXXXXXXXXXXXXXXXXXXXTMDDPKVKKVANLFLCALSSLXXXPIKDLIGRLRPLNVINILXXXXXXXXXXXXSLILLAELFDVXXXXXXXXXXXXXXXXXXXXXXXXXXXXXXXXXXXGGLGLAIGFTKDKXXXXXXXXXXXXXACKDLGAYGLDXXXXXVKWFFPKKEEXXXXXLVRAIEDAVLXXXXXXXXXXXXXXXXXXXXXXXXXXXXXXXXXXXXXXXXXXXXXXXXXXXXXXXXXXXXXXXXXXXXXXXXXXXXXXXXMLSGPPGIGKXXXXXXXXXXXXXXXXGDKRVGLTPRNGVHYSHAYKXEEVLLWDDYGXXXXXXXXXXXXXXXXXXXLTLNCGRIENKGKXXXXXXXXXXXXXXXXXXXXXMNLGPVCRRVDFLVYCTXXXXXXXXXXXXXXXXXXXXXXXXXXXXXXXXXXPQGGFDQNGNXXXXXXXXXXXXXXXXXXXXXXXXXXXXXXXXXXXXXXXXXXXXXNKVFAFRKLAADNNYGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEEYEEYKKLREDRNGKYSIEEXXXXRDKYYEEVAIARATEDDFCEDDEMRIRQRVFRPTRKQRKXXXXXXXXXXXXXXRKRKPDDFKPRGKLWADDSREVXXXXXXXXXXXXXXXXXXXXXXXGWGCWVSPTLXXXXXXXXXXXXXXXXXXXXXXXXXXXXXXXXXXXXXXXXXXXXXGMILEEGCPEGVVCXXXXXXXXXXXXXXXXRMGAVASMKIQGRAVGGQMGMLLXXXXXXXXXXXXXXXXXXXXXXXXXXXXXXVIGVHTAAARSGNTVICAIPXXXXXXXXXXXXXXXXXXXXXXXXXXXXXAPTLSTKTKFWRXXXXXXXXXXXXXXXXXXXXXXXXXCLSLQQIMRDQLKPFTXXXXXXXXXXXXXXXXXXXXXXXXXXXXXXXXXXXXXXXXXXDKTTSSGFPYXXXXXXXXXXXXXXXXXXNQASKANLMFXXXXXXXPLYTAALKDELVKTDRXXXXXXKRLLWGADLSTVXRAAMAFGPFCXXXXXXXXXXXXXXXXXXXXXXXXXXXXXXXXXXHYDADCSRWDXXXXXXXXXXXXXXXXXXXXXXXXXXXXXXXXXXXXXXXXXXXXXXXXEGPPPGVPCTSQWXXXXXXXXXXXXXXXXXXXXXXXXXXXXXXXXXXXXXXXXXXXXXXXXXXXXXXXXIGLVPTRPDKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAGNAFTAGEXXXXXXXXXXXXXXXXXXXXXXXXXXXXXXXXXXXXXXXXXXXXXXXXXXXXXXXXXXXRLLAYLYTPLRANSPTXXXXXVSCRILTRPSQDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAILGAIAATAACSAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265692 - protein, 2556 aa, Norovirus
  MOD_RES (13)..(29): Any amino acid
  MOD_RES (44)..(55): Any amino acid
  MOD_RES (67)..(87): Any amino acid
  MOD_RES (99)..(110): Any amino acid
  MOD_RES (187)..(189): Any amino acid
  MOD_RES (331)..(401): Any amino acid
  MOD_RES (414)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (618)..(650): Any amino acid
  MOD_RES (663)..(707): Any amino acid
  MOD_RES (725)..(884): Any amino acid
  MOD_RES (968)..(982): Any amino acid
  MOD_RES (1001)..(1020): Any amino acid
  MOD_RES (1032)..(1078): Any amino acid
  MOD_RES (1093)..(1099): Any amino acid
  MOD_RES (1157)..(1163): Any amino acid
  MOD_RES (1203)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1429): Any amino acid
  MOD_RES (1444)..(1488): Any amino acid
  MOD_RES (1500)..(1529): Any amino acid
  MOD_RES (1544)..(1560): Any amino acid
  MOD_RES (1572)..(1883): Any amino acid
  MOD_RES (1920)..(2273): Any amino acid
  MOD_RES (2304)..(2556): Any amino acid
MKMASNDASAAAXXXXXXXXXXXXXXXXXSSMAVTFKRALGARXXXXXXXXXXXXPPRPPTPELVKXXXXXXXXXXXXXXXXXXXXXGVSGLPELSTVXXXXXXXXXXXXPPLNQRENRDAKEPLTGTILEMWDGEIYHYGLYVERGLVLGVHKPPAAISLAKVELTPLSLFWRPVYTPQYLISPDXXXKLHGETFPYTAFDNNCYAFCCWVLDLNDSWLSRRMIQRTTGFFRPYQDWNRKPLPTMDDSKLKKVANIFLCTLSSLFTRPIKDIIGKLRPLNIINILASCDWTFAGIVESLILLAELFGVFWTPPDVSAMIAPLLGDFELQXXXXXXXXXXXXXXXXXXXXXXXXXXXXXXXXXXXXXXXXXXXXXXXXXXXXXXXXXXXXXXXXXXXXXXXMVRSIEDAVLDLXXXXXXXXXXXXXXXXXXXXXXXXXXXXXXXXXXXXXXXXXXXXXXXXXXXXXXXXXXXXXXXXXXXXXXXXXXXXXXMISGRPGIGKTXXXXXXXXXXXXXXXGDQRVGLIPRNGVDHWDAYKXERVVLWDDYGMXXXXXXXXXXXXXXXXXPLTLNCDRIENKGKXXXXXXIIITTNLANPAPLDYVNFEACSRRIDFLVYAXXXXXXXXXXXXXXXXXXXXXXXXXXXXXXXXXLAPQGGFDKNGNXXXXXXXXXXXXXXXXXXXXXXXXXXXXXXXXXXXXXXXXXXXXXNKVLAFRQLAAENKYGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGKKHTAFSSKGLSDEEYDEYKRIREERNGKYSIEEYLQDRDKYYEEVAIARATEEDFCEEEEAKIRQRIFRPTRKQRKEERXXXXXXXXXXXXXXXPEDFKPKGKLWADDDRSVXXXXXXXXXXXXXXXXXXXXFGSGWGFWVSPXXXXXXXXXXXXXXXXXXXXXXXXXXXXXXXXXXXXXXXXXXXXXXXGMILEEGAPEGTVVXXXXXXXTGELMPLAARMGTHATMKIQGRTVGGQMGMLLTGSNAKSMDLGTTPGDCGCPYIYKRXXXXXXXGVHTAAARGGNTVICATQGGEGEATLEGGGGQNKGHYAGXXXXXXXXAPKLSTKTKFWRSSTXPLPPGTYEPAYLGGKDPRVXXGPSLQQVMRDQLKPFTXXXXXXXXXXXXXXXXXXXXXXXXXXXXXXXXXXXXQACASLDKTTSSGHPHXXXXXXXXXXXXXXXXLADQASKANLMFEXXXXXXPVYTGALKDELVKTDKXXXXIKKRLLWGSDLATMXXXXXXXXXXXXXXXXXXXXXXXXXXXXXXXXXXXXXXXXXXXXXHYDADYSRWDSTQQXXXXXXXXXXXXXXXXXXXXXXXXXXXXXXXXXXXXXXXXXXXXXGLPSGVPCTSQXXXXXXXXXXXXXXXXXXXXXXXXXXXXXXFSFYGDDEIVSTDIXXXXXXXXXXXXXXXXXPTRPDKTEGPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLIAMLYTPLRANNAGEDVFTVSCRVLTRPSPDFDFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMGNGTGRRRALMAQAIIGAIAATAAGSAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265693 - protein, 2556 aa, Norovirus
  MOD_RES (13)..(29): Any amino acid
  MOD_RES (44)..(55): Any amino acid
  MOD_RES (67)..(87): Any amino acid
  MOD_RES (99)..(110): Any amino acid
  MOD_RES (187)..(189): Any amino acid
  MOD_RES (206)..(210): Any amino acid
  MOD_RES (331)..(401): Any amino acid
  MOD_RES (414)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (618)..(650): Any amino acid
  MOD_RES (663)..(707): Any amino acid
  MOD_RES (725)..(884): Any amino acid
  MOD_RES (968)..(982): Any amino acid
  MOD_RES (1001)..(1020): Any amino acid
  MOD_RES (1032)..(1078): Any amino acid
  MOD_RES (1093)..(1099): Any amino acid
  MOD_RES (1157)..(1163): Any amino acid
  MOD_RES (1183)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1429): Any amino acid
  MOD_RES (1444)..(1488): Any amino acid
  MOD_RES (1500)..(1529): Any amino acid
  MOD_RES (1544)..(1560): Any amino acid
  MOD_RES (1572)..(1883): Any amino acid
  MOD_RES (1920)..(2273): Any amino acid
  MOD_RES (2304)..(2556): Any amino acid
MKMASNDAFAAAXXXXXXXXXXXXXXXXXSNMAVTLKRALGARXXXXXXXXXXXXPPRPPTPELIKXXXXXXXXXXXXXXXXXXXXXGVSGLPDLSTVXXXXXXXXXXXXPPLSQRENRDAKEPLTGTIIEMWDGEIYHYGLYVERGLILGVHKPPAAISLARVELTPLSLYWRPVYAPQYLISPDXXXRLHGESFPYTAFDNNCXXXXXWVLDLNDSWLCRRMIQRTTGFFRPYQDWNRKPLPTTDDSKLKKAANIFLCALSSLFTRPIKDIIGKLRPLNILNILATCDWTFAGIVESLILMAELFDVFWTPPDVSAMIAPLLGDYELQXXXXXXXXXXXXXXXXXXXXXXXXXXXXXXXXXXXXXXXXXXXXXXXXXXXXXXXXXXXXXXXXXXXXXXXILRAIEDAVLDMXXXXXXXXXXXXXXXXXXXXXXXXXXXXXXXXXXXXXXXXXXXXXXXXXXXXXXXXXXXXXXXXXXXXXXXXXXXXXXMISGKPGIGKTXXXXXXXXXXXXXXXGDQRVGLVPRNGVDHWDAYRXEEVMLWDDYGMXXXXXXXXXXXXXXXXXPVTLNCDRIENKGMXXXXXXIIITTNLVGPAPVDYVNLGPVCRRVDFLVYCXXXXXXXXXXXXXXXXXXXXXXXXXXXXXXXXXLAPQGGFDNQGNXXXXXXXXXXXXXXXXXXXXXXXXXXXXXXXXXXXXXXXXXXXXXNRVSAFRKLAADNKYGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGRKHTAFSSKGLSDEEYDEFKRIREERQGRYSIEEYLQDRDRYYEEVAVAKATEENFCEEEEIKIRQRIFRPTKKQRKEERXXXXXXXXXXXXXXXPDDFQPKGNLWADDTRSVXXXXXXXXXXXXXXXXXXXXLGTGWGFWVSSXXXXXXXXXXXXXXXXXXXXXXXXXXXXXXXXXXXXXXXXXXXXXXXGLVLEEGAPEGTVAXXXXXXXSGEMIPLAVRMGTHATMRIQGRLVGGQMGMLLTGANAKNMDLGTIPGDCGAPYVHKRXXXXXXXGVHAAATKSGNTVVCAVQAXXXXXXXXXXXXXXXXXXXXXXXXXXXXGPALSTKTKFWRSSPXALPPGTYEPAYLGGRDPRVXXGPSLQQVMRDQLRPFTXXXXXXXXXXXXXXXXXXXXXXXXXXXXXXXXXXXXDACQSLDKTTSSGSPHXXXXXXXXXXXXXXXXLADQASKANLMYEXXXXXXPVYTAALKDELVKPEKXXXXVKKRLLWGSDLGTMXXXXXXXXXXXXXXXXXXXXXXXXXXXXXXXXXXXXXXXXXXXXXHFDADYTAWDSTQNXXXXXXXXXXXXXXXXXXXXXXXXXXXXXXXXXXXXXXXXXXXXXGLPSGFPCTSQXXXXXXXXXXXXXXXXXXXXXXXXXXXXXXYSFYGDDEIVSTDVXXXXXXXXXXXXXXXXXPTRPDKSEGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLVAMLYTPLRSNGSGDVFTVSCRVLTRPAPDFEFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMGNGAGRRRALMAQAIFGAIAASAAGSILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265694 - protein, 2556 aa, Norovirus
  MOD_RES (13)..(29): Any amino acid
  MOD_RES (43)..(55): Any amino acid
  MOD_RES (67)..(87): Any amino acid
  MOD_RES (99)..(110): Any amino acid
  MOD_RES (187)..(189): Any amino acid
  MOD_RES (206)..(215): Any amino acid
  MOD_RES (316)..(401): Any amino acid
  MOD_RES (414)..(491): Any amino acid
  MOD_RES (503)..(517): Any amino acid
  MOD_RES (538)..(538): Any amino acid
  MOD_RES (550)..(566): Any amino acid
  MOD_RES (581)..(586): Any amino acid
  MOD_RES (618)..(650): Any amino acid
  MOD_RES (663)..(707): Any amino acid
  MOD_RES (725)..(884): Any amino acid
  MOD_RES (968)..(982): Any amino acid
  MOD_RES (1001)..(1020): Any amino acid
  MOD_RES (1032)..(1078): Any amino acid
  MOD_RES (1093)..(1099): Any amino acid
  MOD_RES (1157)..(1163): Any amino acid
  MOD_RES (1183)..(1210): Any amino acid
  MOD_RES (1226)..(1226): Any amino acid
  MOD_RES (1246)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1370): Any amino acid
  MOD_RES (1385)..(1429): Any amino acid
  MOD_RES (1444)..(1488): Any amino acid
  MOD_RES (1500)..(1532): Any amino acid
  MOD_RES (1544)..(1560): Any amino acid
  MOD_RES (1572)..(1883): Any amino acid
  MOD_RES (1920)..(2273): Any amino acid
  MOD_RES (2304)..(2556): Any amino acid
MKMASNDASATAXXXXXXXXXXXXXXXXXSNMAVTFKRTFGAXXXXXXXXXXXXXPPRPPTPELAKXXXXXXXXXXXXXXXXXXXXXGVSGLPELTTVXXXXXXXXXXXXPPLNQRESRDAKEPLTGTNLEMWDGEIYHYGLYVDRGLVLGVHKPPAAISFAKVELAPLSLFWRPVYTPQYPISPDXXXRLHGEAFPYTAFDNNCXXXXXXXXXXNDSWLNRRMIQRTTGFFKPYQDWNRKPLPTVDDSKVKKVANIVLCALSSLFTRPIKDIIGKLKPLNILNILASCDWSFAGVAESLILLADLFGVFWTPPDXXXXXXXXXXXXXXXXXXXXXXXXXXXXXXXXXXXXXXXXXXXXXXXXXXXXXXXXXXXXXXXXXXXXXXXXXXXXXXXXXXXXXXTVRAIEDAVLDLXXXXXXXXXXXXXXXXXXXXXXXXXXXXXXXXXXXXXXXXXXXXXXXXXXXXXXXXXXXXXXXXXXXXXXXXXXXXXXMMCGPPGIGKTXXXXXXXXXXXXXXXPGGKVGLVPREAVDHWDGYHXERIVLWDDYGMXXXXXXXXXXXXXXXXXPLSLNCDRIENEGKXXXXXXIVITTNAPGPAPVDFVNFEACSRRVDFLVYAXXXXXXXXXXXXXXXXXXXXXXXXXXXXXXXXXLAPQGGFDKNGKXXXXXXXXXXXXXXXXXXXXXXXXXXXXXXXXXXXXXXXXXXXXXNKIAAFRQLAAENKYGMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRGKKHAAFSSKGLSDEEYEEYKRIREDKEGRYTIEEYLQDRDRYYEELAIARATEEDFCEEEIAKIRRRVFRPTKKQRREERXXXXXXXXXXXXXXXPDDFQPKGKLWADDNRSVXXXXXXXXXXXXXXXXXXXXFGSGWGFWVSSXXXXXXXXXXXXXXXXXXXXXXXXXXXXXXXXXXXXXXXXXXXXXXXGMVLEEGAPEGTVCXXXXXXXTGELLPLAVRMGTHASMKIQGKMLHGQSGMLLTGANAKGMDLGTGPGDCGAPYVYKRXXXXXXXGVHTAATRGENTVICATQGXXXXXXXXXXXXXXXXXXXXXXXXXXXXGPALSTKTKFWRSSNXSLPPGVYEPAYLGGKDPRIXXGPSLQQVMREQLKPFTXXXXXXXXXXXXXXXXXXXXXXXXXXXXXXXXXXXXQACMSLDKTTSSGYPHXXXXXXXXXXXXXXXXLGEQAAHANNMYEXXXXXXPMYTAALKDELVKTEKXXXXIKKRLLWGSDLSTMXXXXXXXXXXXXXXXXXXXXXXXXXXXXXXXXXXXXXXXXXXXXXHFDADYSAWDSTQNXXXXXXXXXXXXXXXXXXXXXXXXXXXXXXXXXXXXXXXXXXXXXGLPPGVPCTSQXXXXXXXXXXXXXXXXXXXXXXXXXXXXXXXXXYGDDEIVSTDLXXXXXXXXXXXXXXXXXPTRPDKTEGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLVAMLYTPLRANNSGDDVFTVSCRVLTRPTPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMGNGTGRRRVLMAQAVIGAIAASAAGSALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265695 - protein, 2556 aa, Norovirus
  MOD_RES (13)..(29): Any amino acid
  MOD_RES (42)..(55): Any amino acid
  MOD_RES (67)..(87): Any amino acid
  MOD_RES (99)..(110): Any amino acid
  MOD_RES (133)..(156): Any amino acid
  MOD_RES (187)..(189): Any amino acid
  MOD_RES (201)..(219): Any amino acid
  MOD_RES (232)..(238): Any amino acid
  MOD_RES (266)..(266): Any amino acid
  MOD_RES (316)..(401): Any amino acid
  MOD_RES (414)..(491): Any amino acid
  MOD_RES (503)..(517): Any amino acid
  MOD_RES (538)..(538): Any amino acid
  MOD_RES (550)..(566): Any amino acid
  MOD_RES (581)..(591): Any amino acid
  MOD_RES (613)..(650): Any amino acid
  MOD_RES (663)..(707): Any amino acid
  MOD_RES (725)..(897): Any amino acid
  MOD_RES (966)..(982): Any amino acid
  MOD_RES (1001)..(1020): Any amino acid
  MOD_RES (1032)..(1078): Any amino acid
  MOD_RES (1093)..(1102): Any amino acid
  MOD_RES (1157)..(1163): Any amino acid
  MOD_RES (1183)..(1210): Any amino acid
  MOD_RES (1226)..(1226): Any amino acid
  MOD_RES (1243)..(1247): Any amino acid
  MOD_RES (1264)..(1299): Any amino acid
  MOD_RES (1316)..(1331): Any amino acid
  MOD_RES (1345)..(1350): Any amino acid
  MOD_RES (1367)..(1371): Any amino acid
  MOD_RES (1385)..(1429): Any amino acid
  MOD_RES (1442)..(1488): Any amino acid
  MOD_RES (1500)..(1560): Any amino acid
  MOD_RES (1572)..(1883): Any amino acid
  MOD_RES (1920)..(2285): Any amino acid
  MOD_RES (2304)..(2556): Any amino acid
MKRGSNDASAAAXXXXXXXXXXXXXXXXXSSMAVTLKRALGXXXXXXXXXXXXXXPSRPPTPELVKXXXXXXXXXXXXXXXXXXXXXGISGLPELSTVXXXXXXXXXXXXPPLYQRENRDAREPLTGTILEMXXXXXXXXXXXXXXXXXXXXXXXXAAISLAKVELATLSLFWRPVYTSQYLISPDXXXKLHGEAFPYTAXXXXXXXXXXXXXXXXXXXLSRRMISRTTGFXXXXXXXNRKPLPTMDDSKVKKVANLFLCALSSLXTRPIKDLIGKVKPLNVINILASCDWTFAGKVESMILLAELFDVFWTPPDXXXXXXXXXXXXXXXXXXXXXXXXXXXXXXXXXXXXXXXXXXXXXXXXXXXXXXXXXXXXXXXXXXXXXXXXXXXXXXXXXXXXXXMVRAIEDAVLDFXXXXXXXXXXXXXXXXXXXXXXXXXXXXXXXXXXXXXXXXXXXXXXXXXXXXXXXXXXXXXXXXXXXXXXXXXXXXXXMISRRPGIGKTXXXXXXXXXXXXXXXGDQRIGLVPRNGVHYSHAYKXESAVLRLDYVLXXXXXXXXXXXXXXXXXPVTLNCDRIEKKGLXXXXXXXXXXXNATSPAPLDYVNFEACSRRTDXXXXXXXXXXXXXXXXXXXXXXXXXXXXXXXXXXXXXXLAPQGGFDKSGNXXXXXXXXXXXXXXXXXXXXXXXXXXXXXXXXXXXXXXXXXXXXXNKINSFRQLAAENKHGLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRDEEDDEYKRLREERGGKYTIEEYLQDRDRYYEELAVAQATEEDFAEDDEMRIRQRVFRPTRKQRKEXXXXXXXXXXXXXXXXXPDDFKPKGKLWADDSRSVXXXXXXXXXXXXXXXXXXXXFGTGWGFWVSPXXXXXXXXXXXXXXXXXXXXXXXXXXXXXXXXXXXXXXXXXXXXXXXGLVLEEGCPEGTVCXXXXXXXXXXLLPLAVRMGAIASMRVQGRVIGGQMGMLLTGSNAKNMDLGTSPGDCGCPYVYKRXXXXXXXGVHTVAARSGNTVICAIPNXXXXXXXXXXXXXXXXXXXXXXXXXXXXAPALSTKTKFWKSSPXPLPPGVYEPAYLGGRDXXXXXGPSLQQVLRDQLKPFAXXXXXXXXXXXXXXXXXXXXXXXXXXXXXXXXXXXXDACMSLDKTTSSGHPYXXXXXXXXXXXXXXXXLADQASRANLMYEXXXXXXPIYTAALKDELVKTSKXXXXXKKRLLWGADLGTVXXXXXXXXXXXXXXXXXXXXXXXXXXXXXXXXXXXXXXXXXXXXXHYDADYTAWDSTXXXXXXXXXXXXXXXXXXXXXXXXXXXXXXXXXXXXXXXXXXXXXXXGLPSGVPCTPQXXXXXXXXXXXXXXXXXXXXXXXXXXXXXXXXXXXXXXXXXXXXXXXXXXXXXXXXXXXXXPTRPDKTDGPIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIIAYLYTPLRANSGEEVVFTDSCRVLTRPSPDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAVLGAIAASTAGSALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265696 - protein, 2556 aa, Norovirus
  MOD_RES (13)..(29): Any amino acid
  MOD_RES (42)..(55): Any amino acid
  MOD_RES (67)..(110): Any amino acid
  MOD_RES (125)..(156): Any amino acid
  MOD_RES (178)..(189): Any amino acid
  MOD_RES (201)..(243): Any amino acid
  MOD_RES (266)..(267): Any amino acid
  MOD_RES (289)..(296): Any amino acid
  MOD_RES (311)..(401): Any amino acid
  MOD_RES (413)..(491): Any amino acid
  MOD_RES (503)..(517): Any amino acid
  MOD_RES (538)..(538): Any amino acid
  MOD_RES (550)..(566): Any amino acid
  MOD_RES (581)..(600): Any amino acid
  MOD_RES (613)..(650): Any amino acid
  MOD_RES (663)..(707): Any amino acid
  MOD_RES (725)..(899): Any amino acid
  MOD_RES (923)..(924): Any amino acid
  MOD_RES (966)..(982): Any amino acid
  MOD_RES (1001)..(1078): Any amino acid
  MOD_RES (1093)..(1108): Any amino acid
  MOD_RES (1133)..(1163): Any amino acid
  MOD_RES (1183)..(1210): Any amino acid
  MOD_RES (1224)..(1247): Any amino acid
  MOD_RES (1264)..(1304): Any amino acid
  MOD_RES (1316)..(1332): Any amino acid
  MOD_RES (1345)..(1350): Any amino acid
  MOD_RES (1367)..(1371): Any amino acid
  MOD_RES (1385)..(1429): Any amino acid
  MOD_RES (1442)..(1883): Any amino acid
  MOD_RES (1920)..(2285): Any amino acid
  MOD_RES (2304)..(2556): Any amino acid
MKNGSNDASAAAXXXXXXXXXXXXXXXXXSNVAVTLKRALGXXXXXXXXXXXXXXPPRPPTPELVRXXXXXXXXXXXXXXXXXXXXXXXXXXXXXXXXXXXXXXXXXXXXPPLGQRENRDAKEPXXXXXXXXXXXXXXXXXXXXXXXXXXXXXXXXAAISLARVELTTLSLFWRPVYXXXXXXXXXXXXKLHGESFPYTAXXXXXXXXXXXXXXXXXXXXXXXXXXXXXXXXXXXXXXXXXXXPTMDDPKLKKVANVFLCALSSLXXRPIKDIIGKLRPLNVINILASXXXXXXXXVESLILLAELFDVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLVRAIEDAVLDXXXXXXXXXXXXXXXXXXXXXXXXXXXXXXXXXXXXXXXXXXXXXXXXXXXXXXXXXXXXXXXXXXXXXXXXXXXXXXXMISGRPGVGKTXXXXXXXXXXXXXXXGDQRVGLTPRESIDHWDGYHXERVVLWYEYGMXXXXXXXXXXXXXXXXXPLSLNCGRIENKGKXXXXXXXXXXXXXXXXXXXXYVNFEACCRRIDXXXXXXXXXXXXXXXXXXXXXXXXXXXXXXXXXXXXXXLAPQGGFDQNGNXXXXXXXXXXXXXXXXXXXXXXXXXXXXXXXXXXXXXXXXXXXXXNKVSAFRKLAADNNYGFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDEEYDEYKRVREEREGKYSIEEYXXDRDKYYEELAIARATEEDFCEEEEAELRQWIFRPTSKLRKEXXXXXXXXXXXXXXXXXLFAFLPKGKLWADDDRNVXXXXXXXXXXXXXXXXXXXXXXXXXXXXXXXXXXXXXXXXXXXXXXXXXXXXXXXXXXXXXXXXXXXXXXXXXXXXXXGMILEEGCPEGVVCXXXXXXXXXXXXXXXXRMGAVASMKIQGKTIGGQMGMLLTXXXXXXXXXXXXXXXXXXXXXXXXXXXXXXXGVHTAAAHGGNTVVCATQGXXXXXXXXXXXXXXXXXXXXXXXXXXXXGPTLSTKTKFWRSXXXXXXXXXXXXXXXXXXXXXXXXGLSLQQIMRDQLKPFTXXXXXXXXXXXXXXXXXXXXXXXXXXXXXXXXXXXXXXXXXLDKTTSSGFPYXXXXXXXXXXXXXXXXXANQASKANLMFEXXXXXXPLYTAALKDELVKTDRXXXXXKKRLLWGADLSTVXXXXXXXXXXXXXXXXXXXXXXXXXXXXXXXXXXXXXXXXXXXXXLFDADYSRWDSTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLLAYLYTPLRANSPTDDVFTVSCRVLTRPSQDFEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAQAILGAIAATAACSAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265697 - protein, 3390 aa, Dengue virus
  MOD_RES (1160)..(1161): Any amino acid
  MOD_RES (3099)..(3100): Any amino acid
  MOD_RES (3121)..(3129): Any amino acid
NNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGXXFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNXXFTNMEAQLIRQMEGEGVLSKXXXXXXXXXEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 265698 - protein, 3390 aa, Dengue virus
  MOD_RES (15)..(17): Any amino acid
  MOD_RES (43)..(55): Any amino acid
  MOD_RES (119)..(119): Any amino acid
  MOD_RES (150)..(153): Any amino acid
  MOD_RES (178)..(190): Any amino acid
  MOD_RES (207)..(211): Any amino acid
  MOD_RES (228)..(229): Any amino acid
  MOD_RES (287)..(307): Any amino acid
  MOD_RES (324)..(338): Any amino acid
  MOD_RES (368)..(394): Any amino acid
  MOD_RES (459)..(489): Any amino acid
  MOD_RES (518)..(540): Any amino acid
  MOD_RES (562)..(571): Any amino acid
  MOD_RES (590)..(593): Any amino acid
  MOD_RES (673)..(717): Any amino acid
  MOD_RES (746)..(749): Any amino acid
  MOD_RES (797)..(834): Any amino acid
  MOD_RES (926)..(937): Any amino acid
  MOD_RES (968)..(980): Any amino acid
  MOD_RES (997)..(1019): Any amino acid
  MOD_RES (1041)..(1051): Any amino acid
  MOD_RES (1074)..(1101): Any amino acid
  MOD_RES (1160)..(1161): Any amino acid
  MOD_RES (1218)..(1227): Any amino acid
  MOD_RES (1247)..(1248): Any amino acid
  MOD_RES (1350)..(1354): Any amino acid
  MOD_RES (1371)..(1385): Any amino acid
  MOD_RES (1409)..(1409): Any amino acid
  MOD_RES (1435)..(1442): Any amino acid
  MOD_RES (1459)..(1460): Any amino acid
  MOD_RES (1479)..(1491): Any amino acid
  MOD_RES (1520)..(1523): Any amino acid
  MOD_RES (1570)..(1575): Any amino acid
  MOD_RES (1600)..(1609): Any amino acid
  MOD_RES (1635)..(1639): Any amino acid
  MOD_RES (1665)..(1672): Any amino acid
  MOD_RES (1689)..(1711): Any amino acid
  MOD_RES (1735)..(1745): Any amino acid
  MOD_RES (1763)..(1773): Any amino acid
  MOD_RES (1836)..(1862): Any amino acid
  MOD_RES (1879)..(1883): Any amino acid
  MOD_RES (1899)..(1915): Any amino acid
  MOD_RES (1956)..(2012): Any amino acid
  MOD_RES (2029)..(2031): Any amino acid
  MOD_RES (2048)..(2052): Any amino acid
  MOD_RES (2069)..(2076): Any amino acid
  MOD_RES (2118)..(2121): Any amino acid
  MOD_RES (2138)..(2150): Any amino acid
  MOD_RES (2209)..(2229): Any amino acid
  MOD_RES (2274)..(2340): Any amino acid
  MOD_RES (2364)..(2410): Any amino acid
  MOD_RES (2442)..(2465): Any amino acid
  MOD_RES (2569)..(2603): Any amino acid
  MOD_RES (2624)..(2639): Any amino acid
  MOD_RES (2697)..(2709): Any amino acid
  MOD_RES (2726)..(2726): Any amino acid
  MOD_RES (2750)..(2750): Any amino acid
  MOD_RES (2786)..(2816): Any amino acid
  MOD_RES (2835)..(2844): Any amino acid
  MOD_RES (2896)..(2902): Any amino acid
  MOD_RES (2940)..(2962): Any amino acid
  MOD_RES (2979)..(3033): Any amino acid
  MOD_RES (3062)..(3065): Any amino acid
  MOD_RES (3082)..(3100): Any amino acid
  MOD_RES (3121)..(3129): Any amino acid
  MOD_RES (3154)..(3160): Any amino acid
  MOD_RES (3177)..(3182): Any amino acid
  MOD_RES (3199)..(3230): Any amino acid
  MOD_RES (3261)..(3266): Any amino acid
  MOD_RES (3286)..(3292): Any amino acid
  MOD_RES (3333)..(3345): Any amino acid
  MOD_RES (3374)..(3376): Any amino acid
NNQRKKAGKPSINMXXXVRNRVSTGSQLAKRFSRELLNGQGPXXXXXXXXXXXXXLAIPPTAGILARWGTFKKSGAIKVLRGFKREISNMLSIINRRKKTSFCLMMMLPATLAFHLTSXDGEPRMIVAKNERGKSLLFKTATGINMCTLXXXXLGEMCDDTVTYKCPLIAEVEPEDIXXXXXXXXXXXXXGTCNQAGERRRDKRSVXXXXXVGMGLDTRAQTWMSAEXXWRQVEKVETWAFRHPGFTILALFLAHYIGTSLTQKVVIFVLLMLVTPSMAMRCVGVGXXXXXXXXXXXXXXXXXXXXXGCVTTMAKSKPTLDIEXXXXXXXXXXXXXXXCIEGKITNVTTDSRCPTQGEAILPEEQDQXXXXXXXXXXXXXXXXXXXXXXXXXXXCAKFQCLESIEGKVVQHENLKYTVTITVHTGDQHQVGNDTQGVTVEITPQASTVEAVLPEYGTLXXXXXXXXXXXXXXXXXXXXXXXXXXXXXXXFFDLPLPWASGATTETPTWNKKELLVTFXXXXXXXXXXXXXXXXXXXXXXXLTGATEIQTSGGTNIFAGHLKXXXXXXXXXXKGMSYAMCLNAFVLKKEVXXXXHGTILIKVEYKGEDVPCKVPFSTEDGQGKAHSGRLITANPIVTKKDEPINIEAEPPFGESNIIIGIGDKSLKINWYRKGXXXXXXXXXXXXXXXXXXXXXXXXXXXXXXXXXXXXXXXXXXXXXGSAYTALFSGVSWIMKIGIGILLTWIGLXXXXTSMSFSCIVIGVITLYLGAVVQADTGCAVNWKGKELKCGNGIFVTNEXXXXXXXXXXXXXXXXXXXXXXXXXXXXXXXXXXXXXXMENLLWKQVANELNYILWENNIKLTVVVGDTIGILEQGKRALTLQPMELKYSWKTWGKARIVTAEIQNSSFIIDGPNTPECPNVSRAWNVWXXXXXXXXXXXXNIWLKLREMYTQSCDHRLMSAAIKDERAVHXXXXXXXXXXXXXSWKLEKASFIEVKTCTXXXXXXXXXXXXXXXXXXXXXXXAGPISQHNHRPGYYTQTAGPWXXXXXXXXXXXCEGTTVVITESCGTRGSSLRTTXXXXXXXXXXXXXXXXXXXXXXXXXXXXWYGMEIRPINEKEENMVKSLVSAGSGEMDNFTMGILCLAILFEEVLRGKFGKKHMIVGXXFMFVLLLSGQITWRDMARTFIMIGSNASDKMGMGVTHLALIATFKIQPLLALGFFLXXXXXXXXXXLGVGLAMAATLRLPEDIEQXXNGIALGLMTLKLTTQFETYQLWTALVSLTCSNTMFTLTVAWRTATLILAGVSLLPLCQSSSMRKTDWLPMAVAAMGVPSLPLFIFNLKDTPKRKSWPLNEGXXXXXLVSILASSFLRNDVPMXXXXXXXXXXXXXXXITGTSADLIVEKAADITWEEEAEXTGVSHNLMVTVDDDGTMKIKDDETEXXXXXXXXTALLIVSGVFPYSIPAXXLVWHTWQKQTRRSGVLWDXXXXXXXXXXXXXEGVYRIKQQGILGKTQVGVGIQKEGVFHXXXXVTRGAVLTHNGKRLEPNWANVKKDLISYGGGWRLNTQWKKGEEVQVXXXXXXKNPKNFQTMPGIFQTTMGEIGAIAXXXXXXXXXXPIINREGKIVGLYGNGVVTKSGGYVXXXXXTNAEPDGPAPELEEEMFRKRNLTIMXXXXXXXXTRKYLPAIIREAIKRRXXXXXXXXXXXXXXXXXXXXXXXPIRYQTTATKSEHTGKEIVDLMCXXXXXXXXXXXVRVPNYNLVVMDEAHFTXXXXXXXXXXXSTRVGMGETAAIFMTATPPGTAEAFPQSNAPIQDEEKDIPERSWNSGNEWITDFVGKTVWFVXXXXXXXXXXXXXXXXXXXXXXXXXXXFDTEYQKTRLNDWDFVXXXXXSEMGANFRADRVIDPXXXXXXXXXXXXXXXXXLAGPMPVTVASAAQRRGRVGRNPPKENDQYIFMGQPLNNDXXXXXXXXXXXXXXXXXXXXXXXXXXXXXXXXXXXXXXXXXXXXXXXXXXXXXXXXXGDLPVWLAYKVASEGIXXXDRKWCFDGERNNQILEXXXXXEIWTKEGERKKLRPRWXXXXXXXXPLALKEFKEFAAGRKSIAFDLVTEIGRVPTHLAYRTRNALDXXXXLHTSEHGGKAYRHAVEXXXXXXXXXXXXXLMILLTGGVMLFLISGKGVGKTSIGLICVIVSSGMLWMADVPLQWIASAIILEFFMMVXXXXXXXXXXXXXXXXXXXXXIGILTLAAIVTANEMGMLETTKRDLGMSKEPGVASSNSYLDVDLXXXXXXXXXXXXXXXXXXXXXXXXXXXXXXXXXXXXXXXXXXXXXXXXXXXXXXXXXXXXXXXXXXXSQVNPLTLTAAVLLLVTHYAIIGXXXXXXXXXXXXXXXXXXXXXXXXXXXXXXXXXXXXXXXXXXXXXXXQVMLLVLCAAQLLLMRTSWAFCEVLTLATGPXXXXXXXXXXXXXXXXXXXXXXXXFRGSYIAGAGLAFSIMKSVGTGRRGTGSQGETLGEKWKKKLNQLSRKDFDLYKKSGITEVDRIEAKEGLKRGETTHHAVSRGTAKLQWFVERNMVVPEGRVIDXXXXXXXXXXXXXXXXXXXXXXXXXXXXXXXXXXXPMSTYGWNLVKLMTGKDVFYXXXXXXXXXXXXXXXXSPSPTVEEGRTIRVLKMVEPWLRNNQFCIKVLNPYMPAVVEHLERLQRKYGGMLVRNXXXXXXXXXXXXXSNGTGNIVSSVNMVSRXLLNRFTMTYRKPTIERDVDLGAGXRHVNAEPEIPNMDVIGERIRRIKEEHSSTWHYDEEXXXXXXXXXXXXXXXXXXXXXXXXXXXXXXXTKPWDVVPTVIQMAMTDTXXXXXXXXXXEKVDTRTPRPMPGTRRVMGITAGWLWRTLGRNKRPRLCTREEFIKKVRTNAXXXXXXXEENQWDSARAAVEDEEFWKLVDKERELHKQGKCGSCVXXXXXXXXXXXXXXXXXXXXXXXWYMWLGARFLEFEALGXXXXXXXXXXXXXXXXXXXXXXXXXXXXXXXXXXXXXXXXXXXXXXXXXXXXXXXDLHNEEKIIQQMDPEHRQLASAIFKLTYXXXXVKVQRPTPKGTVMDIIXXXXXXXXXXXXXXXXXXXFTNMEAQLVRQMEGEGVLTKXXXXXXXXXEKKVTQWLETKGVERLRRMAISGDXXXXXXXDDRFANALFALNDMGKXXXXXXQWQPSKGWQDWQQVPFXXXXXXXXXXXXXXXXXXXXXXXXXXXXXXXXSQGAGWSLKETACLGKAYAQMWALMYFHRRXXXXXXNAICSAVPVHWIPTSRTTWXXXXXXXWMTTEDMLAVWNRVWIEENPWMEDKTPVTTWEDVPYLGKRXXXXXXXXXXXXXRATWAQNILIAIQQVRSLIGDEEFLDYMXXXKRFRKEEELEGAIW

SEQ ID NO: 265699 - protein, 3390 aa, Dengue virus
  MOD_RES (1)..(26): Any amino acid
  MOD_RES (42)..(73): Any amino acid
  MOD_RES (115)..(159): Any amino acid
  MOD_RES (177)..(252): Any amino acid
  MOD_RES (277)..(351): Any amino acid
  MOD_RES (368)..(394): Any amino acid
  MOD_RES (419)..(430): Any amino acid
  MOD_RES (458)..(492): Any amino acid
  MOD_RES (512)..(545): Any amino acid
  MOD_RES (558)..(571): Any amino acid
  MOD_RES (590)..(595): Any amino acid
  MOD_RES (628)..(629): Any amino acid
  MOD_RES (647)..(650): Any amino acid
  MOD_RES (671)..(722): Any amino acid
  MOD_RES (739)..(752): Any amino acid
  MOD_RES (785)..(847): Any amino acid
  MOD_RES (885)..(885): Any amino acid
  MOD_RES (926)..(937): Any amino acid
  MOD_RES (958)..(1051): Any amino acid
  MOD_RES (1074)..(1102): Any amino acid
  MOD_RES (1118)..(1119): Any amino acid
  MOD_RES (1144)..(1151): Any amino acid
  MOD_RES (1160)..(1161): Any amino acid
  MOD_RES (1197)..(1233): Any amino acid
  MOD_RES (1245)..(1252): Any amino acid
  MOD_RES (1265)..(1265): Any amino acid
  MOD_RES (1287)..(1290): Any amino acid
  MOD_RES (1309)..(1309): Any amino acid
  MOD_RES (1347)..(1389): Any amino acid
  MOD_RES (1408)..(1462): Any amino acid
  MOD_RES (1473)..(1549): Any amino acid
  MOD_RES (1567)..(1578): Any amino acid
  MOD_RES (1599)..(1711): Any amino acid
  MOD_RES (1728)..(1746): Any amino acid
  MOD_RES (1762)..(1819): Any amino acid
  MOD_RES (1836)..(1934): Any amino acid
  MOD_RES (1946)..(2101): Any amino acid
  MOD_RES (2117)..(2155): Any amino acid
  MOD_RES (2198)..(2230): Any amino acid
  MOD_RES (2247)..(2254): Any amino acid
  MOD_RES (2273)..(2342): Any amino acid
  MOD_RES (2359)..(2411): Any amino acid
  MOD_RES (2424)..(2425): Any amino acid
  MOD_RES (2439)..(2479): Any amino acid
  MOD_RES (2494)..(2496): Any amino acid
  MOD_RES (2519)..(2519): Any amino acid
  MOD_RES (2547)..(2604): Any amino acid
  MOD_RES (2621)..(2654): Any amino acid
  MOD_RES (2685)..(2728): Any amino acid
  MOD_RES (2745)..(2762): Any amino acid
  MOD_RES (2785)..(2818): Any amino acid
  MOD_RES (2833)..(2845): Any amino acid
  MOD_RES (2871)..(2887): Any amino acid
  MOD_RES (2896)..(2909): Any amino acid
  MOD_RES (2933)..(3033): Any amino acid
  MOD_RES (3059)..(3100): Any amino acid
  MOD_RES (3121)..(3129): Any amino acid
  MOD_RES (3148)..(3244): Any amino acid
  MOD_RES (3261)..(3269): Any amino acid
  MOD_RES (3283)..(3292): Any amino acid
  MOD_RES (3309)..(3312): Any amino acid
  MOD_RES (3328)..(3346): Any amino acid
  MOD_RES (3362)..(3376): Any amino acid
XXXXXXXXXXXXXXXXXXXXXXXXXXQLAKRFSKELLNGQGXXXXXXXXXXXXXXXXXXXXXXXXXXXXXXXXSGAIKVLKGFKKEISNMLSIINKRKKTSLCLVMILPATLAFXXXXXXXXXXXXXXXXXXXXXXXXXXXXXXXXXXXXXXXXXXXXXDTVTYKCPLVAEVEPEDXXXXXXXXXXXXXXXXXXXXXXXXXXXXXXXXXXXXXXXXXXXXXXXXXXXXXXXXXXXXXXXXXXXXXXXXXXXXLAHYIGTSLTQKAVIFTLLMLVTPXXXXXXXXXXXXXXXXXXXXXXXXXXXXXXXXXXXXXXXXXXXXXXXXXXXXXXXXXXXXXXXXXXXXXXXXXXXRCPTQGEATLPEEQDQXXXXXXXXXXXXXXXXXXXXXXXXXXXCAKFQCLELIEGKAVQHENLKYTVXXXXXXXXXXXXGNDTQGVTAEITPQASTVEVILPEYGTXXXXXXXXXXXXXXXXXXXXXXXXXXXXXXXXXXXLPLPWTSGATAETPIWNRKXXXXXXXXXXXXXXXXXXXXXXXXXXXXXXXXXXEIQNLGGTSIFAXXXXXXXXXXXXXXKGMSYAMCSGSFVLKKEVXXXXXXTILIKVEYRGEDVPCKIPFSTEDEQGKVHNGRXXTANPVVTKKEEPINIEAXXXXGESNIVIGTGDNALKINWYRXXXXXXXXXXXXXXXXXXXXXXXXXXXXXXXXXXXXXXXXXXXXXXXXXXXXALFGGVSWVMKIGIGIXXXXXXXXXXXXXXSFSCIAIGIITLYLGTVVQADMGCVVNWKGKEXXXXXXXXXXXXXXXXXXXXXXXXXXXXXXXXXXXXXXXXXXXXXXXXXXXXXXXXXXXXXXXNHILWENNVKLTVVVGDITGVLEQGKRTLPPQPMELKXSWKAWGKAKIVIAETQNFSFIIDGPNTPECPSTSRAWNVWXXXXXXXXXXXXNIWLKLREVHTQTCDHRLMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCEGTTVVIAENCGTKGPSLRTTXXXXXXXXXXXXXXXXXXXXXXXXXXXXXYGMEIRPVNEKEENMXXSLVSAGSGKADNFTMGALCLAILFXXXXXXXXGKKHMIAGXXLIFVLLLSGQITWRDLTHTLIMIGSNATDRMGMGVXXXXXXXXXXXXXXXXXXXXXXXXXXXXXXXXXXXXXMTTTLQLPADIXXXXXXXXLGLMALKLTTQFXTYQLWTALVSLMCANTIFTLTXXXXTATLILAVISLLPMCQSSXMRKSDWLPVAVAAMGAQPLPLFIFSLKDTPKRKSWPLXXXXXXXXXXXXXXXXXXXXXXXXXXXXXXXXXXXXXXXXXXXSADLTVEKVAEVTWEEEAXXXXXXXXXXXXXXXXXXXXXXXXXXXXXXXXXXXXXXXXXXXXXXXXXXXXXXXWHTWQKRTQRXXXXXXXXXXXXXXXXXXXXXXXXXXXXXXXXXXXXXXXXXXXXXXXXXXXXXXXXXXXXXXXXXXXXXXXXXXXXXSYGGGWKLSAQWKKGEEXXXXXXXXXXXXKNFQTTPGIFQTTTGEIGAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPIRYQTSAIKSEHTGRXXXXXXXXXXXXXXXXXXXRVPNYNLIVMDEAHFXXXXXXXXXXXXXXXXXXXXXXXXXXXXXXXXXXXXXXXXXXXXXXXXXXXXXXXXXXGNDWITDFTGKTVWFVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRNSQKENDQYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRVPSHLAHKTRNALXXXXXXXXXXXXXXXXXXXXXXXXXXXXXXXXXXXXXXXTGGAMLFLVSGKGIGKTSIGLICVVASSGMLWMAEVPLQWIAXXXXXXXXXXXXXXXXXXXXXXXXXXXXXXXXXGILTLAAIVTANEMGLXXXXXXXXGMSKEPGVVSPNSYLDVDXXXXXXXXXXXXXXXXXXXXXXXXXXXXXXXXXXXXXXXXXXXXXXXXXXXXXXXXXXXXXXXXXXXXXXVNPLTLTAVVLLLVTHXXXXXXXXXXXXXXXXXXXXXXXXXXXXXXXXXXXXXXXXXXXXXXXXXXXXXVMLLILCAVQLLXXRTSWALCEVLTLAXXXXXXXXXXXXXXXXXXXXXXXXXXXXXXXXXXXXXXXXXVMKSVGTGKRGTGLXXXTLGEKWKRRLNQLSWKEFDLYKXSGITEVDRSEAKEGLKKGEVTHHAVSRXXXXXXXXXXXXXXXXXXXXXXXXXXXXXXXXXXXXXXXXXXXXXXXXXXXXXXXXXXMSTYGWNIIKLMSGKDXXXXXXXXXXXXXXXXXXXXXXXXXXXXXXXXXXKMVEPWLKNNQFCIKILNPYMPTVVEHLERXXXXXXXXXXXXXXXXXXXXXXXXXXXXXXXXXXXXXXXXXXXXNRFTMTYRRPTIERDVXXXXXXXXXXXXXXXXXXDVIGERIKRIKGEHSKTWHYDDXXXXXXXXXXXXXXXXXXXXXXXXXXXXXXXXXXPWDVVPMVIQMAMTXXXXXXXXXXXXXKVDTRTPKPMPGTRRAMEITAGWLWXXXXXXXXXXXXXXXXXTRKVRTNAXXXXXXXXXXXXXXAKAAVEDEEFWILVDRERELHKQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLHNEEKIMQQMDPEHRLLANAIFKXXXXXXXXXXXXXXXXXXXXXXXXXXXXXXXXXXXXXXXXXXFTNMEVQLIRQMEGEGVLSKXXXXXXXXXEKKITQWLETEGVERLKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKAYAQMWTLMYFHRRXXXXXXXXXCSAVPAHWVPTSRXXXXXXXXXXWMTTEDMLSVWNRVWIXXXXWMENKTPITTWENVPXXXXXXXXXXXXXXXXXXXATWAQNILIAIQQVRXXXXXXXXXXXXXXXKRFRKEEETEGAIW

SEQ ID NO: 265700 - protein, 3389 aa, Dengue virus
  MOD_RES (1)..(76): Any amino acid
  MOD_RES (89)..(94): Any amino acid
  MOD_RES (115)..(159): Any amino acid
  MOD_RES (171)..(253): Any amino acid
  MOD_RES (273)..(351): Any amino acid
  MOD_RES (368)..(395): Any amino acid
  MOD_RES (407)..(439): Any amino acid
  MOD_RES (456)..(493): Any amino acid
  MOD_RES (511)..(546): Any amino acid
  MOD_RES (557)..(573): Any amino acid
  MOD_RES (589)..(597): Any amino acid
  MOD_RES (614)..(616): Any amino acid
  MOD_RES (627)..(630): Any amino acid
  MOD_RES (644)..(650): Any amino acid
  MOD_RES (670)..(722): Any amino acid
  MOD_RES (739)..(753): Any amino acid
  MOD_RES (782)..(851): Any amino acid
  MOD_RES (867)..(872): Any amino acid
  MOD_RES (883)..(886): Any amino acid
  MOD_RES (907)..(909): Any amino acid
  MOD_RES (925)..(938): Any amino acid
  MOD_RES (956)..(1053): Any amino acid
  MOD_RES (1073)..(1102): Any amino acid
  MOD_RES (1118)..(1120): Any amino acid
  MOD_RES (1137)..(1151): Any amino acid
  MOD_RES (1160)..(1161): Any amino acid
  MOD_RES (1170)..(1177): Any amino acid
  MOD_RES (1192)..(1265): Any amino acid
  MOD_RES (1285)..(1293): Any amino acid
  MOD_RES (1307)..(1310): Any amino acid
  MOD_RES (1346)..(1391): Any amino acid
  MOD_RES (1408)..(1550): Any amino acid
  MOD_RES (1566)..(1578): Any amino acid
  MOD_RES (1591)..(1712): Any amino acid
  MOD_RES (1727)..(1819): Any amino acid
  MOD_RES (1830)..(2105): Any amino acid
  MOD_RES (2114)..(2160): Any amino acid
  MOD_RES (2198)..(2231): Any amino acid
  MOD_RES (2246)..(2256): Any amino acid
  MOD_RES (2271)..(2347): Any amino acid
  MOD_RES (2357)..(2502): Any amino acid
  MOD_RES (2518)..(2527): Any amino acid
  MOD_RES (2545)..(2608): Any amino acid
  MOD_RES (2620)..(2668): Any amino acid
  MOD_RES (2685)..(2733): Any amino acid
  MOD_RES (2743)..(2765): Any amino acid
  MOD_RES (2785)..(2847): Any amino acid
  MOD_RES (2869)..(2912): Any amino acid
  MOD_RES (2926)..(3039): Any amino acid
  MOD_RES (3059)..(3112): Any amino acid
  MOD_RES (3121)..(3129): Any amino acid
  MOD_RES (3147)..(3292): Any amino acid
  MOD_RES (3301)..(3316): Any amino acid
  MOD_RES (3328)..(3389): Any amino acid
XXXXXXXXXXXXXXXXXXXXXXXXXXXXXXXXXXXXXXXXXXXXXXXXXXXXXXXXXXXXXXXXXXXXXXXXXXXXIKVLKSFKKEISXXXXXXNRRKRTSLCLMMVLPAALAFXXXXXXXXXXXXXXXXXXXXXXXXXXXXXXXXXXXXXXXXXXXXXDTITYKCPHIAXXXXXXXXXXXXXXXXXXXXXXXXXXXXXXXXXXXXXXXXXXXXXXXXXXXXXXXXXXXXXXXXXXXXXXXXXXXXXXXXXXXAHYVGTSLIQKVVIFTLLMXXXXXXXXXXXXXXXXXXXXXXXXXXXXXXXXXXXXXXXXXXXXXXXXXXXXXXXXXXXXXXXXXXXXXXXXXXXXXXXRCPTQGEAALPEEQDQXXXXXXXXXXXXXXXXXXXXXXXXXXXXAKFQCLEPVEGXXXXXXXXXXXXXXXXXXXXXXXXXXXXXXXXXEITPQASTAEAILPEYXXXXXXXXXXXXXXXXXXXXXXXXXXXXXXXXXXXXXXPLPWTSGVTTETPIWNRXXXXXXXXXXXXXXXXXXXXXXXXXXXXXXXXXXXXIQNSGGTTIFXXXXXXXXXXXXXXXXXMSYAMCLNTFVLRKEXXXXXXXXXLVKVEYKGKDAPCKIPXXXEDGQGKVHNGXXXXANPVVIKKEEPVNXXXXXXXGESNIIIGTGDKALKINWYXXXXXXXXXXXXXXXXXXXXXXXXXXXXXXXXXXXXXXXXXXXXXXXXXXXXXALFGGVSWMMKIGIGVXXXXXXXXXXXXXXXFSCITIGIITLYLGVVVQADMGCVVNWKXXXXXXXXXXXXXXXXXXXXXXXXXXXXXXXXXXXXXXXXXXXXXXXXXXXXXXXXXXXXXXXXXXXXXXWENSIKLTIVVGDVIXXXXXXKRILTPQPMEXXXXWKTWGKAKVVTAEIQNFSFIXXXPNTPECPNTSRAWNVXXXXXXXXXXXXXXIWLKLREMYSQLCDHRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTTVVITEDCGTRGPALRTXXXXXXXXXXXXXXXXXXXXXXXXXXXXXXYGMEIRPVSEKEENMXXXLASAGSGKMDNFTMGVXXXXXXXXXXXXXXXGKKHMIAGXXFIFVLLLSXXXXXXXXAHTLIMIGSNTSDRXXXXXXXXXXXXXXXXXXXXXXXXXXXXXXXXXXXXXXXXXXXXXXXXXXXXXXXXXXXXXXXXXXXXXXXXXXTYQLWTALASLTCSNTILTXXXXXXXXXLILAGVSLLPMCQXXXXRKTDWLPMTVAAMGVSPLPLFIFGLKDALKRRSWPXXXXXXXXXXXXXXXXXXXXXXXXXXXXXXXXXXXXXXXXXXXXXXDLTVEKAANVTWEEEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGGGWRLSAQWKKGEXXXXXXXXXXXXXKNFQTTPGIFQTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRYQTTVTKSEHTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNEWITDFTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHLAYRTRXXXXXXXXXXXXXXXXXXXXXXXXXXXXXXXXXXXXXXXXXXXXXXXLFLISGRGIGKATIGLICVTVSSGMLWMADIPLQWIAXXXXXXXXXXXXXXXXXXXXXXXXXXXXXXXXXXILTLAATIAANEMGXXXXXXXXXXXSREPGVVSPNSYLDXXXXXXXXXXXXXXXXXXXXXXXXXXXXXXXXXXXXXXXXXXXXXXXXXXXXXXXXXXXXXXXXXXXXXXXXXXXXXLIAAVLLLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKKLNQLSWKEFDLYXXXXXXXXXXTEAKEGLKRRETTHHAVXXXXXXXXXXXXXXXXXXXXXXXXXXXXXXXXXXXXXXXXXXXXXXXXXXXXXXXXXXXXXXXXGWNIIKLMSGKXXXXXXXXXXXXXXXXXXXXXXXXXXXXXXXXXXXXXXXXXXXXXXXXXKVLNPYMPNVIEHLERXXXXXXXXXXXXXXXXXXXXXXXXXXXXXXXXXXXXXXXXXXXXXXXXXTHRRPTIERXXXXXXXXXXXXXXXXXXXXXXXGERIERIKDEHSSTWHYDEXXXXXXXXXXXXXXXXXXXXXXXXXXXXXXXXXXXXXXXXXXXXXXXXXXXXXXXXXXXXXXXDTRTPRPMAGTRKAMEITAEWXXXXXXXXXXXXXXXXXXXXXXXXXXXXXXXXXXXXXXXXXXXXAVEDEDFWILVDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKITQQMDPEHKRLANAIFKXXXXXXXXXXXXXXXXXXXXXXXXXXXXXXXXXXXXXXXXXXXXXXXXXXXXXXEGEGVLSKXXXXXXXXXEKKIAQWLENKGVERLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMTTEDMLXXXXXXXXXXXXXXXXKTPITTWEDVPXXXXXXXXXXXXXXXXXXXXXXXXXXXXXXXXXXXXXXXXXXXXXXXXXXXXXXXXXXXXXX

SEQ ID NO: 265701 - protein, 3389 aa, Dengue virus
  MOD_RES (1)..(94): Any amino acid
  MOD_RES (103)..(105): Any amino acid
  MOD_RES (115)..(162): Any amino acid
  MOD_RES (171)..(260): Any amino acid
  MOD_RES (270)..(441): Any amino acid
  MOD_RES (456)..(494): Any amino acid
  MOD_RES (511)..(573): Any amino acid
  MOD_RES (585)..(603): Any amino acid
  MOD_RES (612)..(633): Any amino acid
  MOD_RES (642)..(652): Any amino acid
  MOD_RES (661)..(857): Any amino acid
  MOD_RES (867)..(886): Any amino acid
  MOD_RES (899)..(909): Any amino acid
  MOD_RES (925)..(939): Any amino acid
  MOD_RES (949)..(1053): Any amino acid
  MOD_RES (1073)..(1109): Any amino acid
  MOD_RES (1118)..(1120): Any amino acid
  MOD_RES (1137)..(1268): Any amino acid
  MOD_RES (1278)..(1298): Any amino acid
  MOD_RES (1307)..(1319): Any amino acid
  MOD_RES (1333)..(1334): Any amino acid
  MOD_RES (1346)..(1391): Any amino acid
  MOD_RES (1407)..(1553): Any amino acid
  MOD_RES (1564)..(2105): Any amino acid
  MOD_RES (2114)..(2179): Any amino acid
  MOD_RES (2193)..(2237): Any amino acid
  MOD_RES (2246)..(2258): Any amino acid
  MOD_RES (2270)..(2347): Any amino acid
  MOD_RES (2357)..(2503): Any amino acid
  MOD_RES (2513)..(2535): Any amino acid
  MOD_RES (2544)..(2766): Any amino acid
  MOD_RES (2779)..(2856): Any amino acid
  MOD_RES (2865)..(2916): Any amino acid
  MOD_RES (2926)..(3041): Any amino acid
  MOD_RES (3058)..(3112): Any amino acid
  MOD_RES (3121)..(3129): Any amino acid
  MOD_RES (3142)..(3389): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRRKRTSLXXXMMFPATLAFXXXXXXXXXXXXXXXXXXXXXXXXXXXXXXXXXXXXXXXXXXXXXXXXTYKCPFIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTQKVVIFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSQASITEVILPEYXXXXXXXXXXXXXXXXXXXXXXXXXXXXXXXXXXXXXXXLPWTSGTTTKTPTWNRXXXXXXXXXXXXXXXXXXXXXXXXXXXXXXXXXXXXXXXXXXXXXXXXXXXXXXXXXXXXXXXMSYAMCLGSFVXXXXXXXXXXXXXXXXXXXKGKDAPCKXXXXXXXXXXXXXXXXXXXXXXVVIKKEEPXXXXXXXXXXXSNIVIGVGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTVVVGDVIXXXXXXXXXXXXXXXXXXXXWKTWGKAKMVTAXXXXXXXXXXXPSTPECPSAARAWNVXXXXXXXXXXXXXXXWLKLREAYTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTTVVISENCGMRGPSLRTXXXXXXXXXXXXXXXXXXXXXXXXXXXXXXXXXXXXXTSEKEENMXXXLVSAGSGKVDNFTMGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWAALVSLMXXXXXXXXXXXXXXXXXXXXXISLLPLCQXXXXXXXXXXXXXVAAMGVQPLPLFIXXLKDAPKRRSWPXXXXXXXXXXXXXXXXXXXXXXXXXXXXXXXXXXXXXXXXXXXXXXDLTVEKAPDVTWEEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWRLSAQWKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHLAHRTKXXXXXXXXXXXXXXXXXXXXXXXXXXXXXXXXXXXXXXXXXXXXXXXXXXXXXXXXXXXXXXXXXXIASSGMLWIAEIPXXXXXXXXXXXXXXXXXXXXXXXXXXXXXXXXXXXXXXXXXXXXXIIAANEMGXXXXXXXXXXXXXEPGVVPPTSYLXXXXXXXXXXXXXXXXXXXXXXXXXXXXXXXXXXXXXXXXXXXXXXXXXXXXXXXXXXXXXXXXXXXXXXXXXXXXXXLAAAVLLLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKLNQLSWKXXXXXXXXXXXXXXXXXXXXXXXRGEITRHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXERIKRIKEEHRSXXXXXXXXXXXXXXXXXXXXXXXXXXXXXXXXXXXXXXXXXXXXXXXXXXXXXXXXXXXXXXXXXXXXXXXXXXXXXXGTRKVMGIXXXXXXXXXXXXXXXXXXXXXXXXXXXXXXXXXXXXXXXXXXXXXXXXXXXXENFWKLVDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHQMDPEHRRLANAIFXXXXXXXXXXXXXXXXXXXXXXXXXXXXXXXXXXXXXXXXXXXXXXXXXXXXXXXEGEGVLSEXXXXXXXXXEKRIIQWLETKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265702 - protein, 3405 aa, Dengue virus
  MOD_RES (109)..(109): Any amino acid
  MOD_RES (869)..(873): Any amino acid
  MOD_RES (1171)..(1172): Any amino acid
  MOD_RES (1274)..(1275): Any amino acid
  MOD_RES (1285)..(1288): Any amino acid
  MOD_RES (1471)..(1471): Any amino acid
  MOD_RES (2064)..(2064): Any amino acid
  MOD_RES (2266)..(2270): Any amino acid
  MOD_RES (2671)..(2671): Any amino acid
  MOD_RES (3127)..(3147): Any amino acid
  MOD_RES (3389)..(3405): Any amino acid
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRKRSVTMLLMLXPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVXXXXXQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFFLLXXGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWXXLLSLTFIKTXXXXHYAWKTMAMVLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQXKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGXERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAXXXXXHAAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNXQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPXXXXXXXXXXXXXXXXXXXXXERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNESXXXXXXXXXXXXXXXXX

SEQ ID NO: 265703 - protein, 3405 aa, Dengue virus
  MOD_RES (35)..(37): Any amino acid
  MOD_RES (55)..(61): Any amino acid
  MOD_RES (109)..(109): Any amino acid
  MOD_RES (212)..(212): Any amino acid
  MOD_RES (266)..(266): Any amino acid
  MOD_RES (297)..(308): Any amino acid
  MOD_RES (344)..(354): Any amino acid
  MOD_RES (385)..(385): Any amino acid
  MOD_RES (421)..(426): Any amino acid
  MOD_RES (469)..(473): Any amino acid
  MOD_RES (493)..(496): Any amino acid
  MOD_RES (523)..(546): Any amino acid
  MOD_RES (562)..(566): Any amino acid
  MOD_RES (689)..(696): Any amino acid
  MOD_RES (789)..(814): Any amino acid
  MOD_RES (869)..(873): Any amino acid
  MOD_RES (962)..(972): Any amino acid
  MOD_RES (1008)..(1008): Any amino acid
  MOD_RES (1171)..(1172): Any amino acid
  MOD_RES (1274)..(1275): Any amino acid
  MOD_RES (1285)..(1288): Any amino acid
  MOD_RES (1316)..(1317): Any amino acid
  MOD_RES (1374)..(1391): Any amino acid
  MOD_RES (1471)..(1479): Any amino acid
  MOD_RES (1529)..(1552): Any amino acid
  MOD_RES (1576)..(1579): Any amino acid
  MOD_RES (1604)..(1614): Any amino acid
  MOD_RES (1626)..(1636): Any amino acid
  MOD_RES (1670)..(1675): Any amino acid
  MOD_RES (1706)..(1706): Any amino acid
  MOD_RES (1740)..(1760): Any amino acid
  MOD_RES (1778)..(1790): Any amino acid
  MOD_RES (1835)..(1835): Any amino acid
  MOD_RES (1884)..(1933): Any amino acid
  MOD_RES (1965)..(1987): Any amino acid
  MOD_RES (2005)..(2016): Any amino acid
  MOD_RES (2034)..(2090): Any amino acid
  MOD_RES (2125)..(2126): Any amino acid
  MOD_RES (2204)..(2231): Any amino acid
  MOD_RES (2249)..(2254): Any amino acid
  MOD_RES (2266)..(2270): Any amino acid
  MOD_RES (2303)..(2327): Any amino acid
  MOD_RES (2340)..(2346): Any amino acid
  MOD_RES (2368)..(2385): Any amino acid
  MOD_RES (2427)..(2513): Any amino acid
  MOD_RES (2556)..(2594): Any amino acid
  MOD_RES (2639)..(2659): Any amino acid
  MOD_RES (2671)..(2679): Any amino acid
  MOD_RES (2704)..(2732): Any amino acid
  MOD_RES (2790)..(2812): Any amino acid
  MOD_RES (2830)..(2851): Any amino acid
  MOD_RES (2887)..(2900): Any amino acid
  MOD_RES (2941)..(2990): Any amino acid
  MOD_RES (3033)..(3034): Any amino acid
  MOD_RES (3090)..(3102): Any amino acid
  MOD_RES (3127)..(3147): Any amino acid
  MOD_RES (3195)..(3239): Any amino acid
  MOD_RES (3251)..(3269): Any amino acid
  MOD_RES (3292)..(3315): Any amino acid
  MOD_RES (3339)..(3347): Any amino acid
  MOD_RES (3389)..(3405): Any amino acid
MNNQRKKTGQPSFNMLKRARNRVSTGSQLAKRFSXXXLSGQGPMKMVMAFIAFLXXXXXXXTAGILARWGSFKKSGAIKVLRGFKKEISSMLNTMNRRKKSVTMLLMLXPTVLTFHLTTRGGEPHMIVTKQERGKSLLFKTSVGINMCTLIAMDLGEFCDDTMTYKCPRITETEPDDVDCWCNATETWVTYGTCSQTGEHRREKRSVALAPXVGLGLETRAETWMSSEGAWKQIQKVETWVLRHPGFTVIAFFLAHVIGTSITQKXIIFILLMLATPSMAMRCVGIGNRDFVEGLSXXXXXXXXXXXXSCVTTMAKNKPTLDIELLKTEVTNPAILRKLCIEAXXXXXXXXXXXPTQGEATLMEEQDTNFVCRRTLVDRGWGNGXGLFGKGSLLTCAKFKCVTKLEGKTVQHENLKYSVIXXXXXXDQHQVGNETTEHGTIATITPQAPTSEIQLTDYGTLTLDCSPRXXXXXNEMVLLTMKKKAWLVHKQWXXXXPLPWTSGATTSQETWNRKDLLVTFKTXXXXXXXXXXXXXXXXXXXXXXXXATEIQTTGTTTIFAGXXXXXLKMDKLTLKGTSYVMCTGSFKLEKELAETQHGTVLVQVRYEGTDAPCKIPFLTQDEKGVIQNGRLVTANPIVTDKEKPVNIETEPPFGESYIVVGVGEKALKLSWFKRGSTIGKMFVATARGXXXXXXXXDTAWDFGSVGGVFTSVGKLVHQVFGAAYGVLFSGVSWTMKIGIGILLTWLGLNSRSTSFSMTCIAVGMITLYLGAMVQADSGCVVNWKGRELXXXXXXXXXXXXXXXXXXXXXXXXXXKRLSAAIGRAWEEGVCGIRSTTRLENIMWRQISNELNHILLENDMKFTVVVGDAXXXXXQGKKMIRPQPMEHRYSWRIWGKAKIIGADIQNSTFIIDGPDTPECPDNQRAWNIWEVEDYGFGVFTTNIWLKLRDSYTQMCDHRLMSAXXXXXXXXXXXMGYWIESERNETWKLAKASFIEVKTCTWPKSHTLWXNGVLESEMIIPKIHGGPTSQHNYRPGYFTQAAGPWHLGKLELDFNFCEGTTVVVDEHCGSRGPSLRTTTVTGKTIHEWCCRSCTLPPLRFKGEDGCWYGMEIRPVKEKEENLVRSMVSAGLGEVDSFSLGILCVSILTEEVMRSRWSRRMLMTGTLAVFLLLXXGQLTWNDLIRSCIMVGANASDKMGMGMTYLALMATFRMRPMLAVGLLIRRLTSREVLLLTVGLSLVASVELPSSLEELGDGLAMGIMMLKLLTEFQPHQLWXXLLSLTFVKTXXXXDYAWKTTAMALSIVSLLPLCMSTTSQKXXWLPVLLGSFGCKPLTMFLITENKIWGRRSWPLNEGIMAIGVVSILLSALLKNDVPLXXXXXXXXXXXXXXXXXXSSADLSLEKAAEVSWEQEAEHSGTSHNILVEIQDDGTMKIKDEERDDTITILLKATLLAVSGVYPMSIPATLFVWHFWQXXXXXXXXXLWDTPSPPEVGKAVLDDGIYRILQRGLLGRSQVGVGVFQDGVFHTMWHVXXXXXXXXXXXXXXXXXXXXXXXXISYGGGWRFRGSWNAGEEVQVIAXXXXKNPKNVQTTPGTFKTSEGEVGAIAXXXXXXXXXXXIVNRERKIVGLXXXXXXXXXXXYVSAIAQAKTSQEGPLPEIEDEVFKKRNLTIMDXXXXXXKTRRYLPAIVREAIKRRLRTLVLAPTRVVAXEMAEALKGVPIRYQTTAVKSEHTGREIVDLMCHXXXXXXXXXXXXXXXXXXXXXDEAHFTDPASIAARGYIXXXXXXXXXXXXXMTATPPGSMEAFPQSNAVIQDEEKDIPERSWNSGYDWITDFPGKXVWFVPSIKAGNDIANCLRKNGKRVVQLSRKTFDTEYQKTRNNDWDYVVXXXXXXXXXXXXXXXXXXXXXXXXXXXXXXXXXXXXXXXXXXXXXXXXXXRRGRIGRNQNKEGDQYVYMGQPLKNDEDHAHXXXXXXXXXXXXXXXXXXXXXXXPEREKSAAVDGEYRLRGXXXXXXXXXXXXGDLPVWLSHKVASEGFQXXXXXXXXXXXXXXXXXXXXXXXXXXXXXXXXXXXXXXXXXXXXXXXXXXXXXXXXXFAAGRRSVSGDLISEIGKLPQHLTLKAQNALDNLXXLHNSEQGGKAYRHALEELPDTIETIMLLALIAVLTGGVTLFFLSGKGLGKTSIGLLCVTASSALLWMANVEPHWIAAXXXXXXXXXXXXXXXXXXXXXXXXXXXXYVVIGLLFIILTVAANEXXXXXXTKKDLGIGYVAXXXXXHATMLDVDLRPASAWTLYAVATTVITPMMRHTXXXXXXXXXXXXXXXXXXXXXXXXXGWPISKMDLGVPXXXXXXXSQVNPLTLIAAVLMLLAHYAIXXXXXXXXXXXXXXXXXXAGIMKNPTIDGIVTIDLDPVVYDTKFEKQLGQVMLLILCTSXXXXXXXXXXXXXXXXXXXXXXXXXXXXXXXXXXXXXXXXXXXXXXXXXXXXXXXXXXXXXXXXXXXXXXXXXXXXXXXXXXXXXXXQLSKSEFNIYKRSGIIEVDRSEAKEGLKRGETTRHAVSRGTAXXXXXXXXXXXXXXXXXXXXXXXXXXXXXXXXXXXXXXXVKGYTKGGPGHEEPVPMATYGWNLVKLYSGKDVFFTPPEKCDTLXXXXXXXXXXXXXXXXXXXXXLKMVEPWLKGNXXXXXXXXXPYMPSVVEALEQMQRKYGGMLVRNXXXXXXXXXXXXXXXXXXXXXXXXXXXXXMLLNRFTMAHRKPTYERDVDLGTGTRHVAVEPEIANIDIIGQRIENIKNEHKSTWHYXXXXXXXXXXXXXXXXXXXXXXXSSMVNGVVRLLTKPWDVXXXXXXXXXXXXXXXXXXXXXXEKVDTRTPRAKRGTTQIMEVTARWLWSFLSRNKKPXXXXXXXXXXXXXXNAAIGAVFIDENQWNSAKEAVEDDRFWDLVQKERELHKQGXXXXXXXXXXXXXXXXXXXXXXXXXXXXXXXXXXXXXXXXXXXXXXXXXXHWFSRENSFSGVEGEGLHRLGYILRDISNISGGSMYADDTAGXXTRVTEDDLQNEARITEIMEPEHALLATAIFKLTYQNKVVRVQRPAKSGTVMDVISXXXXXXXXXXXXXGLNTFTNMEVQLIRQMESEGIFLPXXXXXXXXXXXXXXXXXXXXXERLRRMAISGDDCVVKPTDDRFATALIALNDMGKVRKDVPQWEPSKGXXXXXXXXXXXXXXXXXXXXXXXXXXXXXXXXXXXXXXXXXXXXXGWSLKETACLGXXXXXXXXXXXXXXXXXXXAANAICSAVPVDWIPTSRTTWSXXXXXXXXXXXXXXXXXXXXXXXXNPWMEDKTHVSSWEEVPYLGKREXXXXXXXXXLTARATWASNIQVAINQVRRLLGNENYSDYMISMKRFKNEGXXXXXXXXXXXXXXXXX

SEQ ID NO: 265704 - protein, 3405 aa, Dengue virus
  MOD_RES (18)..(37): Any amino acid
  MOD_RES (55)..(66): Any amino acid
  MOD_RES (109)..(109): Any amino acid
  MOD_RES (206)..(227): Any amino acid
  MOD_RES (261)..(323): Any amino acid
  MOD_RES (341)..(359): Any amino acid
  MOD_RES (377)..(388): Any amino acid
  MOD_RES (419)..(428): Any amino acid
  MOD_RES (465)..(474): Any amino acid
  MOD_RES (492)..(496): Any amino acid
  MOD_RES (516)..(551): Any amino acid
  MOD_RES (561)..(568): Any amino acid
  MOD_RES (594)..(596): Any amino acid
  MOD_RES (686)..(699): Any amino acid
  MOD_RES (728)..(732): Any amino acid
  MOD_RES (773)..(826): Any amino acid
  MOD_RES (869)..(873): Any amino acid
  MOD_RES (930)..(936): Any amino acid
  MOD_RES (962)..(979): Any amino acid
  MOD_RES (1008)..(1012): Any amino acid
  MOD_RES (1040)..(1045): Any amino acid
  MOD_RES (1077)..(1113): Any amino acid
  MOD_RES (1171)..(1172): Any amino acid
  MOD_RES (1229)..(1231): Any amino acid
  MOD_RES (1274)..(1275): Any amino acid
  MOD_RES (1285)..(1288): Any amino acid
  MOD_RES (1314)..(1323): Any amino acid
  MOD_RES (1367)..(1392): Any amino acid
  MOD_RES (1431)..(1431): Any amino acid
  MOD_RES (1445)..(1445): Any amino acid
  MOD_RES (1471)..(1481): Any amino acid
  MOD_RES (1499)..(1511): Any amino acid
  MOD_RES (1528)..(1553): Any amino acid
  MOD_RES (1573)..(1579): Any amino acid
  MOD_RES (1597)..(1637): Any amino acid
  MOD_RES (1666)..(1681): Any amino acid
  MOD_RES (1701)..(1805): Any amino acid
  MOD_RES (1817)..(1817): Any amino acid
  MOD_RES (1834)..(1933): Any amino acid
  MOD_RES (1959)..(2095): Any amino acid
  MOD_RES (2107)..(2107): Any amino acid
  MOD_RES (2124)..(2132): Any amino acid
  MOD_RES (2144)..(2163): Any amino acid
  MOD_RES (2174)..(2176): Any amino acid
  MOD_RES (2198)..(2231): Any amino acid
  MOD_RES (2249)..(2255): Any amino acid
  MOD_RES (2266)..(2270): Any amino acid
  MOD_RES (2282)..(2350): Any amino acid
  MOD_RES (2366)..(2390): Any amino acid
  MOD_RES (2403)..(2515): Any amino acid
  MOD_RES (2555)..(2599): Any amino acid
  MOD_RES (2612)..(2613): Any amino acid
  MOD_RES (2639)..(2682): Any amino acid
  MOD_RES (2700)..(2738): Any amino acid
  MOD_RES (2775)..(2854): Any amino acid
  MOD_RES (2883)..(2919): Any amino acid
  MOD_RES (2940)..(3010): Any amino acid
  MOD_RES (3030)..(3041): Any amino acid
  MOD_RES (3070)..(3071): Any amino acid
  MOD_RES (3089)..(3103): Any amino acid
  MOD_RES (3127)..(3156): Any amino acid
  MOD_RES (3183)..(3271): Any amino acid
  MOD_RES (3290)..(3316): Any amino acid
  MOD_RES (3338)..(3354): Any amino acid
  MOD_RES (3364)..(3366): Any amino acid
  MOD_RES (3389)..(3405): Any amino acid
MNNQRKKTGQPSFNMLKXXXXXXXXXXXXXXXXXXXXLSGQGPMKFVMAFIAFLXXXXXXXXXXXXARWSSFKKNGAIRVLRGFKKEVSNMLNIINRRKRSVTMFLMLXPTVLAFHLTTRGGEPHMVVGKQERGKSLLFKTSAGINMCTLIAMDLGELCEDTMTYKCPQITEVEPDDVDCWCNTTDTWVTYGTCTQIGEHRRDKRXXXXXXXXXXXXXXXXXXXXXXEGAWRQIQRVETWVLRHPGFTVTALFLAHVIGTXXXXXXXXXXXXXXXXXXXXXXXXXXXXXXXXXXXXXXXXXXXXXXXXXXXXXXXXXXXXXXXELLKTEVTDPAVLRKLCXXXXXXXXXXXXXXXXXXXATLVEEQDSNFVCRRTFXXXXXXXXXXXXGKGSLMTCAKFKCVTKLEGKIAQYENLKYSXXXXXXXXXXHQVGNETTDHGTTATITPQAPSTEIQLTDYGVLTLDXXXXXXXXXXEMVLLTMKEKAWLVHKQXXXXXPLPWTSGALTLQETWNRQDXXXXXXXXXXXXXXXXXXXXXXXXXXXXXXXXXXXXMSGTTTIFAXXXXXXXXMDKLTLRGISYVMCTGLFKLEKEVAXXXHGTVLVQIRYEGTDAPCKIPFSSQDEKGATQNGRVITANPIVTDKDKPVNIEAEPPFGESYIIIGAGEKTLKLSWFKKGSSIGKMFVATXXXXXXXXXXXXXXWDFGSIGGLFTSIGKLIHQVFGAAYGVLXXXXXWTMKIGLGVLLTWLGLNSRSASLSMTCIAVGLITLYLGVMXXXXXXXXXXXXXXXXXXXXXXXXXXXXXXXXXXXXXXXXXXXXXXXXXXXXXXEGVCGIRSVTRLENIMWKQISNELNYILLENGIKLTVVVGDVXXXXXQGKKTIRPQPMEHKYSWKSWGKAKIIGADAQNATFIIDGPNTPECPDGQRAWNIWEXXXXXXXIFTTNIWLKMRDSHTQACDHRLMSAXXXXXXXXXXXXXXXXXXEKNETWKLAGASFIEVKTCVWPKSHTLWXXXXXESEMVIPKIYGGPISQHNHRPGYFTQTXXXXXXGKLELDFDFCEGTTVVVDEHCGYRGPSLRTTXXXXXXXXXXXXXXXXXXXXXXXXXXXXXXXXXXXXXKDKEENLVKSMVSAGSGEVDNFSLGILCASIIIEEVMRSRWSKKMLMTGTLVVFLLLXXGQLTWSDLTRLCIMVGANAFDNMGMGTTHLALMATFKIRPMFAVGLLFRKLTSREVXXXTIGLSLVASVELPNSLDELGDGLAIGIMMLKLLTDFQSYQLWXXLLSLTFIRTXXXXDYAWKTMAMILSIASLIPLCLSTTSXXXXXXXXXXGSLGCKPLPMFLITETEIWGRKSWPINEGIMAVGIVSILLSALXXXXXXXXXXXXXXXXXXXXXXXXXXSADLSLEKAAVVSWEEEAEHSGASHNILVVVQDDGTMKXKDEEKDDTLTILLXATLLAISGVYPLSIPATLFLWYFWQXXXXXXXXXXXDTPSPPEVEKAVLDDGIXXXXXXXXXXXXXVGVGVFQEGVFHTMWHXXXXXXXXXXXXXXXXXXXXXXXXXXSYGGGWRLQGLWNTGEEVQXXXXXXXKNPKNVQTAPGTFKTSEXXXXXXXXXXXXXXXXXXXXXXXXXXXXXXXXXXXXXXXXXVSAIAQARASQEGPLPEIEEEVFKKRNLXXXXXXXXXXXXXXXXPAMVREAIKRKLRTLVLAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAIIQDEERDIXERSWNSGHEWITDFPGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRGRIGRNQNKEGDQYIYMGQPLKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSISGDLILEIXKLPQHLTQKAQNALDNXXXXXXXXXGGRAYRHALEEXXXXXXXXXXXXXXXXXXXXVMLFFLSGKGXXXTSIGLLCVTSSSALLWMANVEXXXXXXXXXXXXXXXXXXXXXXXXXXXXXXXXXXYVVIGLLFVILTVAANEXXXXXXXKKDLGIGHAAXXXXXHVTMLDVDLRPXXXXXXXXXXXXXXXXXXXXXXXXXXXXXXXXXXXXXXXXXXXXXXXXXXXXXXXXXXXXXXXXXXXXXPLTLTATVLMLVAHYXXXXXXXXXXXXXXXXXXXXXXXXXNPTVDGIVTIDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKSEFNTYKKSGIVEVDRSEAKEGLRRGEIIKHAVSRGTXXXXXXXXXXXXXXXXXXXXXXXXXXXXXXXXXXXXXXXXXXXXXKGGAGHEEPIPMXXYGWNLVRLHSGKDVFFMPPEKCDTLXXXXXXXXXXXXXXXXXXXXXXXXXXXXXXXXXXXXXXXXXXXXPSVVETLEQMQRRHGGMXXXXXXXXXXXXXXXXXXXXXXXXXXXXXXXXXXXXXXXTMTHRKPTYEKDVDLGAGTRHVAVEPEEANLDIIGQXXXXXXXXXXXXXXXXXXXXXXXXXXXXXXXXXXXXXXXXXXXXXXXXXXXXXXXXXXXXXXXXXXXXXXXXXXXXXXXXDTRTPRAKRGTVQIMEMTARWLWSFLSRXXXXXXXXXXXXXXXXXXXXXXXXXXXXXXXXXXXXXAVEDERFWELVRRERELHKQXXXXXXXXXXXXXXXXXXXXXXXXXXXXXXXXXXXXXXXXXXXXXXXXXXXXXXXXXXXXXXXXXXXXXXXGYILRDISRIPGGSMYADDXXXXXXXXXXXXLQNEAKITDIMEPEHALLAKAIFKLTYQXXVVRVQRPARNGTVMDVIXXXXXXXXXXXXXXXLNTFTNMGAQLIRQMESEGIFFPXXXXXXXXXXXXXXXXXXXXXXXXXXXXXXGDDCVVKPVDDRFATALSALNDMGKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAICSADPVEWVPTSRTTXXXXXXXXXXXXXXXXXXXXXXXXXXXPWMEDKTHISSWEEVPYLGKRXXXXXXXXXXXXXXXXXATNVQVAINXXXRLIGNENYLDFMTSMKRFKNEIXXXXXXXXXXXXXXXXX

SEQ ID NO: 265705 - protein, 3405 aa, Dengue virus
  MOD_RES (1)..(1): Any amino acid
  MOD_RES (11)..(81): Any amino acid
  MOD_RES (109)..(109): Any amino acid
  MOD_RES (136)..(136): Any amino acid
  MOD_RES (152)..(154): Any amino acid
  MOD_RES (180)..(194): Any amino acid
  MOD_RES (205)..(243): Any amino acid
  MOD_RES (256)..(329): Any amino acid
  MOD_RES (340)..(359): Any amino acid
  MOD_RES (377)..(401): Any amino acid
  MOD_RES (418)..(432): Any amino acid
  MOD_RES (444)..(475): Any amino acid
  MOD_RES (491)..(505): Any amino acid
  MOD_RES (515)..(568): Any amino acid
  MOD_RES (593)..(610): Any amino acid
  MOD_RES (635)..(636): Any amino acid
  MOD_RES (650)..(651): Any amino acid
  MOD_RES (686)..(705): Any amino acid
  MOD_RES (725)..(746): Any amino acid
  MOD_RES (773)..(850): Any amino acid
  MOD_RES (869)..(873): Any amino acid
  MOD_RES (906)..(911): Any amino acid
  MOD_RES (930)..(946): Any amino acid
  MOD_RES (959)..(982): Any amino acid
  MOD_RES (992)..(1013): Any amino acid
  MOD_RES (1030)..(1134): Any amino acid
  MOD_RES (1171)..(1174): Any amino acid
  MOD_RES (1203)..(1205): Any amino acid
  MOD_RES (1225)..(1232): Any amino acid
  MOD_RES (1249)..(1261): Any amino acid
  MOD_RES (1274)..(1275): Any amino acid
  MOD_RES (1285)..(1288): Any amino acid
  MOD_RES (1314)..(1325): Any amino acid
  MOD_RES (1348)..(1394): Any amino acid
  MOD_RES (1429)..(1448): Any amino acid
  MOD_RES (1460)..(1482): Any amino acid
  MOD_RES (1499)..(1561): Any amino acid
  MOD_RES (1571)..(1586): Any amino acid
  MOD_RES (1597)..(1638): Any amino acid
  MOD_RES (1666)..(1683): Any amino acid
  MOD_RES (1701)..(1941): Any amino acid
  MOD_RES (1951)..(2095): Any amino acid
  MOD_RES (2105)..(2107): Any amino acid
  MOD_RES (2124)..(2177): Any amino acid
  MOD_RES (2198)..(2256): Any amino acid
  MOD_RES (2266)..(2270): Any amino acid
  MOD_RES (2282)..(2353): Any amino acid
  MOD_RES (2364)..(2520): Any amino acid
  MOD_RES (2531)..(2538): Any amino acid
  MOD_RES (2550)..(2600): Any amino acid
  MOD_RES (2612)..(2618): Any amino acid
  MOD_RES (2639)..(2686): Any amino acid
  MOD_RES (2697)..(2740): Any amino acid
  MOD_RES (2756)..(2757): Any amino acid
  MOD_RES (2775)..(2857): Any amino acid
  MOD_RES (2880)..(2919): Any amino acid
  MOD_RES (2940)..(3015): Any amino acid
  MOD_RES (3028)..(3042): Any amino acid
  MOD_RES (3070)..(3072): Any amino acid
  MOD_RES (3088)..(3116): Any amino acid
  MOD_RES (3127)..(3162): Any amino acid
  MOD_RES (3180)..(3271): Any amino acid
  MOD_RES (3289)..(3320): Any amino acid
  MOD_RES (3334)..(3368): Any amino acid
  MOD_RES (3389)..(3405): Any amino acid
XINQRKKTGRXXXXXXXXXXXXXXXXXXXXXXXXXXXXXXXXXXXXXXXXXXXXXXXXXXXXXXXXXXXXXXXXXXXXXXXRGFKREISNMLSIMNRRKRSVTMILMLXPTALTFHLTTRGGEPHMIVGKQERGKXLLFKTSTGVNMCTLIXXXLGELCEDTITYKCPRISEAEPDDVDXXXXXXXXXXXXXXXSRTGEHRRDKXXXXXXXXXXXXXXXXXXXXXXXXXXXXXXXXXXXXXXXHPGFTVMALFLAXXXXXXXXXXXXXXXXXXXXXXXXXXXXXXXXXXXXXXXXXXXXXXXXXXXXXXXXXXXXXXXXXXXXXXXXXXVTSPAILRKLXXXXXXXXXXXXXXXXXXXXATLVEEQDANFVCRRTLXXXXXXXXXXXXXXXXXXXXXXXXXVTKLEGKIVQHENLKYXXXXXXXXXXXXXXXNESTEHGTIATXXXXXXXXXXXXXXXXXXXXXXXXXXXXXXXXMVLLTMEKKSWLVHKXXXXXXXXXXXXXXXTTQETWNRQXXXXXXXXXXXXXXXXXXXXXXXXXXXXXXXXXXXXXXXXXXXXXXXXXXXXXXMDKLTLKGVSYVMCTGPFKLEKEVXXXXXXXXXXXXXXXXXXAPCKIPFSAQDGKGVTQNGRVITAXXIVTDREKPVNIEAXXPFGESYIIIGAGEKTLKLSWFKKGSNIGKMFEATXXXXXXXXXXXXXXXXXXXXGGVFTSAGKLVHQVFGAAYXXXXXXXXXXXXXXXXXXXXXXGLNSRNTSLSVMCIVVGLVTLYLGAMXXXXXXXXXXXXXXXXXXXXXXXXXXXXXXXXXXXXXXXXXXXXXXXXXXXXXXXXXXXXXXXXXXXXXXXXXXXXXXNHILLENDIKFTVVVGNAXXXXXQGRKMVRPQPMEYKYSWKIWGKAKIIGADTQNXXXXXXGPDTPECPDEQRAWNIWEXXXXXXXXXXXXXXXXXRDSYTQACDHRLXXXXXXXXXXXXXXXXXXXXXXXXETWKLTRASXXXXXXXXXXXXXXXXXXXXXXSEMIIPKMYGGPISQHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSLGLLCTSIMTEEVMRSRWSRKMLMTGILAVFFLLXXXXLTWNDLTRLCIMVGANASDRMGMGMTYLXXXATFKIRPMFAVGLLLRRLTXXXXXXXXIGLSLVAFVELPNSLEXXXXXXXXXXXXXKLLTDFQPHQLWXXLLSLTFVRTXXXXDYAWRTMAMVLSVVSLFPLCMSTTSXXXXXXXXXXXXLGCKPLTMFLITENEIWGRKSWXXXXXXXXXXXXXXXXXXXXXXXXXXXXXXXXXXXXXXXXXXXXXXXDLLLDKAAKVSWEQEAEHSGASHNILVEVQDDGPXXXXXXXXXXXXXXXXXXXXLAISGVYPLSIXXXXXXXXXXXXXXXXXXXXXXXTPSPPKVERAVLDNGIXXXXXXXXXXXXXXXXXXXXXXXXXXXXXXXXXXXXXXXXXXXXXXXXXXXXXXXXXXXXXXXQGLWNTGEEXXXXXXXXXXXXXXXXTMPGTFKTPEXXXXXXXXXXXXXXXXXXXXXXXXXXXXXXXXXXXXXXXXXXSAIAQTKASQEGPLPEIENEVFRKRNLXXXXXXXXXXXXXXXXXXIVREAIKRRLRTLVLAPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHNKEGDQYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKSVSGDLILXXXKLPQHLTLKAQNALDNXXXXXXXXXXXXXXXXXXXXXXXXXXXXXXXXXXXXXXXXXXXXXXXXXXXXXXSIGLLCVITSSALLWIASVEXXXXXXXXXXXXXXXXXXXXXXXXXXXXXXXXXXXXXXXXXXXXXXXXXXXXXXXXXXXKDLGIGHAVXXXXXHATMLDIDLHPXXXXXXXXXXXXXXXXXXXXXXXXXXXXXXXXXXXXXXXXXXXXXXXXXXXXXXXXXXXXXXXXXXXXXXXXLTATVLMLVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNTYKKSGIMEXXXXXXXXGLKRGEITKHAXXXXXXXXXXXXXXXXXXXXXXXXXXXXXXXXXXXXXXXXXXXXXXXXXXXGGLGHEEPIPMXXXXXXXVKLHSGKDVFFVPPEKCDTLXXXXXXXXXXXXXXXXXXXXXXXXXXXXXXXXXXXXXXXXXXXXXXXXETLEQMQRRHXXXXXXXXXXXXXXXXXXXXXXXXXXXXXXXXXXXXXXXXXXXXAHRKPTFERDVDLGAXXRHVTVEPEVPNLDIIGQXXXXXXXXXXXXXXXXXXXXXXXXXXXXXXXXXXXXXXXXXXXXXXXXXXXXXXXXXXXXXXXXXXXXXXXXXXXXXXXXXXXTPKAKQGTAQIMEVTARWLWSFXXXXXXXXXXXXXXXXXXXXXXXXXXXXXXXXXXXXXXXXAVEDERFWNLVKKERELHKQXXXXXXXXXXXXXXXXXXXXXXXXXXXXXXXXXXXXXXXXXXXXXXXXXXXXXXXXXXXXXXXXXXXXXXXXXXXXDISKIPGGSMYAXXXXXXXXXXXXXXXRNEARITDIMEPEHALLARSIFKLTYQXXXVRVQRPTKNGTVMDVXXXXXXXXXXXXXXXXXXXXXXXXXXXXXQMESEEIFSPXXXXXXXXXXXXXXXXXXXXXXXXXXXXXXXXXXXXKPIDDRFAAALTALNDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNANCSAVPIDWVPTSRTXXXXXXXXXXXXXXXXXXXXXXXXXXXXXXXXDKTHVSSWGDVPYXXXXXXXXXXXXXXXXXXXXXXXXXXXXXXXXXXXIGNENYLDYMISMKRFKNDSXXXXXXXXXXXXXXXXX

SEQ ID NO: 265706 - protein, 3405 aa, Dengue virus
  MOD_RES (1)..(90): Any amino acid
  MOD_RES (109)..(110): Any amino acid
  MOD_RES (120)..(164): Any amino acid
  MOD_RES (178)..(243): Any amino acid
  MOD_RES (256)..(403): Any amino acid
  MOD_RES (414)..(432): Any amino acid
  MOD_RES (444)..(505): Any amino acid
  MOD_RES (515)..(568): Any amino acid
  MOD_RES (582)..(613): Any amino acid
  MOD_RES (634)..(651): Any amino acid
  MOD_RES (662)..(705): Any amino acid
  MOD_RES (725)..(752): Any amino acid
  MOD_RES (767)..(883): Any amino acid
  MOD_RES (895)..(911): Any amino acid
  MOD_RES (928)..(946): Any amino acid
  MOD_RES (959)..(1018): Any amino acid
  MOD_RES (1030)..(1134): Any amino acid
  MOD_RES (1145)..(1154): Any amino acid
  MOD_RES (1171)..(1174): Any amino acid
  MOD_RES (1184)..(1185): Any amino acid
  MOD_RES (1203)..(1213): Any amino acid
  MOD_RES (1223)..(1238): Any amino acid
  MOD_RES (1249)..(1275): Any amino acid
  MOD_RES (1285)..(1288): Any amino acid
  MOD_RES (1311)..(1328): Any amino acid
  MOD_RES (1345)..(1395): Any amino acid
  MOD_RES (1424)..(1448): Any amino acid
  MOD_RES (1459)..(1482): Any amino acid
  MOD_RES (1496)..(1683): Any amino acid
  MOD_RES (1698)..(2177): Any amino acid
  MOD_RES (2195)..(2256): Any amino acid
  MOD_RES (2266)..(2520): Any amino acid
  MOD_RES (2531)..(2626): Any amino acid
  MOD_RES (2636)..(2687): Any amino acid
  MOD_RES (2697)..(2758): Any amino acid
  MOD_RES (2769)..(2857): Any amino acid
  MOD_RES (2872)..(2928): Any amino acid
  MOD_RES (2939)..(3016): Any amino acid
  MOD_RES (3028)..(3278): Any amino acid
  MOD_RES (3289)..(3320): Any amino acid
  MOD_RES (3334)..(3405): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMLNVMNRRKRSATMLLMLXXTTLAFHLTTXXXXXXXXXXXXXXXXXXXXXXXXXXXXXXXXXXXXXXXXXXXXXYKCPRISEAEPDDXXXXXXXXXXXXXXXXXXXXXXXXXXXXXXXXXXXXXXXXXXXXXXXXXXXXXXXXXXXXXXXXXXHPGFTMIALFLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLEGKTVQHEXXXXXXXXXXXXXXXXXXXNETTDHGTTATXXXXXXXXXXXXXXXXXXXXXXXXXXXXXXXXXXXXXXXXXXXXXXXXXXXXXXXXXXXXXXASQETWNRKXXXXXXXXXXXXXXXXXXXXXXXXXXXXXXXXXXXXXXXXXXXXXXXXXXXXXXMDKLTLKGVSYVMXXXXXXXXXXXXXXXXXXXXXXXXXXXXXXXXKIPFSTQDERGVTQNGRVITXXXXXXXXXXXXXXXXXXPFGESYITIGXXXXXXXXXXXXXXXXXXXXXXXXXXXXXXXXXXXXXXXXXXXXGGVFTSMGKLIHQVFGTAYXXXXXXXXXXXXXXXXXXXXXXXXXXXXTSLSMTCIVVGMVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMEYKYSWKIWGXXXXXXXXXXXXXXXXXGPNTPECSDDQRAWNIXXXXXXXXXXXXXXXXXXXRDSHTQMCDHRLXXXXXXXXXXXXXXXXXXXXXXXXXXXXXXXXXXXXXXXXXXXXXXXXXXXXXXXXXXXXPKIYGGPMSQHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSLGLLCVSIXXXXXXXXXXSRKMLMAGTLAVLFLLXXXXLTWKDLIRLXXMVGANVSDRMGMGTTHLXXXXXXXXXXXFAVGLLLRRXXXXXXXXXXXXXXXXASAELPNSLEXXXXXXXXXXXXXXXXXXXXXXXXXXXLLSFTFIKTXXXXHCAWKTMAMVLSIVSLFPLCMSXXXXXXXXXXXXXXXXXXKPLAMFLIVENKIWGRXXXXXXXXXXXXXXXXXXXXXXXXXXXXXXXXXXXXXXXXXXXXXXXXXXXLSLDKAAEVSWEKEAEHSGASHNIFVEVXXXXXXXXXXXXXXXXXXXXXXXXXLAISGVYPLSXXXXXXXXXXXXXXXXXXXXXXXXTPSPPVVERAVLDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVREAIKRKMRTLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIGLLCVMASSALLWIAXXXXXXXXXXXXXXXXXXXXXXXXXXXXXXXXXXXXXXXXXXXXXXXXXXXXXXXXXXXXXXKDLGIGHVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNIYKRSGIVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFFTPPERCXXXXXXXXXXXXXXXXXXXXXXXXXXXXXXXXXXXXXXXXXXXXXXXXXXXXTLERMQRKHXXXXXXXXXXXXXXXXXXXXXXXXXXXXXXXXXXXXXXXXXXXXXXXXXXXXXXXXXXXXXXHVAVEPEVPNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPKAKRGTAQIMEMXXXXXXXXXXXXXXXXXXXXXXXXXXXXXXXXXXXXXXXXXXXXXXXXXXXXXXXXXLVHKERELHKXXXXXXXXXXXXXXXXXXXXXXXXXXXXXXXXXXXXXXXXXXXXXXXXXXXXXXXXXXXXXXXXXXXXXXXXXXXXXXISKISGGNMYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVNWVPTSRTXXXXXXXXXXXXXXXXXXXXXXXXXXXXXXXXDKTRVSSWEDVPYXXXXXXXXXXXXXXXXXXXXXXXXXXXXXXXXXXXXXXXXXXXXXXXXXXXXXXXXXXXXXXXXXXXXXXXX

SEQ ID NO: 265707 - protein, 3405 aa, Dengue virus
  MOD_RES (94)..(94): Any amino acid
  MOD_RES (106)..(109): Any amino acid
  MOD_RES (869)..(873): Any amino acid
  MOD_RES (1168)..(1172): Any amino acid
  MOD_RES (1274)..(1298): Any amino acid
  MOD_RES (1471)..(1471): Any amino acid
  MOD_RES (2064)..(2064): Any amino acid
  MOD_RES (2266)..(2272): Any amino acid
  MOD_RES (2671)..(2671): Any amino acid
  MOD_RES (3127)..(3147): Any amino acid
  MOD_RES (3388)..(3405): Any amino acid
MNNQRKKTARPSFNMLKRARNRVSTVSQLAKRFSKGLLSGQGPMKLVMAFIAFLRFLAIPPTAGILARWGSFKKNGAIKVLRGFKKEISNMLNXMNRRKRSVTMLXXXXPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDVXXXXXQGKKMIRPQPMEYKYSWKSWGKAKIIGADVQNTTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCISIMIEEVMRSRWSRKMLMTGTLAVFXXXXXGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWXXXXXXXXXXXXXXXXXXXXXXXXXLSIVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQXKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGXERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAXXXXXXXAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNXQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPXXXXXXXXXXXXXXXXXXXXXERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEXXXXXXXXXXXXXXXXXX

SEQ ID NO: 265708 - protein, 3405 aa, Dengue virus
  MOD_RES (36)..(36): Any amino acid
  MOD_RES (56)..(60): Any amino acid
  MOD_RES (94)..(94): Any amino acid
  MOD_RES (106)..(109): Any amino acid
  MOD_RES (298)..(307): Any amino acid
  MOD_RES (345)..(353): Any amino acid
  MOD_RES (422)..(425): Any amino acid
  MOD_RES (470)..(472): Any amino acid
  MOD_RES (494)..(495): Any amino acid
  MOD_RES (524)..(543): Any amino acid
  MOD_RES (563)..(565): Any amino acid
  MOD_RES (690)..(695): Any amino acid
  MOD_RES (790)..(813): Any amino acid
  MOD_RES (869)..(873): Any amino acid
  MOD_RES (963)..(971): Any amino acid
  MOD_RES (1168)..(1172): Any amino acid
  MOD_RES (1274)..(1298): Any amino acid
  MOD_RES (1375)..(1390): Any amino acid
  MOD_RES (1471)..(1478): Any amino acid
  MOD_RES (1530)..(1551): Any amino acid
  MOD_RES (1577)..(1578): Any amino acid
  MOD_RES (1605)..(1613): Any amino acid
  MOD_RES (1627)..(1635): Any amino acid
  MOD_RES (1671)..(1674): Any amino acid
  MOD_RES (1741)..(1759): Any amino acid
  MOD_RES (1779)..(1789): Any amino acid
  MOD_RES (1885)..(1932): Any amino acid
  MOD_RES (1966)..(1986): Any amino acid
  MOD_RES (2006)..(2015): Any amino acid
  MOD_RES (2035)..(2089): Any amino acid
  MOD_RES (2205)..(2230): Any amino acid
  MOD_RES (2250)..(2253): Any amino acid
  MOD_RES (2266)..(2272): Any amino acid
  MOD_RES (2304)..(2326): Any amino acid
  MOD_RES (2341)..(2345): Any amino acid
  MOD_RES (2369)..(2384): Any amino acid
  MOD_RES (2428)..(2512): Any amino acid
  MOD_RES (2557)..(2593): Any amino acid
  MOD_RES (2640)..(2658): Any amino acid
  MOD_RES (2671)..(2678): Any amino acid
  MOD_RES (2705)..(2731): Any amino acid
  MOD_RES (2791)..(2811): Any amino acid
  MOD_RES (2831)..(2850): Any amino acid
  MOD_RES (2888)..(2899): Any amino acid
  MOD_RES (2942)..(2989): Any amino acid
  MOD_RES (3091)..(3101): Any amino acid
  MOD_RES (3127)..(3147): Any amino acid
  MOD_RES (3196)..(3238): Any amino acid
  MOD_RES (3252)..(3268): Any amino acid
  MOD_RES (3293)..(3314): Any amino acid
  MOD_RES (3340)..(3346): Any amino acid
  MOD_RES (3388)..(3405): Any amino acid
MNNQRKKTGQPSFNMLKRARNRVSTGSQLAKRFSKXLLSGQGPMKMVMAFIAFLRXXXXXPTAGILARWGSFKKSGAIKVLRGFKKEISSMLNXMNRRKKSVTMLXXXXPTVLTFHLTTRGGEPHMIVTKQERGKSLLFKTSVGINMCTLIAMDLGEFCEDTMTYKCPRITETEPDDVDCWCNATETWVTYGTCSQTGEHRREKRSVALAPHVGLGLETRAETWMSSEGAWKQIQKVETWALRHPGFTVIAFFLAHVIGTSITQKGIIFILLMLATPSMAMRCVGIGNRDFVEGLSGXXXXXXXXXXGSCVTTMAKNKPTLDIELLKTEVTNPAILRKLCIEAKXXXXXXXXXCPTQGEATLMEEQDTNFVCRRTLVDRGWGNGCGLFGKGSLLTCAKFKCVTKLEGKTVQHENLKYSVIVXXXXGDQHQVGNETTEHGTIATITPQAPTSEIQLTDYGTLTLDCSPRTXXXFNEMVLLTMKKKAWLVHKQWFXXLPLPWTSGATTSQETWNRKDLLVTFKTAXXXXXXXXXXXXXXXXXXXXLTGATEIQTTGTTTIFAGHXXXRLKMDKLTLKGTSYVMCTGSFKLEKELAETQHGTVLVQVRYEGTDAPCKIPFLTQDEKGVIQNGRLVTANPIVTDKEKPVNIETEPPFGESYIVVGVGEKALKLSWFKRGSTIGKMFVATARGAXXXXXXGDTAWDFGSVGGVFTSVGKLVHQVFGAAYGVLFSGVSWTMKIGIGILLTWLGLNSRSTSLSMTCIAVGMITLYLGAMVQADSGCVVNWKGRELKXXXXXXXXXXXXXXXXXXXXXXXXPKRLSAAIGRAWEEGVCGIRSATRLENIMWRQISNELNHILLENDMKFTVVVGDAXXXXXQGKKMIRPQPMEHRYSWKIWGKAKIIGADIQNSTFIIDGPDTPECPDNQRAWNIWEVEDYGFGVFTTNIWLKLRDSYTQMCDHRLMSAAXXXXXXXXXDMGYWIESERNETWKLAKASFIEVKTCTWPKSHTLWSNGVLESEMIIPKIHGGPTSQHNYRPGYFTQAAGPWHLGKLELDFNFCEGTTVVVDEHCGYRGPSLRTTTVTGKTIHEWCCRSCTLPPLRFKGEDGCWYGMEIRPVKEKEENLVRSMVSAGLGEVDSFSLGILCVSILTEEVMRSRWSRRMLMTGTLVVFXXXXXGQLTWNDLIRSCIMVGANASDKMGMGMTYLALMATFRMRPMLAVGLLIRRLTSREVLLLTVGLSLVASVELPSSLEELGDGLAMGIMMLKLLTEFQPHQLWXXXXXXXXXXXXXXXXXXXXXXXXXLSIVSLLPLCMSTTSQKTTWLPVLLGSFGCKPLTMFLITENKIWGRRSWPLNEGIMAIGVVSILLSALLKNDVPLAXXXXXXXXXXXXXXXXGSSADLSLEKAAEVSWEQEAEHSGTSHNILVEIQDDGTMKIKDEERDDTITILLKATLLAVSGVYPMSIPATLFVWHFWQXXXXXXXXVLWDTPSPPEVGKAVLDDGIYRILQRGLLGRSQVGVGVFQDGVFHTMWHVTXXXXXXXXXXXXXXXXXXXXXXLISYGGGWRFRGSWNAGEEVQVIAVXXGKNPKNVQTTPGTFKTSEGEVGAIALXXXXXXXXXPIVNREGKVVGLYXXXXXXXXXTYVSAIAQAKTSQEGPLPEIEDEVFKKRNLTIMDLXXXXGKTRRYLPAIVREAIKRRLRTLVLAPTRVVASEMAEALKGVPIRYQTTAVKSEHTGREIVDLMCHAXXXXXXXXXXXXXXXXXXXMDEAHFTDPASIAARGYISXXXXXXXXXXXFMTATPPGSMEAFPQSNAVIQDEEKDIPERSWNSGYDWITDFPGKTVWFVPSIKAGNDIANCLRKNGKRVVQLSRKTFDTEYQKTRNNDWDYVVTXXXXXXXXXXXXXXXXXXXXXXXXXXXXXXXXXXXXXXXXXXXXXXXXQRRGRIGRNQNKEGDQYVYMGQPLKNDEDHAHWXXXXXXXXXXXXXXXXXXXXXEPEREKSAAVDGEYRLRGEXXXXXXXXXXRGDLPVWLSHKVASEGFQYXXXXXXXXXXXXXXXXXXXXXXXXXXXXXXXXXXXXXXXXXXXXXXXXXXXXXXXEFAAGRRSVSGDLISEIGKLPQHLTLKAQNALDNLVMLHNSEQGGKAYRHALEELPDTIETIMLLALIAVLTGGVTLFFLSGKGLGKTSIGLLCVTASSALLWMANVEPHWIAASXXXXXXXXXXXXXXXXXXXXXXXXXXAYVVIGLLFIILTVAANEMXXXXTTKKDLGIGYVAXXXXXXXTMLDVDLRPASAWTLYAVATTVITPMMRHTIXXXXXXXXXXXXXXXXXXXXXXXKGWPISKMDLGVPLXXXXXYSQVNPLTLIAAVLMLLAHYAIIXXXXXXXXXXXXXXXXAAGIMKNPTIDGIVTIDLDPVVYDTKFEKQLGQVMLLILCTSQXXXXXXXXXXXXXXXXXXXXXXXXXXXXXXXXXXXXXXXXXXXXXXXXXXXXXXXXXXXXXXXXXXXXXXXXXXXXXXXXXXXXXNQLSKSEFNIYKRSGIIEVDRSEAKEGLKRGETTRHAVSRGTAKXXXXXXXXXXXXXXXXXXXXXXXXXXXXXXXXXXXXXEVKGYTKGGPGHEEPVPMATYGWNLVKLYSGKDVFFTPPEKCDTLLXXXXXXXXXXXXXXXXXXXVLKMVEPWLKGNXXXXXXXXNPYMPSVVEALEQMQRKYGGMLVRNPXXXXXXXXXXXXXXXXXXXXXXXXXXXRMLLNRFTMTHRKPTYERDVDLGTGTRHVAVEPEIPNLDIIGQRIENIKNEHKSTWHYDXXXXXXXXXXXXXXXXXXXXXASSMVNGVVRLLTKPWDVIXXXXXXXXXXXXXXXXXXXXKEKVDTRTPRAKRGTTQIMEVTARWLWSFLSRNKKPRXXXXXXXXXXXXSNAAIGAVFIDENQWNSAKEAVEDDRFWDLVQKERELHKQGKXXXXXXXXXXXXXXXXXXXXXXXXXXXXXXXXXXXXXXXXXXXXXXXXDHWFSRENSFSGVEGEGLHRLGYILRDISNIPGGSMYADDTAGWDTRVTEDDLQNEARITEIMEPEHALLATAIFKLTYQNKVVRVQRPAKSGTVMDVISRXXXXXXXXXXXYGLNTFTNMEVQLIRQMESEGIFLPXXXXXXXXXXXXXXXXXXXXXERLRRMAISGDDCVVKPTDDRFATALIALNDMGKVRKDVPQWEPSKGWXXXXXXXXXXXXXXXXXXXXXXXXXXXXXXXXXXXXXXXXXXXAGWSLKETACLGKXXXXXXXXXXXXXXXXXLAANAICSAVPVDWIPTSRTTWSIXXXXXXXXXXXXXXXXXXXXXXENPWMEDKTHVSSWEEVPYLGKREDXXXXXXXGLTARATWASNIQVAINQVRRLLGNENYSDYMISMKRFKNEXXXXXXXXXXXXXXXXXX

SEQ ID NO: 265709 - protein, 3405 aa, Dengue virus
  MOD_RES (19)..(36): Any amino acid
  MOD_RES (56)..(65): Any amino acid
  MOD_RES (94)..(94): Any amino acid
  MOD_RES (106)..(109): Any amino acid
  MOD_RES (207)..(226): Any amino acid
  MOD_RES (262)..(322): Any amino acid
  MOD_RES (342)..(358): Any amino acid
  MOD_RES (378)..(387): Any amino acid
  MOD_RES (420)..(427): Any amino acid
  MOD_RES (466)..(473): Any amino acid
  MOD_RES (493)..(495): Any amino acid
  MOD_RES (517)..(550): Any amino acid
  MOD_RES (562)..(567): Any amino acid
  MOD_RES (595)..(595): Any amino acid
  MOD_RES (687)..(698): Any amino acid
  MOD_RES (729)..(731): Any amino acid
  MOD_RES (775)..(825): Any amino acid
  MOD_RES (869)..(873): Any amino acid
  MOD_RES (931)..(935): Any amino acid
  MOD_RES (963)..(978): Any amino acid
  MOD_RES (1009)..(1011): Any amino acid
  MOD_RES (1041)..(1044): Any amino acid
  MOD_RES (1078)..(1112): Any amino acid
  MOD_RES (1168)..(1172): Any amino acid
  MOD_RES (1230)..(1230): Any amino acid
  MOD_RES (1274)..(1298): Any amino acid
  MOD_RES (1315)..(1322): Any amino acid
  MOD_RES (1368)..(1391): Any amino acid
  MOD_RES (1471)..(1480): Any amino acid
  MOD_RES (1500)..(1510): Any amino acid
  MOD_RES (1529)..(1552): Any amino acid
  MOD_RES (1574)..(1578): Any amino acid
  MOD_RES (1598)..(1636): Any amino acid
  MOD_RES (1668)..(1680): Any amino acid
  MOD_RES (1702)..(1798): Any amino acid
  MOD_RES (1835)..(1932): Any amino acid
  MOD_RES (1960)..(2094): Any amino acid
  MOD_RES (2125)..(2131): Any amino acid
  MOD_RES (2145)..(2162): Any amino acid
  MOD_RES (2175)..(2175): Any amino acid
  MOD_RES (2199)..(2230): Any amino acid
  MOD_RES (2250)..(2254): Any amino acid
  MOD_RES (2266)..(2272): Any amino acid
  MOD_RES (2283)..(2349): Any amino acid
  MOD_RES (2367)..(2389): Any amino acid
  MOD_RES (2404)..(2408): Any amino acid
  MOD_RES (2419)..(2514): Any amino acid
  MOD_RES (2556)..(2597): Any amino acid
  MOD_RES (2640)..(2681): Any amino acid
  MOD_RES (2701)..(2737): Any amino acid
  MOD_RES (2776)..(2853): Any amino acid
  MOD_RES (2884)..(2918): Any amino acid
  MOD_RES (2941)..(3009): Any amino acid
  MOD_RES (3031)..(3038): Any amino acid
  MOD_RES (3090)..(3102): Any amino acid
  MOD_RES (3127)..(3155): Any amino acid
  MOD_RES (3184)..(3270): Any amino acid
  MOD_RES (3291)..(3315): Any amino acid
  MOD_RES (3339)..(3353): Any amino acid
  MOD_RES (3365)..(3365): Any amino acid
  MOD_RES (3388)..(3405): Any amino acid
MNNQRKKTGQPSFNMLKRXXXXXXXXXXXXXXXXXXLLSGQGPMKFVMAFIAFLRXXXXXXXXXXLARWSSFKKNGAIKVLRGFKKEVSNMLNXINRRKRSVTMFXXXXPTVLAFHLTTRGGEPHMVVGKQERGKSLLFKTSAGINMCTLIAMDLGELCDDTMTYKCPQITEVEPDDVDCWCNTTDTWVTYGTCTQIGEHRRDKRSXXXXXXXXXXXXXXXXXXXXSEGAWRQIQRVETWVLRHPGFTVTALFLAHVIGTSXXXXXXXXXXXXXXXXXXXXXXXXXXXXXXXXXXXXXXXXXXXXXXXXXXXXXXXXXXXXXIELLKTEVTDPAVLRKLCIXXXXXXXXXXXXXXXXXEATLVEEQDSNFVCRRTFVXXXXXXXXXXFGKGSLMTCAKFKCVTKLEGKIAQYENLKYSVXXXXXXXXQHQVGNETTDHGTTATITPQAPSSEIQLTDYGVLTLDCXXXXXXXXNEMVLLTMKEKAWLVHKQWXXXLPLPWTSGALTLQETWNRQDLXXXXXXXXXXXXXXXXXXXXXXXXXXXXXXXXXXQMSGTTTIFAGXXXXXXKMDKLTLRGMSYVMCTGLFKLEKEVAEXQHGTVLVQIRYEGTDAPCKIPFSSQDEKGATQNGRVITANPIVTDKDKPVNIEAEPPFGESYIIIGAGEKTLKLSWFKKGSSIGKMFVATAXXXXXXXXXXXXAWDFGSIGGLFTSIGKLIHQVFGAAYGVLFXXXSWTMKIGLGVLLTWLGLNSRSASFSMTCIAVGLVTLYLGAMVQXXXXXXXXXXXXXXXXXXXXXXXXXXXXXXXXXXXXXXXXXXXXXXXXXXXEEGVCGIRSTTRLENIMWKQISNELNHILLENGMKLTVVVGDVXXXXXQGRKMIRPQPMEHKYSWRSWGKAKIIGADAQNATFIIDGPNTPECPDGQRAWNIWEVXXXXXGIFTTNIWLKMRDSHTQACDHRLMSAAXXXXXXXXXXXXXXXXSEKNETWKLAGASFIEVKTCVWPKSHTLWSXXXLESEMVIPKIYGGPISQHNHRPGYFTQTAXXXXLGKLELDFDFCEGTTVVVDEHCGSRGPSLRTTTXXXXXXXXXXXXXXXXXXXXXXXXXXXXXXXXXXXVKDKEENLVKSMVSAGSGEVDNFSLGILCASIIIEEVMRSRWSKKMLMTGILAVFXXXXXGQLTWSDLTRLCIMVGANAFDNMGMGTTYLALMATFKIRPMFAVGLLFRKLTSREVLXLTIGLSLVASVELPNSLDELGDGLAIGIMMLKLLTDFQSYQLWXXXXXXXXXXXXXXXXXXXXXXXXXLSIASLIPLCLSTTSQXXXXXXXXLGSLGCKPLPMFLITETKIWGRKSWPLNEGIMAVGIVSILLSALLXXXXXXXXXXXXXXXXXXXXXXXXSSADLSLEKAAVVSWEEEAEHSGASHNILVVVQDDGTMKIKDEEKDDTLTILLKATLLAISGVYPLSIPATLFLWYFWQXXXXXXXXXXWDTPSPPEVEKAVLDDGIYXXXXXXXXXXXQVGVGVFQEGVFHTMWHVXXXXXXXXXXXXXXXXXXXXXXXXISYGGGWRLQGLWNTGEEVQVXXXXXGKNPKNVQTAPGTFKTSEGXXXXXXXXXXXXXXXXXXXXXXXXXXXXXXXXXXXXXXXYVSAIAQARASQEGPLPEIEEKVFRKRNLTIXXXXXXXXXXXXXLPAMVREAIKRKLRTLVLAPTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVEAFPQSNAIIQDEERDIPERSWNSGHEWITDFPGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRRGRIGRNQNKEGDQYIYMGQPLKNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRSISGDLILEIGKLPQHLTQKAQNALDNLXXXXXXXQGGRAYRHALEELXXXXXXXXXXXXXXXXXXGVMLFFLSGKGLXKTSIGLLCVTSSSALLWMANVEPXXXXXXXXXXXXXXXXXXXXXXXXXXXXXXXXAYVVIGLLFVILTVAANEMXXXXXTKKDLGIGHAAXXXXXXXTMLDVDLRPAXXXXXXXXXXXXXXXXXXXXXXXXXXXXXXXXXXXXXXXXXXXXXXXXXXXXXXXXXXXXXXXXXXXNPLTLTATVLMLVAHYAXXXXXXXXXXXXXXXXXXXXXXXKNPTVDGIVTIDLDXXXXXAKFEKQLGQVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSKSEFNTYKKSGIVEVDRSEAKEGLRRGEIIKHAVSRGTAXXXXXXXXXXXXXXXXXXXXXXXXXXXXXXXXXXXXXXXXXXYTKGGAGHEEPIPMATYGWNLVRLHSGKDVFFMPPEKCDTLLXXXXXXXXXXXXXXXXXXXXXXXXXXXXXXXXXXXXXXXXXXMPSVVETLEQMQRRHGGMLXXXXXXXXXXXXXXXXXXXXXXXXXXXXXXXXXXXXXFTMAHRKPTYEKDVDLGAGTRHVAVEPEEANLDIIGQRXXXXXXXXXXXXXXXXXXXXXXXXXXXXXXXXXXXXXXXXXXXXXXXXXXXXXXXXXXXXXXXXXXXXXXXXXXXXXXVDTRTPRAKRGTVQIMEMTARWLWSFLSRNXXXXXXXXXXXXXXXXXXXXXXXXXXXXXXXXXXXEAVEDERFWELVRRERELHKQGXXXXXXXXXXXXXXXXXXXXXXXXXXXXXXXXXXXXXXXXXXXXXXXXXXXXXXXXXXXXXXXXXXXXXLGYILRDISRISGGNMYADDTXXXXXXXXEDDLQNEAKITDIMEPEHALLAKAIFKLTYQNKVVRVQRPARNGTVMDVISXXXXXXXXXXXXXGLNTFTNMGAQLIRQMESEGIFFPXXXXXXXXXXXXXXXXXXXXXXXXXXXXXSGDDCVVKPVDDRFATALSALNDMGKVRXXXXXXXXXXXXXXXXXXXXXXXXXXXXXXXXXXXXXXXXXXXXXXXXXXXXXXXXXXXXXXXXXXXXXXXXXXXXXXXXXXXXXXXANAICSADPVEWVPTSRTTWXXXXXXXXXXXXXXXXXXXXXXXXXNPWMEDKTHISSWEEVPYLGKREXXXXXXXXXXXXXXXWATNVQVAINQXRRLIGNENYLDFMTSMKRFKNDXXXXXXXXXXXXXXXXXX

SEQ ID NO: 265710 - protein, 3405 aa, Dengue virus
  MOD_RES (12)..(80): Any amino acid
  MOD_RES (94)..(94): Any amino acid
  MOD_RES (106)..(109): Any amino acid
  MOD_RES (153)..(153): Any amino acid
  MOD_RES (181)..(193): Any amino acid
  MOD_RES (206)..(231): Any amino acid
  MOD_RES (256)..(327): Any amino acid
  MOD_RES (341)..(358): Any amino acid
  MOD_RES (378)..(400): Any amino acid
  MOD_RES (419)..(431): Any amino acid
  MOD_RES (461)..(473): Any amino acid
  MOD_RES (492)..(505): Any amino acid
  MOD_RES (516)..(567): Any amino acid
  MOD_RES (594)..(599): Any amino acid
  MOD_RES (687)..(705): Any amino acid
  MOD_RES (726)..(745): Any amino acid
  MOD_RES (774)..(831): Any amino acid
  MOD_RES (845)..(849): Any amino acid
  MOD_RES (869)..(873): Any amino acid
  MOD_RES (906)..(910): Any amino acid
  MOD_RES (931)..(936): Any amino acid
  MOD_RES (960)..(981): Any amino acid
  MOD_RES (993)..(1012): Any amino acid
  MOD_RES (1032)..(1134): Any amino acid
  MOD_RES (1168)..(1173): Any amino acid
  MOD_RES (1204)..(1204): Any amino acid
  MOD_RES (1226)..(1231): Any amino acid
  MOD_RES (1250)..(1259): Any amino acid
  MOD_RES (1274)..(1298): Any amino acid
  MOD_RES (1315)..(1324): Any amino acid
  MOD_RES (1366)..(1393): Any amino acid
  MOD_RES (1430)..(1447): Any amino acid
  MOD_RES (1461)..(1481): Any amino acid
  MOD_RES (1500)..(1561): Any amino acid
  MOD_RES (1572)..(1585): Any amino acid
  MOD_RES (1598)..(1637): Any amino acid
  MOD_RES (1667)..(1682): Any amino acid
  MOD_RES (1702)..(1798): Any amino acid
  MOD_RES (1809)..(1940): Any amino acid
  MOD_RES (1952)..(2094): Any amino acid
  MOD_RES (2106)..(2106): Any amino acid
  MOD_RES (2125)..(2176): Any amino acid
  MOD_RES (2199)..(2255): Any amino acid
  MOD_RES (2266)..(2272): Any amino acid
  MOD_RES (2283)..(2352): Any amino acid
  MOD_RES (2365)..(2515): Any amino acid
  MOD_RES (2535)..(2537): Any amino acid
  MOD_RES (2555)..(2599): Any amino acid
  MOD_RES (2613)..(2617): Any amino acid
  MOD_RES (2640)..(2685): Any amino acid
  MOD_RES (2701)..(2739): Any amino acid
  MOD_RES (2776)..(2856): Any amino acid
  MOD_RES (2881)..(2918): Any amino acid
  MOD_RES (2941)..(3014): Any amino acid
  MOD_RES (3029)..(3041): Any amino acid
  MOD_RES (3071)..(3071): Any amino acid
  MOD_RES (3089)..(3115): Any amino acid
  MOD_RES (3127)..(3161): Any amino acid
  MOD_RES (3181)..(3270): Any amino acid
  MOD_RES (3290)..(3319): Any amino acid
  MOD_RES (3335)..(3367): Any amino acid
  MOD_RES (3385)..(3405): Any amino acid
MINQRKKTGRPXXXXXXXXXXXXXXXXXXXXXXXXXXXXXXXXXXXXXXXXXXXXXXXXXXXXXXXXXXXXXXXXXXXXXLRGFKREISNMLNXMNRRKRSVTMIXXXXPTALTFHLTTRGGEPHMIVGKQERGKSLLFKTSTGVNMCTLIAXDLGELCEDTITYKCPRISEAEPDDVDCXXXXXXXXXXXXXCSRTGEHRRDKRXXXXXXXXXXXXXXXXXXXXXXXXXXKQIQRVETWALRHPGFTVMALFLAXXXXXXXXXXXXXXXXXXXXXXXXXXXXXXXXXXXXXXXXXXXXXXXXXXXXXXXXXXXXXXXXXXXXXXXXTEVANPAVLRKLCXXXXXXXXXXXXXXXXXXEATLVEEQDANFVCRRTLVXXXXXXXXXXXXXXXXXXXXXXXCVTKLEGKTVQHENLKYSXXXXXXXXXXXXXGNESTEHGTIATITPQAPSTEIQLTDYGVXXXXXXXXXXXXXNEMVLLTMEKKSWLVHKQXXXXXXXXXXXXXXTTQETWNRQDXXXXXXXXXXXXXXXXXXXXXXXXXXXXXXXXXXXXXXXXXXXXXXXXXXXXKMDKLTLKGISYVMCTGLFKLEKEVAXXXXXXVLVQVRYEGTDAPCKIPFSAQDGKGVTQNGRVITANPIVTDREKPVNIEAEPPFGESYIIIGAGEKALKLSWFRKGSNIGKMFEATAXXXXXXXXXXXXXXXXXXXGGVFTSAGKLVHQVFGAAYGXXXXXXXXXXXXXXXXXXXXLGLNSRNTSLSVMCIVVGLVTLYLGAMVXXXXXXXXXXXXXXXXXXXXXXXXXXXXXXXXXXXXXXXXXXXXXXXXXXXXXXXXXXIRSVTRLENIMWKXXXXXLNYILLENDIKFTVVVGNAXXXXXQGKKTIRPQPMEYKYSWKSWGKAKIIGADTQNXXXXXDGPDTPECPDEQRAWNIWEVXXXXXXIFTTNIWLRLRDSYTQACDHRLMXXXXXXXXXXXXXXXXXXXXXXNEPWKLARASFXXXXXXXXXXXXXXXXXXXXESEMIIPKMYGGPISQHNHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSLGLLCTSIMTEEVMRSRWSRKMLMTGTLAVLXXXXXXQLTWNDLTRLCIMVGANASDRMGMGMTYLAXMATFKIRPMFAVGLLLRRLTSXXXXXXTIGLSLMAFVELPNSLEEXXXXXXXXXXMLKLLTDFQPHQLWXXXXXXXXXXXXXXXXXXXXXXXXXLSVVSLFPLCMSTTSQXXXXXXXXXXSLGCKPLAMFLIAENEIWGRKSWPINEGIMAVGIVSILLSAXXXXXXXXXXXXXXXXXXXXXXXXXXXXADLLLDKAAKVSWEQEAEHSGASHNILVEVQDDGPMXXXXXXXXXXXXXXXXXXLLAVSGMYPLSIPXXXXXXXXXXXXXXXXXXXXXDTPSPPKVERAVLDNGIYXXXXXXXXXXXXXXXXXXXXXXXXXXXXXXXXXXXXXXXXXXXXXXXXXXXXXXXXXXXXXXQGLWNTGEEVXXXXXXXXXXXXXXQTMPGTFKTPEGXXXXXXXXXXXXXXXXXXXXXXXXXXXXXXXXXXXXXXXXVSAIAQTKASQEGPLPEIENEVFRKRNLTXXXXXXXXXXXXXXXXAIVREAIKRRLRTLVLAPTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEAFPQSNAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNHNKEGDQYVYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRSVSSDLILEXGKLPQHLTLKAQNALDNLXXXXXXXXXXXXXXXXXXXXXXXXXXXXXXXXXXXXXXXXXXXXXXXXXXXXTSIGLLCVIASSVLLWIASVEPXXXXXXXXXXXXXXXXXXXXXXXXXXXXXXXXXXXXXXXXXXXXXXXXXXXXXXXXXKKDLGIGHAVXXXXXXXTMLDIDLHPAXXXXXXXXXXXXXXXXXXXXXXXXXXXXXXXXXXXXXXXXXXXXXXXXXXXXXXXXXXXXXXXXXXXXXXTLTATVLMLVAHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSKPEFNTYKRSGIVEVDRSXXXEGLKRGETIKHAVSRGTXXXXXXXXXXXXXXXXXXXXXXXXXXXXXXXXXXXXXXXXXXXXXKGGLGHEEPIPMAXXXXXLVKLHSGKDVFFVPPEKCDTLLXXXXXXXXXXXXXXXXXXXXXXXXXXXXXXXXXXXXXXXXXXXXXXVETLEHMQRKHGGMLXXXXXXXXXXXXXXXXXXXXXXXXXXXXXXXXXXXXXXXMAHRKPTFERDVDLGAGTRHVTVEPEVANIDIIGQRXXXXXXXXXXXXXXXXXXXXXXXXXXXXXXXXXXXXXXXXXXXXXXXXXXXXXXXXXXXXXXXXXXXXXXXXXXXXXXXXXRTPKAKQGTAQIMEVTARWLWSFLXXXXXXXXXXXXXXXXXXXXXXXXXXXXXXXXXXXXXXEAVEDERFWNLVKKERELHKQGXXXXXXXXXXXXXXXXXXXXXXXXXXXXXXXXXXXXXXXXXXXXXXXXXXXXXXXXXXXXXXXXXXXXXXXXXXRDISKISGGNMYADXXXXXXXXXXXXXLRNEARITDTMEPEHALLARSIFKLTYQNXVVRVQRPTKNGTVMDVIXXXXXXXXXXXXXXXXXXXXXXXXXXXRQMESEEIFSPXXXXXXXXXXXXXXXXXXXXXXXXXXXXXXXXXXXVKPIDDRFAAALTALNDMGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANANCSAVPVNWVPTSRTTXXXXXXXXXXXXXXXXXXXXXXXXXXXXXXEDKTHVSSWGDVPYLXXXXXXXXXXXXXXXXXXXXXXXXXXXXXXXXXLIGNENYLDYMISMKRFXXXXXXXXXXXXXXXXXXXXX

SEQ ID NO: 265711 - protein, 3405 aa, Dengue virus
  MOD_RES (1)..(94): Any amino acid
  MOD_RES (106)..(109): Any amino acid
  MOD_RES (121)..(141): Any amino acid
  MOD_RES (152)..(163): Any amino acid
  MOD_RES (179)..(194): Any amino acid
  MOD_RES (205)..(242): Any amino acid
  MOD_RES (256)..(402): Any amino acid
  MOD_RES (419)..(431): Any amino acid
  MOD_RES (445)..(475): Any amino acid
  MOD_RES (486)..(505): Any amino acid
  MOD_RES (516)..(567): Any amino acid
  MOD_RES (585)..(612): Any amino acid
  MOD_RES (635)..(636): Any amino acid
  MOD_RES (647)..(650): Any amino acid
  MOD_RES (670)..(705): Any amino acid
  MOD_RES (726)..(751): Any amino acid
  MOD_RES (768)..(851): Any amino acid
  MOD_RES (869)..(877): Any amino acid
  MOD_RES (896)..(910): Any amino acid
  MOD_RES (929)..(946): Any amino acid
  MOD_RES (960)..(1018): Any amino acid
  MOD_RES (1031)..(1134): Any amino acid
  MOD_RES (1145)..(1153): Any amino acid
  MOD_RES (1168)..(1173): Any amino acid
  MOD_RES (1204)..(1212): Any amino acid
  MOD_RES (1224)..(1239): Any amino acid
  MOD_RES (1250)..(1259): Any amino acid
  MOD_RES (1270)..(1298): Any amino acid
  MOD_RES (1312)..(1325): Any amino acid
  MOD_RES (1339)..(1393): Any amino acid
  MOD_RES (1425)..(1447): Any amino acid
  MOD_RES (1460)..(1481): Any amino acid
  MOD_RES (1496)..(1682): Any amino acid
  MOD_RES (1699)..(1940): Any amino acid
  MOD_RES (1951)..(2176): Any amino acid
  MOD_RES (2189)..(2255): Any amino acid
  MOD_RES (2266)..(2519): Any amino acid
  MOD_RES (2532)..(2625): Any amino acid
  MOD_RES (2637)..(2686): Any amino acid
  MOD_RES (2698)..(2757): Any amino acid
  MOD_RES (2772)..(2856): Any amino acid
  MOD_RES (2873)..(2928): Any amino acid
  MOD_RES (2940)..(3015): Any amino acid
  MOD_RES (3029)..(3045): Any amino acid
  MOD_RES (3056)..(3278): Any amino acid
  MOD_RES (3290)..(3319): Any amino acid
  MOD_RES (3335)..(3405): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMNRRKRSVTTLXXXXPTTLAFHLTTRXXXXXXXXXXXXXXXXXXXXXSAGVNMCTLVXXXXXXXXXXXXTYKCPRISEAEPDDVXXXXXXXXXXXXXXXXSQTGGHRREKXXXXXXXXXXXXXXXXXXXXXXXXXXXXXXXXXXXXXXRHPGFTMIALFLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKLEGKIVQHENLKYSXXXXXXXXXXXXXGNETTDHGTTATIXXXXXXXXXXXXXXXXXXXXXXXXXXXXXXXMVLLTMKGKSXXXXXXXXXXXXXXXXXXXXASQETWNRKDXXXXXXXXXXXXXXXXXXXXXXXXXXXXXXXXXXXXXXXXXXXXXXXXXXXXKMDKLTLKGVSYVMCTGXXXXXXXXXXXXXXXXXXXXXXXXXXXXCKIPFSTQDERGVTQNGRVITAXXTVTDKEKPVNXXXXPPFGESYITIGAGEEALKLXXXXXXXXXXXXXXXXXXXXXXXXXXXXXXXXXXXXGGVFTSMGKLIHQVFGTAYGXXXXXXXXXXXXXXXXXXXXXXXXXXSTSLSMTCIVVGMVTLXXXXXXXXXXXXXXXXXXXXXXXXXXXXXXXXXXXXXXXXXXXXXXXXXXXXXXXXXXXXXXXXXXXXXXXXXXXXXXXXXXXXHILLENDMKLTVVVGDAXXXXXXXXXMVRPQPMEYKYSWKIWGKXXXXXXXXXXXXXXXDGPNTSECSDDQRAWNIWXXXXXXXXXXXXXXXXXXRDSHTQMCDHRLMXXXXXXXXXXXXXXXXXXXXXXXXXXXXXXXXXXXXXXXXXXXXXXXXXXXXXXXXXXXPKIYGGPMSQHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSLGLLCVSIXXXXXXXXXWSRKMLMAGTLAVFXXXXXXQLTWKDLIRLCIMVGANVSDRMGMGTTHLAXXXXXXXXXMFAVGLLLRRLXXXXXXXXXXXXXXXXSAELPNSLEEXXXXXXXXXXILKLLTDFQPXXXXXXXXXXXXXXXXXXXXXXXXXXXXXLSIVSLFPLCMSTXXXXXXXXXXXXXXLGCKPLTMFLIVEXXXXXXXXXXXXXXXXXXXXXXXXXXXXXXXXXXXXXXXXXXXXXXXXXXXXXXXADLSLEKTAEVSWEKEAEHSGASHNIFVEVQXXXXXXXXXXXXXXXXXXXXXXXLLAISGVYPLSIXXXXXXXXXXXXXXXXXXXXXXDTPSPPVVERAVLDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIIREAIKRKMRTLILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNYNKEGDQYIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSIGLLCVMSSSXXXXXXXXXXXXXXXXXXXXXXXXXXXXXXXXXXXXXXXXXXXXXXXXXXXXXXXXXXXXXXXXXXXKKDLGIGHVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFNIYKRSGIVEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDVFFTPPERCDXXXXXXXXXXXXXXXXXXXXXXXXXXXXXXXXXXXXXXXXXXXXXXXXXXETLEHMQRKHGXXXXXXXXXXXXXXXXXXXXXXXXXXXXXXXXXXXXXXXXXXXXXXXXXXXXXXXXXXXXRHVAVEPEVPNLDIXXXXXXXXXXXXXXXXXXXXXXXXXXXXXXXXXXXXXXXXXXXXXXXXXXXXXXXXXXXXXXXXXXXXXXXXXXXXXXXXXXXXXRTPKPKRGTAQIMEMTXXXXXXXXXXXXXXXXXXXXXXXXXXXXXXXXXXXXXXXXXXXXXXXXXXXXXXXXLVHKERELHKQXXXXXXXXXXXXXXXXXXXXXXXXXXXXXXXXXXXXXXXXXXXXXXXXXXXXXXXXXXXXXXXXXXXXXXXXXXXXDISKIPGGSMYADXXXXXXXXXXXXXXXXXAKITDIMKPEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPIDWVPTSRTTXXXXXXXXXXXXXXXXXXXXXXXXXXXXXXEDKTRVSSWEDVPYLXXXXXXXXXXXXXXXXXXXXXXXXXXXXXXXXXXXXXXXXXXXXXXXXXXXXXXXXXXXXXXXXXXXXXXX

SEQ ID NO: 265712 - protein, 3405 aa, Dengue virus
  MOD_RES (94)..(109): Any amino acid
  MOD_RES (712)..(712): Any amino acid
  MOD_RES (868)..(873): Any amino acid
  MOD_RES (906)..(906): Any amino acid
  MOD_RES (1142)..(1142): Any amino acid
  MOD_RES (1165)..(1172): Any amino acid
  MOD_RES (1274)..(1301): Any amino acid
  MOD_RES (1471)..(1471): Any amino acid
  MOD_RES (2064)..(2064): Any amino acid
  MOD_RES (2266)..(2272): Any amino acid
  MOD_RES (2671)..(2671): Any amino acid
  MOD_RES (3127)..(3147): Any amino acid
  MOD_RES (3388)..(3405): Any amino acid
MNNQRKKTARPSFNMLKRARNRVSTVSQLAKRFSKGLLSGQGPMKLVMAFIAFLRFLAIPPTAGILARWGSFKKNGAIKVLRGFKKEISNMLNXXXXXXXXXXXXXXXXPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSXGKLVHQIFGTAYGVLFSGVSWTMKIGIGVLLTWLGLNSRSTSLSMTCIAVGLVTLYLGVMVQADSGCVINWKGRELKCGSGIFVTNEVHTWTEQYKFQADSPKRLSAAIGKAWEEGVCGIRSATRLENIMWKQISNELNHILLENDMKFTVVVGDXXXXXXQGKKMIRPQPMEYKYSWKSWGKAKIIGADVQNXTFIIDGPNTPECPDDQRAWNIWEVEDYGFGIFTTNIWLKLRDSYTQVCDHRLMSAAIKDSKAVHADMGYWIESEKNETWKLARASFIEVKTCIWPKSHTLWSNGVLESEMIIPKIYGGPISQHNYRPGYFTQTAGPWHLGKLELDFDLCEGTTVVVDEHCGNRGPSLRTTTVTGKIIHEWCCRSCTLPPLRFRGEDGCWYGMEIRPVKEKEENLVKSMVSAGSGEVDSFSLGLLCXSIMIEEVMRSRWSRKMLMTGTLXXXXXXXXGQLTWNDLIRLCIMVGANASDRMGMGTTYLALMATFKMRPMFAVGLLFRRLTSREVLLLTIGLSLVASVELPNSLEELGDGLAMGIMILKLLTDFQSHQLWXXXXXXXXXXXXXXXXXXXXXXXXXXXXVSLFPLCLSTTSQKTTWLPVLLGSLGCKPLTMFLIAENKIWGRKSWPLNEGIMAVGIVSILLSSLLKNDVPLAGPLIAGGMLIACYVISGSSADLSLEKAAEVSWEEEAEHSGASHNILVEVQDDGTMKIKDEERDDTLTILLKATLLAVSGVYPLSIPATLFVWYFWQXKKKQRSGVLWDTPSPPEVERAVLDDGIYRIMQRGLLGRSQVGVGVFQENVFHTMWHVTRGAVLMYQGKRLEPSWASVKKDLISYGGGWRLQGSWNTGEEVQVIAVEPGKNPKNVQTAPGTFKTPEGEVGAIALDFKPGTSGSPIVNREGKIVGLYGNGVVTTSGTYVSAIAQAKASQEGPLPEIEDEVFRKRNLTIMDLHPGSGKTRRYLPAIVREAIKRKLRTLILAPTRVVASEMAEALKGMPIRYQTTAVKSEHTGKEIVDLMCHATFTMRLLSPVRVPNYNMIIMDEAHFTDPSSIAARGYISTRVGMGEAAAIFMTATPPGSVEAFPQSNAVIQDEERDIPERSWNSGYEWITDFPGKTVWFVPSIKSGNDIANCLRKNGKRVIQLSRKTFDTEYQKTKNNDWDYVVTTDISEMGANFRADRVIDPRRCLKPVILKDGPERVILAGPMPVTVASAAQRRGRIGRNHNKEGDQYIYMGQPLNNDEDHAHWTEAKMLLDNINTPEGIIPALFEPEREKSAAIDGEYRLRGEARKTFVELMRRGDLPVWLSYKVASEGFQYSDRRWCFDGERNNQVLEENMDVEIWTKEGXERKKLRPRWLDARTYSDPLALREFKEFAAGRRSVSGDLILEIGKLPQHLTQRAQNALDNLVMLHNSEQGGRAYRHAMEELPDTIETLMLLALIAVLTGGVTLFFLSGRGLGKTSIGLLCVMASSVLLWMASVEPHWIAASIILEFFLMVLLIPEPDRQRTPQDNQLAYVVIGLLFMILTVAANEMGLLETTKKDLGIGHVAXXXXXXXAMLDVDLHPASAWTLYAVATTIITPMMRHTIENTTANISLTAIANQAAILMGLDKGWPISKMDIGVPLLALGCYSQVNPLTLTAAVLMLVAHYAIIGPGLQAKATREAQKRTAAGIMKNPTVDGIVAIDLDPVVYDAKFEKQLGQIMLLILCTSQILLMRTTWALCESITLATGPLTTLWEGSPGKFWNTTIAVSMANIFRGSYLAGAGLAFSLMKSLGGGRRGTGAQGETLGEKWKRQLNQLSKSEFNTYKRSGIMEVDRSEAKEGLKRGETTKHAVSRGTAKLRWFVERNLVKPEGKVIDLGCGRGGWSYYCAGLKKVTEVKGYTKGGPGHEEPIPMATYGWNLVKLHSGKDVFFIPPEKCDTLLCDIGESSPNPTIEEGRTLRVLKMVEPWLRGNXQFCIKILNPYMPSVVETLEQMQRKHGGMLVRNPLSRNSTHEMYWVSCGTGNIVSAVNMTSRMLLNRFTMAHRKPTYERDVDLGAGTRHVAVEPEVANLDIIGQRIENIKHEHKSTWHYDEDNPYKTWAYHGSYEVKPSGSASSMVNGVVKLLTKPWDVIPMVTQIAMTDTTPFGQQRVFKEKVDTRTPKAKRGTAQIMEVTAKWLWGFLSRNKKPRICTREEFTRKVRSNAAIGAVFVDENQWNSAKEAVEDERFWDLVHRERELHKQGKCATCVYNMMGKREKKLGEFGKAKGSRAIWYMWLGARFLEFEALGFMNEDHWFSRENSLSGVEGEGLHKLGYILRDISKIPGGNMYADDTAGWDTRITEDDLQNEAKITDIMEPEHALLAKSIFKLTYQNKVVRVQRPAKNGTVMDVISRRDQRGSGQVGTYGLNTFTNMEAQLIRQMESEGIFSPXXXXXXXXXXXXXXXXXXXXXERLKRMAISGDDCVVKPIDDRFATALTALNDMGKVRKDIPQWEPSKGWNDWQQVPFCSHHFHQLIMKDGREIVVPCRNQDELVGRARVSQGAGWSLRETACLGKSYAQMWQLMYFHRRDLRLAANAICSAVPVDWVPTSRTTWSIHAHHQWMTTEDMLSVWNRVWIEENPWMEDKTHISSWGDVPYLGKREDQWCGSLIGLTARATWATNIQVAINQVRRLIGNENYLDYMTSMKRFKNEXXXXXXXXXXXXXXXXXX

SEQ ID NO: 265713 - protein, 3405 aa, Dengue virus
  MOD_RES (57)..(59): Any amino acid
  MOD_RES (94)..(109): Any amino acid
  MOD_RES (299)..(306): Any amino acid
  MOD_RES (346)..(352): Any amino acid
  MOD_RES (423)..(424): Any amino acid
  MOD_RES (471)..(471): Any amino acid
  MOD_RES (525)..(542): Any amino acid
  MOD_RES (564)..(564): Any amino acid
  MOD_RES (693)..(694): Any amino acid
  MOD_RES (712)..(712): Any amino acid
  MOD_RES (791)..(812): Any amino acid
  MOD_RES (868)..(873): Any amino acid
  MOD_RES (906)..(906): Any amino acid
  MOD_RES (964)..(970): Any amino acid
  MOD_RES (1142)..(1142): Any amino acid
  MOD_RES (1165)..(1172): Any amino acid
  MOD_RES (1274)..(1301): Any amino acid
  MOD_RES (1376)..(1388): Any amino acid
  MOD_RES (1471)..(1477): Any amino acid
  MOD_RES (1531)..(1550): Any amino acid
  MOD_RES (1606)..(1612): Any amino acid
  MOD_RES (1628)..(1633): Any amino acid
  MOD_RES (1672)..(1673): Any amino acid
  MOD_RES (1742)..(1758): Any amino acid
  MOD_RES (1780)..(1788): Any amino acid
  MOD_RES (1886)..(1931): Any amino acid
  MOD_RES (1967)..(1985): Any amino acid
  MOD_RES (2007)..(2014): Any amino acid
  MOD_RES (2036)..(2087): Any amino acid
  MOD_RES (2206)..(2229): Any amino acid
  MOD_RES (2251)..(2252): Any amino acid
  MOD_RES (2266)..(2272): Any amino acid
  MOD_RES (2305)..(2325): Any amino acid
  MOD_RES (2344)..(2344): Any amino acid
  MOD_RES (2370)..(2383): Any amino acid
  MOD_RES (2429)..(2511): Any amino acid
  MOD_RES (2558)..(2592): Any amino acid
  MOD_RES (2641)..(2657): Any amino acid
  MOD_RES (2671)..(2677): Any amino acid
  MOD_RES (2706)..(2730): Any amino acid
  MOD_RES (2792)..(2810): Any amino acid
  MOD_RES (2832)..(2849): Any amino acid
  MOD_RES (2889)..(2898): Any amino acid
  MOD_RES (2943)..(2988): Any amino acid
  MOD_RES (3092)..(3100): Any amino acid
  MOD_RES (3127)..(3147): Any amino acid
  MOD_RES (3197)..(3234): Any amino acid
  MOD_RES (3253)..(3267): Any amino acid
  MOD_RES (3294)..(3313): Any amino acid
  MOD_RES (3341)..(3345): Any amino acid
  MOD_RES (3388)..(3405): Any amino acid
MNNQRKKTGQPSFNMLKRARNRVSTGSQLAKRFSKGLLSGQGPMKMVMAFIAFLRFXXXPPTAGILARWGSFKKSGAIKVLRGFKKEISSMLNXXXXXXXXXXXXXXXXPTVLTFHLTTRGGEPHMIVTKQERGKSLLFKTSVGINMCTLIAMDLGEFCEDTMTYKCPRITETEPDDVDCWCNATETWVTYGTCSQTGEHRREKRSVALAPHVGLGLETRAETWMSSEGAWKQIQKVETWALRHPGFTVIAFFLAHVIGTSITQKGIIFILLMLATPSMAMRCVGIGNRDFVEGLSGAXXXXXXXXHGSCVTTMAKNKPTLDIELLKTEVTNPAILRKLCIEAKIXXXXXXXRCPTQGEATLMEEQDTNFVCRRTLVDRGWGNGCGLFGKGSLLTCAKFKCVTKLEGKTVQHENLKYSVIVTXXTGDQHQVGNETTEHGTIATITPQAPTSEIQLTDYGTLTLDCSPRTGXDFNEMVLLTMKKKAWLVHKQWFLDLPLPWTSGATTSQETWNRKDLLVTFKTAHXXXXXXXXXXXXXXXXXXALTGATEIQTTGTTTIFAGHLXCRLKMDKLTLKGTSYVMCTGSFKLEKELAETQHGTVLVQVRYEGTDAPCKIPFLTQDEKGVIQNGRLVTANPIVTDKEKPVNIETEPPFGESYIVVGVGEKALKLSWFKRGSTIGKMFVATARGARRMXXLGDTAWDFGSVGGVFTSXGKLVHQVFGAAYGVLFSGVSWTMKIGIGILLTWLGLNSRSTSLSMTCIAVGMITLYLGVMVQADSGCVVNWKGRELKCXXXXXXXXXXXXXXXXXXXXXXSPKRLSAAIGRAWEEGVCGIRSATRLENIMWRQISNELNHILLENDMKLTVVVGDXXXXXXQGKKMIRPQPMEHRYSWKIWGKAKIIGADIQNXTFIIDGPDTPECPDNQRAWNIWEVEDYGFGVFTTNIWLKLRDSYTQMCDHRLMSAAIXXXXXXXADMGYWIESERNETWKLARASFIEVKTCTWPKSHTLWSNGVLESEMIIPKIHGGPTSQHNYRPGYFTQAAGPWHLGKLELDFNFCEGTTVVVDEHCGSRGPSLRTTTVTGKTIHEWCCRSCTLPPLRFKGEDGCWYGMEIRPVKEKEENLVRSMVSAGSGEVDSFSLGILCXSILIEEVMRSRWSRRMLMTGTLXXXXXXXXGQLTWNDLIRSCIMVGANASDKMGMGTTYLALMATFRMRPMLAVGLLIRRLTSREVLLLTVGLSLVASVELPSSLEELGDGLAMGIMMLKLLTEFQPHQLWXXXXXXXXXXXXXXXXXXXXXXXXXXXXVSLLPLCMSTTSQKTTWLPVLLGSFGCKPLTMFLITENKIWGRRSWPLNEGIMAIGVVSILLSALLKNDVPLAGXXXXXXXXXXXXXISGSSADLSLEKAAEVSWEQEAEHSGTSHNILVEIQDDGTMKIKDEERDDTITILLKATLLAVSGVYPMSIPATLFVWHFWQXXXXXXXGVLWDTPSPPEVGKAVLDDGIYRILQRGLLGRSQVGVGVFQDGVFHTMWHVTRXXXXXXXXXXXXXXXXXXXXDLISYGGGWRFRGSWNAGEEVQVIAVEPGKNPKNVQTTPGTFKTSEGEVGAIALDXXXXXXXSPIVNREGKVVGLYGXXXXXXSGTYVSAIAQAKTSQEGPLPEIEDEVFKKRNLTIMDLHXXSGKTRRYLPAIVREAIKRRLRTLVLAPTRVVASEMAEALKGVPIRYQTTAVKSEHTGREIVDLMCHATXXXXXXXXXXXXXXXXXIMDEAHFTDPASIAARGYISTXXXXXXXXXIFMTATPPGSMEAFPQSNAVIQDEEKDIPERSWNSGYDWITDFPGKTVWFVPSIKAGNDIANCLRKNGKRVVQLSRKTFDTEYQKTRNNDWDYVVTTXXXXXXXXXXXXXXXXXXXXXXXXXXXXXXXXXXXXXXXXXXXXXXAQRRGRIGRNQNKEGDQYVYMGQPLKNDEDHAHWTXXXXXXXXXXXXXXXXXXXFEPEREKSAAVDGEYRLRGEAXXXXXXXXRRGDLPVWLSHKVASEGFQYSXXXXXXXXXXXXXXXXXXXXXXXXXXXXXXXXXXXXXXXXXXXXXXXXXXXXFKEFAAGRRSVSGDLISEIGKLPQHLTLKAQNALDNLVMLHNSEQGGKAYRHAMEELPDTIETIMLLALIAVLTGGVTLFFLSGKGLGKTSIGLLCVTASSALLWMANVEPHWIAASIXXXXXXXXXXXXXXXXXXXXXXXXLAYVVIGLLFIILTVAANEMGXXETTKKDLGIGYVAXXXXXXXTMLDVDLRPASAWTLYAVATTVITPMMRHTIEXXXXXXXXXXXXXXXXXXXXXDKGWPISKMDLGVPLLALXCYSQVNPLTLIAAVLMLLAHYAIIGXXXXXXXXXXXXXXTAAGIMKNPTIDGIVAIDLDPVVYDTKFEKQLGQVMLLILCTSQIXXXXXXXXXXXXXXXXXXXXXXXXXXXXXXXXXXXXXXXXXXXXXXXXXXXXXXXXXXXXXXXXXXXXXXXXXXXXXXXXXXXLNQLSKSEFNIYKRSGIIEVDRSEAKEGLKRGETTRHAVSRGTAKLXXXXXXXXXXXXXXXXXXXXXXXXXXXXXXXXXXXTEVKGYTKGGPGHEEPVPMATYGWNLVKLYSGKDVFFTPPEKCDTLLCXXXXXXXXXXXXXXXXXRVLKMVEPWLKGNXXXXXXXLNPYMPSVVEALEQMQRKYGGMLVRNPLXXXXXXXXXXXXXXXXXXXXXXXXXSRMLLNRFTMTHRKPTYERDVDLGTGTRHVAVEPEIANIDIIGQRIENIKNEHKSTWHYDEXXXXXXXXXXXXXXXXXXXSASSMVNGVVRLLTKPWDVIPXXXXXXXXXXXXXXXXXXFKEKVDTRTPRAKRGTTQIMEVTARWLWSFLSRNKKPRIXXXXXXXXXXRSNAAIGAVFIDENQWNSAKEAVEDDRFWDLVQKERELHKQGKCXXXXXXXXXXXXXXXXXXXXXXXXXXXXXXXXXXXXXXXXXXXXXXEDHWFSRENSFSGVEGEGLHKLGYILRDISNIPGGSMYADDTAGWDTRITEDDLQNEARITEIMEPEHALLATAIFKLTYQNKVVRVQRPAKSGTVMDVISRRXXXXXXXXXTYGLNTFTNMEVQLIRQMESEGIFLPXXXXXXXXXXXXXXXXXXXXXERLRRMAISGDDCVVKPTDDRFATALIALNDMGKVRKDVPQWEPSKGWNXXXXXXXXXXXXXXXXXXXXXXXXXXXXXXXXXXXXXXVSQGAGWSLKETACLGKSXXXXXXXXXXXXXXXRLAANAICSAVPVDWIPTSRTTWSIHXXXXXXXXXXXXXXXXXXXXEENPWMEDKTHVSSWEEVPYLGKREDQXXXXXIGLTARATWASNIQVAINQVRRLLGNENYSDYMISMKRFKNEXXXXXXXXXXXXXXXXXX

SEQ ID NO: 265714 - protein, 3405 aa, Dengue virus
  MOD_RES (20)..(35): Any amino acid
  MOD_RES (57)..(64): Any amino acid
  MOD_RES (94)..(109): Any amino acid
  MOD_RES (208)..(225): Any amino acid
  MOD_RES (263)..(321): Any amino acid
  MOD_RES (343)..(357): Any amino acid
  MOD_RES (379)..(386): Any amino acid
  MOD_RES (421)..(426): Any amino acid
  MOD_RES (467)..(472): Any amino acid
  MOD_RES (494)..(494): Any amino acid
  MOD_RES (518)..(549): Any amino acid
  MOD_RES (563)..(566): Any amino acid
  MOD_RES (688)..(697): Any amino acid
  MOD_RES (712)..(712): Any amino acid
  MOD_RES (730)..(730): Any amino acid
  MOD_RES (782)..(824): Any amino acid
  MOD_RES (868)..(873): Any amino acid
  MOD_RES (906)..(908): Any amino acid
  MOD_RES (932)..(934): Any amino acid
  MOD_RES (964)..(977): Any amino acid
  MOD_RES (1010)..(1010): Any amino acid
  MOD_RES (1042)..(1043): Any amino acid
  MOD_RES (1079)..(1111): Any amino acid
  MOD_RES (1142)..(1142): Any amino acid
  MOD_RES (1165)..(1172): Any amino acid
  MOD_RES (1274)..(1301): Any amino acid
  MOD_RES (1316)..(1321): Any amino acid
  MOD_RES (1369)..(1390): Any amino acid
  MOD_RES (1471)..(1479): Any amino acid
  MOD_RES (1501)..(1509): Any amino acid
  MOD_RES (1530)..(1551): Any amino acid
  MOD_RES (1575)..(1577): Any amino acid
  MOD_RES (1599)..(1635): Any amino acid
  MOD_RES (1669)..(1679): Any amino acid
  MOD_RES (1703)..(1797): Any amino acid
  MOD_RES (1836)..(1931): Any amino acid
  MOD_RES (1961)..(2093): Any amino acid
  MOD_RES (2126)..(2130): Any amino acid
  MOD_RES (2152)..(2161): Any amino acid
  MOD_RES (2200)..(2229): Any amino acid
  MOD_RES (2251)..(2253): Any amino acid
  MOD_RES (2266)..(2272): Any amino acid
  MOD_RES (2284)..(2348): Any amino acid
  MOD_RES (2368)..(2388): Any amino acid
  MOD_RES (2420)..(2513): Any amino acid
  MOD_RES (2557)..(2596): Any amino acid
  MOD_RES (2641)..(2680): Any amino acid
  MOD_RES (2702)..(2736): Any amino acid
  MOD_RES (2777)..(2852): Any amino acid
  MOD_RES (2885)..(2917): Any amino acid
  MOD_RES (2942)..(2998): Any amino acid
  MOD_RES (3032)..(3036): Any amino acid
  MOD_RES (3091)..(3101): Any amino acid
  MOD_RES (3127)..(3154): Any amino acid
  MOD_RES (3185)..(3269): Any amino acid
  MOD_RES (3292)..(3314): Any amino acid
  MOD_RES (3340)..(3352): Any amino acid
  MOD_RES (3388)..(3405): Any amino acid
MNNQRKKTGQPSFNMLKRAXXXXXXXXXXXXXXXXGLLSGQGPMKFVMAFIAFLRFXXXXXXXXILARWSSFKKNGAIKVLRGFKKEVSNMLNXXXXXXXXXXXXXXXXPTVLAFHLTTRGGEPHMVVGKQERGKSLLFKTSAGINMCTLIAMDLGELCDDTMTYKCPQITEVEPDDVDCWCNTTDTWVTYGTCTQIGEHRRDKRSVXXXXXXXXXXXXXXXXXXSSEGAWRQIQRVETWVLRHPGFTVTALFLAHVIGTSIXXXXXXXXXXXXXXXXXXXXXXXXXXXXXXXXXXXXXXXXXXXXXXXXXXXXXXXXXXXDIELLKTEVTDPAVLRKLCIEXXXXXXXXXXXXXXXGEATLVEEQDSNFVCRRTFVDXXXXXXXXLFGKGSLMTCAKFKCVTKLEGKIAQYENLKYSVIXXXXXXDQHQVGNETTDHGTTATITPQAPSSEIQLTDYGVLTLDCSXXXXXXFNEMVLLTMKEKAWLVHKQWFXDLPLPWTSGALTLQETWNRQDLLXXXXXXXXXXXXXXXXXXXXXXXXXXXXXXXXIQMSGTTTIFAGHXXXXLKMDKLTLRGMSYVMCTGLFKLEKEVAETQHGTVLVQIRYEGTDAPCKIPFSSQDEKGATQNGRVITANPIVTDKDKPVNIEAEPPFGESYIIIGAGEKTLKLSWFKKGSSIGKMFVATARXXXXXXXXXXTAWDFGSIGGLFTSXGKLIHQVFGAAYGVLFSXVSWTMKIGLGVLLTWLGLNSRSASFSMTCIAVGLVTLYLGAMVQADSGCVIXXXXXXXXXXXXXXXXXXXXXXXXXXXXXXXXXXXXXXXXXXXWEEGVCGIRSTTRLENIMWKQISNELNHILLENGMKFTVVVGDXXXXXXQGKKMIRPQPMEHKYSWRSWGKAKIIGADAQNXXXIIDGPNTPECPDGQRAWNIWEVEXXXFGIFTTNIWLKMRDSHTQACDHRLMSAAIXXXXXXXXXXXXXXESEKNETWKLARASFIEVKTCVWPKSHTLWSNXVLESEMVIPKIYGGPISQHNHRPGYFTQTAGXXHLGKLELDFDFCEGTTVVVDEHCGYRGPSLRTTTVXXXXXXXXXXXXXXXXXXXXXXXXXXXXXXXXXPVKDKEENLVKSMVSAGLGEVDNFSLGILCXSIITEEVMRSRWSKKMLMTGTLXXXXXXXXGQLTWSDLTRLCIMVGANAFDNMGMGMTYLALMATFKMRPMFAVGLLFRKLTSREVLLLTIGLSLVASVELPNSLDELGDGLAMGIMMLKLLTDFQSYQLWXXXXXXXXXXXXXXXXXXXXXXXXXXXXASLIPLCLSTTSQKXXXXXXLLGSLGCKPLPMFLITETKIWGRKSWPLNEGIMAVGIVSILLSALLKXXXXXXXXXXXXXXXXXXXXXXGSSADLSLEKAAVVSWEEEAEHSGASHNILVVVQDDGTMKIKDEEKDDTLTILLKATLLAISGVYPLSIPATLFLWYFWQXXXXXXXXXLWDTPSPPEVEKAVLDDGIYRXXXXXXXXXSQVGVGVFQEGVFHTMWHVTXXXXXXXXXXXXXXXXXXXXXXLISYGGGWRLQGLWNTGEEVQVIXXXPGKNPKNVQTAPGTFKTSEGEXXXXXXXXXXXXXXXXXXXXXXXXXXXXXXXXXXXXXTYVSAIAQARASQEGPLPEIEEKVFRKRNLTIMXXXXXXXXXXXYLPAMVREAIKRKLRTLVLAPTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSVEAFPQSNAIIQDEERDIPERSWNSGHEWITDFPGKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAQRRGRIGRNQNKEGDQYIYMGQPLKNDEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRRSISGDLILEIGKLPQHLTQKAQNALDNLVXXXXXEQGGRAYRHALEELPDTIETLXXXXXXXXXXGGVMLFFLSGKGLGKTSIGLLCVTSSSALLWMANVEPHXXXXXXXXXXXXXXXXXXXXXXXXXXXXXXLAYVVIGLLFVILTVAANEMGXXXTTKKDLGIGHAAXXXXXXXTMLDVDLRPASXXXXXXXXXXXXXXXXXXXXXXXXXXXXXXXXXXXXXXXXXXXXXXXXXXXXXXXXXXXXXXXXXVNPLTLTATVLMLVAHYAIXXXXXXXXXXXXXXXXXXXXXMKNPTVDGIVTIDLDPVVYDAKFEKQLGQVMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLSKSEFNTYKKSGIVEVDRSEAKEGLRRGEIIKHAVSRGTAKXXXXXXXXXXXXXXXXXXXXXXXXXXXXXXXXXXXXXXXXGYTKGGAGHEEPIPMATYGWNLVRLHSGKDVFFMPPEKCDTLLCXXXXXXXXXXXXXXXXXXXXXXXXXXXXXXXXXXXXXXXXYMPSVVETLEQMQRRHGGMLVXXXXXXXXXXXXXXXXXXXXXXXXXXXXXXXXXXXRFTMAHRKPTYEKDVDLGAGTRHVAVEPEEANLDIIGQRIXXXXXXXXXXXXXXXXXXXXXXXXXXXXXXXXXXXXXXXXXXXXXXXXXXXXXXXXXXXXXXXXXXXXXXXXXXXXKVDTRTPRAKRGTVQIMEMTARWLWSFLSRNKXXXXXXXXXXXXXXXXXXXXXXXXXXXXXXXXXKEAVEDERFWELVRRERELHKQGKXXXXXXXXXXXXXXXXXXXXXXXXXXXXXXXXXXXXXXXXXXXXXXXXXXXXXXXXXLSGVEGEGLHKLGYILRDISRISGGNMYADDTAXXXXXVTEDDLQNEAKITDIMEPEHALLAKAIFKLTYQNKVVRVQRPARNGTVMDVISRXXXXXXXXXXXYGLNTFTNMGAQLIRQMESEGIFFPXXXXXXXXXXXXXXXXXXXXXXXXXXXXISGDDCVVKPVDDRFATALSALNDMGKVRKXXXXXXXXXXXXXXXXXXXXXXXXXXXXXXXXXXXXXXXXXXXXXXXXXXXXXXXXXXXXXXXXXXXXXXXXXXXXXXXXXXXXXAANAICSADPVEWVPTSRTTWSXXXXXXXXXXXXXXXXXXXXXXXENPWMEDKTHISSWEEVPYLGKREDXXXXXXXXXXXXXTWATNVQVAINQVRRLIGNENYLDYMTSMKRFKNDXXXXXXXXXXXXXXXXXX

SEQ ID NO: 265715 - protein, 3405 aa, Dengue virus
  MOD_RES (13)..(79): Any amino acid
  MOD_RES (94)..(109): Any amino acid
  MOD_RES (182)..(192): Any amino acid
  MOD_RES (207)..(230): Any amino acid
  MOD_RES (256)..(326): Any amino acid
  MOD_RES (342)..(357): Any amino acid
  MOD_RES (379)..(399): Any amino acid
  MOD_RES (420)..(430): Any amino acid
  MOD_RES (462)..(472): Any amino acid
  MOD_RES (493)..(505): Any amino acid
  MOD_RES (518)..(566): Any amino acid
  MOD_RES (595)..(598): Any amino acid
  MOD_RES (688)..(712): Any amino acid
  MOD_RES (727)..(744): Any amino acid
  MOD_RES (775)..(830): Any amino acid
  MOD_RES (846)..(848): Any amino acid
  MOD_RES (868)..(873): Any amino acid
  MOD_RES (906)..(909): Any amino acid
  MOD_RES (932)..(935): Any amino acid
  MOD_RES (961)..(981): Any amino acid
  MOD_RES (1000)..(1011): Any amino acid
  MOD_RES (1037)..(1060): Any amino acid
  MOD_RES (1072)..(1128): Any amino acid
  MOD_RES (1140)..(1142): Any amino acid
  MOD_RES (1165)..(1172): Any amino acid
  MOD_RES (1229)..(1230): Any amino acid
  MOD_RES (1251)..(1255): Any amino acid
  MOD_RES (1274)..(1301): Any amino acid
  MOD_RES (1316)..(1321): Any amino acid
  MOD_RES (1367)..(1392): Any amino acid
  MOD_RES (1431)..(1431): Any amino acid
  MOD_RES (1443)..(1447): Any amino acid
  MOD_RES (1462)..(1480): Any amino acid
  MOD_RES (1501)..(1561): Any amino acid
  MOD_RES (1573)..(1584): Any amino acid
  MOD_RES (1599)..(1636): Any amino acid
  MOD_RES (1668)..(1681): Any amino acid
  MOD_RES (1703)..(1797): Any amino acid
  MOD_RES (1810)..(1939): Any amino acid
  MOD_RES (1953)..(2093): Any amino acid
  MOD_RES (2126)..(2175): Any amino acid
  MOD_RES (2200)..(2254): Any amino acid
  MOD_RES (2266)..(2272): Any amino acid
  MOD_RES (2284)..(2351): Any amino acid
  MOD_RES (2366)..(2514): Any amino acid
  MOD_RES (2536)..(2536): Any amino acid
  MOD_RES (2556)..(2598): Any amino acid
  MOD_RES (2641)..(2684): Any amino acid
  MOD_RES (2702)..(2738): Any amino acid
  MOD_RES (2777)..(2855): Any amino acid
  MOD_RES (2884)..(2917): Any amino acid
  MOD_RES (2942)..(3008): Any amino acid
  MOD_RES (3030)..(3039): Any amino acid
  MOD_RES (3090)..(3114): Any amino acid
  MOD_RES (3127)..(3160): Any amino acid
  MOD_RES (3182)..(3269): Any amino acid
  MOD_RES (3291)..(3318): Any amino acid
  MOD_RES (3336)..(3366): Any amino acid
  MOD_RES (3388)..(3405): Any amino acid
MINQRKKTGRPSXXXXXXXXXXXXXXXXXXXXXXXXXXXXXXXXXXXXXXXXXXXXXXXXXXXXXXXXXXXXXXXXXXXVLRGFKREISNMLNXXXXXXXXXXXXXXXXPTALTFHLTTRGGEPHMIVGKQERGKSLLFKTSTGVNMCTLIAMDLGELCEDTITYKCPRISEAEPDDVDCWXXXXXXXXXXXTCSRTGEHRRDKRSXXXXXXXXXXXXXXXXXXXXXXXXWKQIQRVETWALRHPGFTVMALFLAXXXXXXXXXXXXXXXXXXXXXXXXXXXXXXXXXXXXXXXXXXXXXXXXXXXXXXXXXXXXXXXXXXXXXXXKTEVTSPAILRKLCIXXXXXXXXXXXXXXXXGEATLVEEQDANFVCRRTLVDXXXXXXXXXXXXXXXXXXXXXKCVTKLEGKTVQHENLKYSVXXXXXXXXXXXVGNESTEHGTTATITPQAPTTEIQLTDYGVLXXXXXXXXXXXFNEMVLLTMEKKSWLVHKQWXXXXXXXXXXXXXTTQETWNRQDLLXXXXXXXXXXXXXXXXXXXXXXXXXXXXXXXXXXXXXXXXXXXXXXXXXLKMDKLTLKGISYVMCTGPFKLEKEVAEXXXXTVLVQVRYEGTDAPCKIPFSAQDGKGVTQNGRLITANPIVTDREKPVNIETEPPFGESYIIVGAGEKALKLSWFKKGSNIGKMFEATARXXXXXXXXXXXXXXXXXXXXXXXXXGKLVHQVFGAAYGVXXXXXXXXXXXXXXXXXXWLGLNSRSTSLSVMCIVVGLVTLYLGAMVQXXXXXXXXXXXXXXXXXXXXXXXXXXXXXXXXXXXXXXXXXXXXXXXXXXXXXXXXGIRSVTRLENIMWKQXXXELNYILLENDIKFTVVVGNXXXXXXQGKKTIRPQPMEYKYSWKNWGKAKIIGADTQNXXXXIDGPDTPECPDEQRAWNIWEVEXXXXGIFTTNIWLRLRDSYTQACDHRLMSXXXXXXXXXXXXXXXXXXXXXNETWKLEKASFIEVKTCIXXXXXXXXXXXXLESEMIIPKMYGGPMSQHNYRPGYFXXXXXXXXXXXXXXXXXXXXXXXXIVDEHCGNRGPXXXXXXXXXXXXXXXXXXXXXXXXXXXXXXXXXXXXXXXXXXXXXXXXXXXXXXXXXSGEVDNFSLGIXXXSIMTEEVMRSRWSRKMLMTGILXXXXXXXXGQLTWNDLIRLCIMVGANASDRMGMGTTHLALMATFKIRPMFAVGLLLRRLTSREVXXLTIGLSLVAFVELPNSLEELXXXXXIGIMMLKLLTDFQPHQLWXXXXXXXXXXXXXXXXXXXXXXXXXXXXVSLFPLCMSTTSQKXXXXXXLLGSLGCKPLTMFLIVENEIWGRKSWPINEGIMAVGIVSILLSALXXXXXXXXXXXXXXXXXXXXXXXXXXSADLLLEKAAKVSWEQEAEHSGASHNILVEVQDDGPMKXKDEERDDMLTIXXXXXLLAISGVYPLSIPAXXXXXXXXXXXXXXXXXXXWDTPSPPKVERAVLDNGIYRXXXXXXXXXXXXXXXXXXXXXXXXXXXXXXXXXXXXXXXXXXXXXXXXXXXXXXXXXXXXXQGLWNTGEEVQXXXXXXXXXXXXVQTMPGTFKTPEGEXXXXXXXXXXXXXXXXXXXXXXXXXXXXXXXXXXXXXXYVSAIAQTKASQEGPLPEIENEVFRKRNLTIXXXXXXXXXXXXXXPAIVREAIKRRLRTLVLAPTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSAEAFPQSNAVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNHNKEGDQYVYMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRKSVSGDLILEIGKLPQHLTLKAQNALDNLVXXXXXXXXXXXXXXXXXXXXXXXXXXXXXXXXXXXXXXXXXXXXXXXXXXKTSIGLLCVMSSSVLLWIASVEPHXXXXXXXXXXXXXXXXXXXXXXXXXXXXXXXXXXXXXXXXXXXXXXXXXXXXXXXTKKDLGIGHAVXXXXXXXTMLDIDLHPASXXXXXXXXXXXXXXXXXXXXXXXXXXXXXXXXXXXXXXXXXXXXXXXXXXXXXXXXXXXXXXXXXXXXLTLTATVLMLVAHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLSKPEFNTYKRSGIVEVDRSEXKEGLKRGETIKHAVSRGTAXXXXXXXXXXXXXXXXXXXXXXXXXXXXXXXXXXXXXXXXXXXTKGGLGHEEPIPMATYGWNLVKLHSGKDVFFVPPEKCDTLLCXXXXXXXXXXXXXXXXXXXXXXXXXXXXXXXXXXXXXXXXXXXXVVETLERMQRKHGGMLVXXXXXXXXXXXXXXXXXXXXXXXXXXXXXXXXXXXXXTMAHRKPTFERDVDLGAGTRHVTVEPEVPNLDIIGQRIXXXXXXXXXXXXXXXXXXXXXXXXXXXXXXXXXXXXXXXXXXXXXXXXXXXXXXXXXXXXXXXXXXXXXXXXXXXXXXXTRTPKAKQGTAQIMEVTAKWLWDFLSRNXXXXXXXXXXXXXXXXXXXXXXXXXXXXXXXXXXKEAVEDERFWNLVKKERELHKQGKXXXXXXXXXXXXXXXXXXXXXXXXXXXXXXXXXXXXXXXXXXXXXXXXXXXXXXXXXXXXXXXXXXXRLGYILRDISKISGGNMYADDXXXXXXXXXXDDLRNEARITDIMEPEHALLARSIFKLTYQNKVVRVQRPTKNGTVMDVISXXXXXXXXXXXXXXXXXXXXXXXXXIRQMESEEIFSPXXXXXXXXXXXXXXXXXXXXXXXXXXXXXXXXXXVVKPIDDRFAAALTALNDMGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXAANANCSAVPIDWVPTSRTTWXXXXXXXXXXXXXXXXXXXXXXXXXXXXMEDKTHVSSWGDVPYLGXXXXXXXXXXXXXXXXXXXXXXXXXXXXXXXRLIGNENYLDFMTSMKRFKNEXXXXXXXXXXXXXXXXXX

SEQ ID NO: 265716 - protein, 3405 aa, Dengue virus
  MOD_RES (1)..(109): Any amino acid
  MOD_RES (122)..(140): Any amino acid
  MOD_RES (153)..(163): Any amino acid
  MOD_RES (180)..(193): Any amino acid
  MOD_RES (206)..(241): Any amino acid
  MOD_RES (256)..(330): Any amino acid
  MOD_RES (342)..(402): Any amino acid
  MOD_RES (420)..(430): Any amino acid
  MOD_RES (461)..(474): Any amino acid
  MOD_RES (487)..(505): Any amino acid
  MOD_RES (517)..(566): Any amino acid
  MOD_RES (585)..(608): Any amino acid
  MOD_RES (662)..(663): Any amino acid
  MOD_RES (684)..(712): Any amino acid
  MOD_RES (727)..(750): Any amino acid
  MOD_RES (769)..(850): Any amino acid
  MOD_RES (863)..(875): Any amino acid
  MOD_RES (897)..(909): Any amino acid
  MOD_RES (930)..(946): Any amino acid
  MOD_RES (961)..(1018): Any amino acid
  MOD_RES (1031)..(1152): Any amino acid
  MOD_RES (1165)..(1172): Any amino acid
  MOD_RES (1205)..(1209): Any amino acid
  MOD_RES (1225)..(1232): Any amino acid
  MOD_RES (1251)..(1258): Any amino acid
  MOD_RES (1270)..(1301): Any amino acid
  MOD_RES (1313)..(1324): Any amino acid
  MOD_RES (1350)..(1392): Any amino acid
  MOD_RES (1429)..(1447): Any amino acid
  MOD_RES (1461)..(1480): Any amino acid
  MOD_RES (1496)..(1656): Any amino acid
  MOD_RES (1668)..(1681): Any amino acid
  MOD_RES (1700)..(1939): Any amino acid
  MOD_RES (1952)..(2175): Any amino acid
  MOD_RES (2189)..(2254): Any amino acid
  MOD_RES (2266)..(2518): Any amino acid
  MOD_RES (2533)..(2536): Any amino acid
  MOD_RES (2548)..(2624): Any amino acid
  MOD_RES (2638)..(2685): Any amino acid
  MOD_RES (2699)..(2756): Any amino acid
  MOD_RES (2773)..(2855): Any amino acid
  MOD_RES (2879)..(2928): Any amino acid
  MOD_RES (2941)..(3014): Any amino acid
  MOD_RES (3030)..(3044): Any amino acid
  MOD_RES (3064)..(3278): Any amino acid
  MOD_RES (3291)..(3318): Any amino acid
  MOD_RES (3336)..(3368): Any amino acid
  MOD_RES (3380)..(3405): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPTTLAFHLTTRGXXXXXXXXXXXXXXXXXXXTSAGVNMCTLVAXXXXXXXXXXXTYKCPRISEAEPDDVDXXXXXXXXXXXXXXCSQIGEHRRDKRXXXXXXXXXXXXXXXXXXXXXXXXXXXXXXXXXXXXLRHPGFTMIALFLAXXXXXXXXXXXXXXXXXXXXXXXXXXXXXXXXXXXXXXXXXXXXXXXXXXXXXXXXXXXXXXXXXXXXXXXXXXXANPAVLRKLCIXXXXXXXXXXXXXXXXXXXXXXXXXXXXXXXXXXXXXXXXXXXXXXXXXXXXXXXXXXXXXTKLEGKIVQHENLKYSVXXXXXXXXXXXVGNETTDHGTIATITPQAPTTEIQLTDYGVXXXXXXXXXXXXXXEMVLLTMEKKSWXXXXXXXXXXXXXXXXXXXASQETWNRKDLXXXXXXXXXXXXXXXXXXXXXXXXXXXXXXXXXXXXXXXXXXXXXXXXXXLKMDKLTLKGVSYVMCTGXXXXXXXXXXXXXXXXXXXXXXXXADAPCKIPFSTQDERGVTQNGRVITANPIVTDKEKPINIEAEPPFGESYITIGXXEEALKLSWFKKGSSIGKMFVXXXXXXXXXXXXXXXXXXXXXXXXXXXXXGKLIHQVFGTAYGVXXXXXXXXXXXXXXXXXXXXXXXXRNTSLSMTCIVVGMVTLYXXXXXXXXXXXXXXXXXXXXXXXXXXXXXXXXXXXXXXXXXXXXXXXXXXXXXXXXXXXXXXXXXXXXXXXXXXXXXXXXXXNHILLENDIKFTXXXXXXXXXXXXXKKMVRPQPMEYKYSWRSWGKAXXXXXXXXXXXXXIDGPNTSECSDDQRAWNIWEXXXXXXXXXXXXXXXXXRDSHTQMCDHRLMSXXXXXXXXXXXXXXXXXXXXXXXXXXXXXXXXXXXXXXXXXXXXXXXXXXXXXXXXXXPKIYGGPMSQHNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRWSRKMLMAGTLXXXXXXXXGQLTWKDLIRLCIMVGANVSDRMGMGTTHLALXXXXXMRPMFAVGLLLRRLTXXXXXXXXIGLSLVACVELPNSLEELXXXXXXXXMILKLLTDFQPXXXXXXXXXXXXXXXXXXXXXXXXXXXXXXXXVSLFPLCMSTTXXXXXXXXXXXXSLGCKPLAMFLIAENEIWGRKSWPLXXXXXXXXXXXXXXXXXXXXXXXXXXXXXXXXXXXXXXXXXXXSADLSLDKAAEVSWEKEAEHSGASHNIFVEVQDDGTXXXXXXXXXXXXXXXXXXXLLAISGVYPLSIPXXXXXXXXXXXXXXXXXXXXWDTPSPPVVERAVLDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDKVFRKRNLTIXXXXXXXXXXXXXXPAIVREAIKRKMRTLILAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNYNKEGDQYIYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTSIGLLCVIASSXXXXXXXXXXXXXXXXXXXXXXXXXXXXXXXXXXXXXXXXXXXXXXXXXXXXXXXXXXXXXXXXXXTKKDLGIGHVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEFNIYKRSGIVEVDXXXXKEGLKRGETIKXXXXXXXXXXXXXXXXXXXXXXXXXXXXXXXXXXXXXXXXXXXXXXXXXXXXXXXXXXXXXXXXXXXXXXXXXXXXXKDAFFIPPEKCDTXXXXXXXXXXXXXXXXXXXXXXXXXXXXXXXXXXXXXXXXXXXXXXXXVETLEHMQRKHGGXXXXXXXXXXXXXXXXXXXXXXXXXXXXXXXXXXXXXXXXXXXXXXXXXXXXXXXXXXTRHVAVEPEVPNLDIIXXXXXXXXXXXXXXXXXXXXXXXXXXXXXXXXXXXXXXXXXXXXXXXXXXXXXXXXXXXXXXXXXXXXXXXXXXXXXXXXXXXTRTPKAKRGTAQVMEVTARWLWGXXXXXXXXXXXXXXXXXXXXXXXXXXXXXXXXXXXXXXXXXXXXXXXXXXLVHKERELHKQGXXXXXXXXXXXXXXXXXXXXXXXXXXXXXXXXXXXXXXXXXXXXXXXXXXXXXXXXXXXXXXXXXXXXXXXXXXRDISKIPGGSMYADDXXXXXXXXXXXXXXXEARITDIMEAEHALLATSIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVNWVPTSRTTWXXXXXXXXXXXXXXXXXXXXXXXXXXXXMEDKTRVSSWEDVPYLGXXXXXXXXXXXXXXXXXXXXXXXXXXXXXXXXXIGNENYLDYMIXXXXXXXXXXXXXXXXXXXXXXXXXX

SEQ ID NO: 265717 - protein, 3391 aa, Dengue virus
  MOD_RES (104)..(108): Any amino acid
  MOD_RES (450)..(450): Any amino acid
  MOD_RES (903)..(903): Any amino acid
  MOD_RES (952)..(952): Any amino acid
  MOD_RES (1160)..(1165): Any amino acid
  MOD_RES (1190)..(1190): Any amino acid
  MOD_RES (1242)..(1243): Any amino acid
  MOD_RES (1263)..(1263): Any amino acid
  MOD_RES (2260)..(2264): Any amino acid
  MOD_RES (2489)..(2489): Any amino acid
  MOD_RES (3049)..(3049): Any amino acid
  MOD_RES (3122)..(3139): Any amino acid
MNNQRKKARSTPFNMLKRERNRVSTVQQLTKRFSLGMLQGRGPLKLFMALVAFLRFLTIPPTAGILKRWGTIKKSKAINVLRGFRKEIGRMLNILNRRRRTAGXXXXXIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSXTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEXHNQTFLIDGPETAECPNTNRAWNSLEVEDYGFGVFTTNIWLKLREKQDXFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAXXXXXXSFVTLITGNMSFRDLGRVMVMVGAXMTDDIGMGVTYLALLAAFKVRPTFAAGLLLRKLTSKELMMATIGIALLSQSXXPETILELTDALALGMMVLKXVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGXXXXXEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLEPIPYDPKFEKQLGQVMLLILCVTQVLMMRTTWALCEALTLATGPISTLWEGNPGRFWNTTIAVSMANIFRGSYLAGAGLLFSIMKNTTNXRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMXGEHKKLAEAIFKLTYQNKVVRVQRPTPRGTVMDIISRRDQRGSGQVGTYGLNTFTNMEAQLIRQMEGEGIFKXXXXXXXXXXXXXXXXXXRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 265718 - protein, 3391 aa, Dengue virus
  MOD_RES (1)..(1): Any amino acid
  MOD_RES (18)..(18): Any amino acid
  MOD_RES (34)..(39): Any amino acid
  MOD_RES (104)..(108): Any amino acid
  MOD_RES (121)..(121): Any amino acid
  MOD_RES (179)..(181): Any amino acid
  MOD_RES (205)..(206): Any amino acid
  MOD_RES (218)..(225): Any amino acid
  MOD_RES (294)..(318): Any amino acid
  MOD_RES (381)..(390): Any amino acid
  MOD_RES (450)..(450): Any amino acid
  MOD_RES (491)..(498): Any amino acid
  MOD_RES (535)..(546): Any amino acid
  MOD_RES (568)..(580): Any amino acid
  MOD_RES (690)..(697): Any amino acid
  MOD_RES (720)..(721): Any amino acid
  MOD_RES (750)..(750): Any amino acid
  MOD_RES (804)..(804): Any amino acid
  MOD_RES (836)..(838): Any amino acid
  MOD_RES (903)..(903): Any amino acid
  MOD_RES (929)..(929): Any amino acid
  MOD_RES (952)..(952): Any amino acid
  MOD_RES (1073)..(1108): Any amino acid
  MOD_RES (1160)..(1165): Any amino acid
  MOD_RES (1190)..(1190): Any amino acid
  MOD_RES (1242)..(1243): Any amino acid
  MOD_RES (1263)..(1263): Any amino acid
  MOD_RES (1332)..(1333): Any amino acid
  MOD_RES (1361)..(1392): Any amino acid
  MOD_RES (1479)..(1480): Any amino acid
  MOD_RES (1514)..(1526): Any amino acid
  MOD_RES (1560)..(1582): Any amino acid
  MOD_RES (1603)..(1607): Any amino acid
  MOD_RES (1625)..(1627): Any amino acid
  MOD_RES (1696)..(1712): Any amino acid
  MOD_RES (1732)..(1740): Any amino acid
  MOD_RES (1756)..(1800): Any amino acid
  MOD_RES (1882)..(1885): Any amino acid
  MOD_RES (1901)..(1904): Any amino acid
  MOD_RES (1949)..(1986): Any amino acid
  MOD_RES (2002)..(2005): Any amino acid
  MOD_RES (2064)..(2067): Any amino acid
  MOD_RES (2083)..(2088): Any amino acid
  MOD_RES (2106)..(2106): Any amino acid
  MOD_RES (2143)..(2144): Any amino acid
  MOD_RES (2198)..(2201): Any amino acid
  MOD_RES (2213)..(2223): Any amino acid
  MOD_RES (2245)..(2248): Any amino acid
  MOD_RES (2260)..(2264): Any amino acid
  MOD_RES (2276)..(2283): Any amino acid
  MOD_RES (2299)..(2315): Any amino acid
  MOD_RES (2342)..(2345): Any amino acid
  MOD_RES (2366)..(2372): Any amino acid
  MOD_RES (2407)..(2410): Any amino acid
  MOD_RES (2426)..(2436): Any amino acid
  MOD_RES (2462)..(2476): Any amino acid
  MOD_RES (2489)..(2489): Any amino acid
  MOD_RES (2529)..(2553): Any amino acid
  MOD_RES (2577)..(2579): Any amino acid
  MOD_RES (2597)..(2598): Any amino acid
  MOD_RES (2613)..(2614): Any amino acid
  MOD_RES (2638)..(2639): Any amino acid
  MOD_RES (2700)..(2708): Any amino acid
  MOD_RES (2724)..(2729): Any amino acid
  MOD_RES (2748)..(2750): Any amino acid
  MOD_RES (2789)..(2809): Any amino acid
  MOD_RES (2836)..(2858): Any amino acid
  MOD_RES (2911)..(2912): Any amino acid
  MOD_RES (2943)..(2984): Any amino acid
  MOD_RES (3025)..(3027): Any amino acid
  MOD_RES (3049)..(3049): Any amino acid
  MOD_RES (3069)..(3071): Any amino acid
  MOD_RES (3122)..(3139): Any amino acid
  MOD_RES (3200)..(3200): Any amino acid
  MOD_RES (3229)..(3232): Any amino acid
  MOD_RES (3262)..(3268): Any amino acid
  MOD_RES (3335)..(3348): Any amino acid
XNNQRKKAKNTPFNMLKXERNRVSTIQQLTKRFXXXXXXGRGPLKLFMAFVAFLRFLTIPPTVGILKRWGTVKKSKAISVLRGFRREIGRMLNILNRRRRSAGXXXXXIPTVVAFHLTTRXGEPHMIVGINEKGKSLLFKTENGTNMCTLMAMDLGELCEDTITYNCPFLKQNEPEDIXXXCNSTSTWVTYGTCSAMGEHRREKXXVALVPHVRMGLXXXXXXXXSSEGAWKHAQRIETWVLRHPGFTMMAAILAYTIGTTHFQRVLIFILLAAITPSMTMRCIGMSNRDFVEXXXXXXXXXXXXXXXXXXXXXXXXXPTLDFELIKTEAKHPATLRKFCVEAKLTNTTTASRCPTQGEPSLKEEQDKRFICRHSMVDRGXXXXXXXXXXGGIVTCAMFRCKKNMEGKVVLPENLEYTIVVTPHSGEENAVGNDTGKHGKEIKVTPQSSXAEAELTDYGTITMECSPRTSLDFNEMVLLQMENKAWLVHRXXXXXXXXPWLPGADKQESNWIQKEMLVTFKNPHAKRQDVVVLGXXXXXXXXXXXXATEIQMSLGNILFMGHLKCRLXXXXXXXXXXXXXMCTGKFKVVKEIAETQHGTIVIRVQYEGDDSPCKIPFEIMDLEKRYILGRLITVNPIVIEKDSPINIEAEPPFGDSYIIVGVEPGQLKLSWFKKGSSIGQMIETTMRGAXXXXXXXXTAWDFGSIGGVFTSVGKALHQVXXAIYGVAFSGVSWTMKILIGVVITWIGMNXRSTSLSVSLVLVGIVTLYLGAVVQADTGCVVSWKSKELKCGSGIFVTDNVHTWXEQYKFQPDSPSKLASAIQKAQEEDICGIRSVXXXENLMWKQITPELNHILAENEAKLTIMTGDIRGIMQVGRRSLRPQPTELKYSWKAWGKAKVLSTEXYNHTFLIDGPETTECPNSNRAWNSLXVEDYGFGVFSTNIWLKLKEKQDXICDSKLMSAAVKDDRAVHADMGYWIESALNDTWKIEKASFIEVKNCYWPRSHTLWSNGVLESEMIIPKNLAGPVSQHNYRPGYHTQIAGPWHLGKLEMDFDFCDGTTVIVTEECGNRGPSXXXXXXXXXXXXXXXXXXXXXXXXXXXXXXXXXXXXEIRPLKEKEENLVSSLVTAGHGQVDNFSLGILGMALLLEEMLRTRIGTKHAXXXXXXSFMTLITGNMSFKDLGRVVVMVGAXMADEMGMGITYLALLAAFRVRPTFAVGLFLRKLTSKELMMTTIGIVLLSQSXXPETVLELTDALALGMMALKXVRDLEKYQLAVTVMAILCVPNAVILRHAWKVSCTILAVVSVSPLFLTSSQQKTDWIPLVLTIKGLSPTXXFLTTLSRTNKTRSWPLNEAVMAVGMVSXXXXXXXXXXXXXXXXXXXXXXXXXXXXXXXXSADLELERATDVRWEEQAEISGSSPILSITIAEDGSMSIKNEEEEHILTILIRTGLLVISGLFPISMPITAAAWYLWETKKQRAGVXXDVPSPPPMERAELEDGAYRIKQRGIFGYSQIGAXXXXXXXXXXXXXVTRGAVLMHKGKRIEPSWADVRKDLVSYGGGWKXXXXXXXXXXXXXXXXXXXXXXXAVQTKPGIFKTNAGTIGAVSXXXXXGTSGSPIIDKKGKVVGLXXXGVVTRSGTYVSSIAQTEKSIEDNPDIEDDIFRKRKLTIMDLHPGAGKTKKYLPAIVREAIRRGLRTLIXXXXXXXXXXXXXXXXXLPIRYQTPAIKTEHTGREIXXXXXXXXXTMRLLSPIRVPNYNLXXXXXXXXXXXXXXXXXXXXXXXXXXXXXXXXXXXXXXXXXXXXXPQSNAPIIDEEREIPERSWNSGHEWITNFKGKTVWFVPSIKTGNDIAACLRKNGKRVIQLSRKTFDSEYIKTRANDWDFVVXXXXSEMGANFRAERVIDPXXXXKPVILTDGEERVVLAGPMPVTHFSAAQRRGRVGRNPRNENDQYIXXXXXXXXXXXXXXXXXXXXXXXXXXXXXXXXXXXXXXEREKVDAVDGEYRLRXXXXKTFVDLMKRGDLPVWLAYRVASEGINYADRKWCFDGVRNNQILEENMEVEVWTKEGERXXXXPRWLDARTYSDPLALXXXXXXAAGRKSLALSLITEMGRXPTFMTQKTRNALDNLAVLHTAEVGGKAYTHALSELPXXLETLLLLGLLAAVTGGIFLFLMSGRGVGKMTLGMCCIVTASVLLWHAQIQPHWXXXXIILVFFLIVLLXXXXXXXXXXXDNQLTYVIIAILTLVAATMANXXXXLEKTKKDFGLGXXXXXQSEINILDIDLXXXXXXXXYAVATTFITPMLRHSXXXXXXXXXXXXXXXXXTVLMGLGRGWPLSKMDIGAPLLAIGCXXXXNPITLTAALFLLIAHYAIIGXXXXXXXTREAQKRTAAGIMKNPTVDGITVIDLDPIPYDPKXXXXLGQVMLLVLCVTQVLXXXXXXXXXXXLTLATGPVSTLWEGNPGKFWNTTIAXXXXXXXXXXXXXXXGLLFSIMKNTTSXRRGTGNMGETLGEKWKNRLNALGKSEFQIYKRSGIQEVDXXXXXXXXXXXXXXXXXXXXXXXXXRWFVERNLVTPEGKVMDLGCGRGXXXYYCGGLKNVKEVKGLTKXXPGHEEPVPMSTYGWXXVRLQSGVDVFFIPPERCDTLLCDXXESSPNPTVEAGRTLRVLSLVENWLNNNTQFCVKVLNPYMPSVIEKMETLQRQFGGALVRNXXXXXXXXXMYWVSNASGNIVSSVXXXXXXLINRFTMRYKKTTYEPDVXXXSGTRNIGIENETPNMDIIGKRIEKIKQEHEISWHYDQDXXXXXXXXXXXXXXXXXXXXXSMVNGVVKLLTKPWDVLPTVTQMAMTXXXXXXXXXXXXXXXXXXXXXXXEGTKKLMRITAEWLWKELGKEKKPRICTREEFTKKVRSNAALGAVFTDENKWXXAREAVEDGRFWELVDRERNLHLDGKCETCVXXXXXXXXXXXXXXXXXXXXXXXXXXXXXXXXXXXXXXXXXXEDHWFSRGNSLSGVEGEGLHRLGYILRDVGRKAGGAMYADXXXGWDTRITIEDLKNEEMITNHMXGEHKRLAEAIFRLTYQNKVXXXQRPTSRGTVMDIISRKDQRGSGQVVTYGLNTFTNMGAQLIRQMEGEGVFKXXXXXXXXXXXXXXXXXXREGRERLARMAISGDDCVVKPIDDRFANALTALNDMGKIRKDIQQWEPSKGWSDWTQVPFXSHHFHELVMKDGRTLVVPCRSQDELIGRXXXXQGAGWSLRETACLGKSYAQMWTLMYFHRRXXXXXXXAICSAVPPHWVPTSRTTWSIHATHEWMTTEDMLTVWNRVWIRDNPWIEDKTPVESWEEIPYLGKREXXXXXXXXXXXXXXTWAKNIQAAINQVRALIGEEGYIDYMPSMKRFRKEEEESGVLW

SEQ ID NO: 265719 - protein, 3391 aa, Dengue virus
  MOD_RES (1)..(1): Any amino acid
  MOD_RES (18)..(44): Any amino acid
  MOD_RES (53)..(68): Any amino acid
  MOD_RES (87)..(93): Any amino acid
  MOD_RES (104)..(108): Any amino acid
  MOD_RES (121)..(122): Any amino acid
  MOD_RES (153)..(158): Any amino acid
  MOD_RES (177)..(187): Any amino acid
  MOD_RES (204)..(226): Any amino acid
  MOD_RES (288)..(324): Any amino acid
  MOD_RES (379)..(392): Any amino acid
  MOD_RES (450)..(450): Any amino acid
  MOD_RES (465)..(480): Any amino acid
  MOD_RES (491)..(498): Any amino acid
  MOD_RES (514)..(549): Any amino acid
  MOD_RES (560)..(596): Any amino acid
  MOD_RES (651)..(652): Any amino acid
  MOD_RES (678)..(678): Any amino acid
  MOD_RES (688)..(700): Any amino acid
  MOD_RES (716)..(731): Any amino acid
  MOD_RES (749)..(756): Any amino acid
  MOD_RES (788)..(819): Any amino acid
  MOD_RES (833)..(840): Any amino acid
  MOD_RES (903)..(903): Any amino acid
  MOD_RES (924)..(931): Any amino acid
  MOD_RES (952)..(952): Any amino acid
  MOD_RES (988)..(989): Any amino acid
  MOD_RES (1007)..(1013): Any amino acid
  MOD_RES (1072)..(1114): Any amino acid
  MOD_RES (1147)..(1148): Any amino acid
  MOD_RES (1160)..(1165): Any amino acid
  MOD_RES (1176)..(1176): Any amino acid
  MOD_RES (1190)..(1190): Any amino acid
  MOD_RES (1205)..(1207): Any amino acid
  MOD_RES (1242)..(1243): Any amino acid
  MOD_RES (1263)..(1263): Any amino acid
  MOD_RES (1330)..(1333): Any amino acid
  MOD_RES (1350)..(1394): Any amino acid
  MOD_RES (1415)..(1416): Any amino acid
  MOD_RES (1429)..(1431): Any amino acid
  MOD_RES (1446)..(1449): Any amino acid
  MOD_RES (1465)..(1480): Any amino acid
  MOD_RES (1497)..(1498): Any amino acid
  MOD_RES (1512)..(1526): Any amino acid
  MOD_RES (1542)..(1544): Any amino acid
  MOD_RES (1556)..(1584): Any amino acid
  MOD_RES (1602)..(1609): Any amino acid
  MOD_RES (1623)..(1631): Any amino acid
  MOD_RES (1669)..(1715): Any amino acid
  MOD_RES (1731)..(1800): Any amino acid
  MOD_RES (1834)..(1834): Any amino acid
  MOD_RES (1849)..(1862): Any amino acid
  MOD_RES (1882)..(1909): Any amino acid
  MOD_RES (1918)..(1933): Any amino acid
  MOD_RES (1944)..(2016): Any amino acid
  MOD_RES (2060)..(2090): Any amino acid
  MOD_RES (2104)..(2108): Any amino acid
  MOD_RES (2140)..(2148): Any amino acid
  MOD_RES (2160)..(2161): Any amino acid
  MOD_RES (2177)..(2182): Any amino acid
  MOD_RES (2192)..(2229): Any amino acid
  MOD_RES (2239)..(2250): Any amino acid
  MOD_RES (2260)..(2264): Any amino acid
  MOD_RES (2274)..(2347): Any amino acid
  MOD_RES (2366)..(2391): Any amino acid
  MOD_RES (2401)..(2479): Any amino acid
  MOD_RES (2489)..(2489): Any amino acid
  MOD_RES (2526)..(2555): Any amino acid
  MOD_RES (2571)..(2579): Any amino acid
  MOD_RES (2595)..(2618): Any amino acid
  MOD_RES (2634)..(2656): Any amino acid
  MOD_RES (2674)..(2679): Any amino acid
  MOD_RES (2699)..(2730): Any amino acid
  MOD_RES (2746)..(2752): Any amino acid
  MOD_RES (2770)..(2773): Any amino acid
  MOD_RES (2789)..(2818): Any amino acid
  MOD_RES (2834)..(2862): Any amino acid
  MOD_RES (2900)..(2912): Any amino acid
  MOD_RES (2936)..(2997): Any amino acid
  MOD_RES (3023)..(3027): Any amino acid
  MOD_RES (3049)..(3049): Any amino acid
  MOD_RES (3062)..(3111): Any amino acid
  MOD_RES (3122)..(3139): Any amino acid
  MOD_RES (3155)..(3161): Any amino acid
  MOD_RES (3175)..(3184): Any amino acid
  MOD_RES (3197)..(3208): Any amino acid
  MOD_RES (3221)..(3283): Any amino acid
  MOD_RES (3334)..(3348): Any amino acid
  MOD_RES (3390)..(3391): Any amino acid
XNNQRKKARTTPFNMLKXXXXXXXXXXXXXXXXXXXXXXXXXXXRLFMALVAXXXXXXXXXXXXXXXXWGAIKKSRAINVLRGFRRXXXXXXXILNKRRRTAGXXXXXIPTVIAFHLTTRXXEPHMIVSKNEKGKSLLFKTKDGINMCTLMAXXXXXXCEDTITYKCPLLKQNEPEXXXXXXXXXXXWVTYGTCATMGEHRREXXXXXXXXXXXXXXXXXXXXXXXSEGAWKQAQRIETWILRHPGFTLMAAVLAYTVGTTYFQRALIFILLTAVTPSMAMRCIGISXXXXXXXXXXXXXXXXXXXXXXXXXXXXXXXXXXXXXLTKTEAKQPATLRKYCVEAKLTNTTTDSRCPTQGEPTLSEEQDKRFVCRHSMVDXXXXXXXXXXXXXXIVTCAMFTCKKNMEGKVVLPENLEYTVVITPHSGEEHAVGNDTGKHGQEVKITPQSSXSEAELTGYGTITMEXXXXXXXXXXXXXXXXMEEKAWLVHRXXXXXXXXPWLPGADKQGSNWIQXXXXXXXXXXXXXXXXXXXXXXXXXXXXXXXXXXXXIQMSSGNILFXXXXXXXXXXXXXXXXXXXXXXXXXXXXXXXXXXXXXHGTIVVRIQYEGDGSPCRVPFEITDLEKKYILGRLITVNPIVAGKDNPINIEAEXXFGDSYIVIGVEPGQLKLDWFKKGSSXGQMFATTMRXXXXXXXXXXXXXDFGSLGGAFTSIGKAXXXXXXXXXXXXXXXXSWIMKILIGAIITWIGMXXXXXXXXVSLVLVGVVTLYLGAMVQADSGCIVSWKNKEXXXXXXXXXXXXXXXXXXXXXXXXXXXXXXXXAIQKAHEEDICGIXXXXXXXXLMWRQITSELNHILSENEVKLTIMTGDTKGIMQAGKRSLKPQPTELRYSWKTWGKAKMLPTEXHNRTFLIDGPETTECPNSNRXXXXXXXXDYGFGIFTTNIWLKLKERQDXVCDSKLMSAAVKNNRAVHADMGYWMESRLNDTWKMXXASFIEIKSCHWPRSHTLXXXXXXXSEMVIPKSFAGPVSQHNNRPGYYTQITGPWHLGRLEMDFDLCDGTTVVVTENCGNRGPXXXXXXXXXXXXXXXXXXXXXXXXXXXXXXXXXXXXXXXXXXXEREENLVNSLVTAGQGQIDNFSLGILGMALLLXXMLKTRMGTKHAXXXXXXSLVTLITGNLXFKDLGRVIIMVGAXMTDDIGIGVTYLALXXXYRVRPTFAAGLFLRKLTSKELLMATIGITLLSQSXXPGSVLELTDAIALGIMVLKXVRKMEKYQLAVTIMAMLCIPNVMILLNAWKVGCTTLATVSVSPLILTSSRQKTDWIPLALTVKGLNXXXXFLTTLSRPNKTRSWPLXXXXXXXXXXXXXXXXXXXXXXXXXXXXXXXXXXXXXXXXXXXXXDLELEKAAEVKWDDQAEISGXXPILSVTISEDGSXXXKNEEEEQILTILIRXXXXVISGLFPVSMPITAAXXXXXXXXXXXXXXXXDVPSPPPVGRAELEDGXXRIKQRRILGYSQIXXXXXXXXXXXXXXXVTRGAVLVHKGKRIEXXXADVKKDLVSYGXXXXXXXXXXXXXXXXXXXXXXXXXXXXXQTKPGLFRTSTGTIGAVXXXXXXXXSGSPIVDKKGKVVXXXXXXXXXRSGTYVSAIAQTEKNVENNPEIEDDIFRKRKLTIMDLXXXXXXXXXXXXXXXXXXXXXXXXXXXXXXXXXXXXXXXXXXXXXXXRYQTPAIKAEHTGREXXXXXXXXXXXXXXXXXXXXXXXXXXXXXXXXXXXXXXXXXXXXXXXXXXXXXXXXXXXXXXXXXXXXXXPQSNAPIVDEEREIPERSWSTGYEWITNFEGKTXWFVPSIRAGNDIAAXXXXXXXXXXXXXXKTFDSEYAKTRSNDWDFVVXXXXXXXXXXXXXXXXXXXXXXXXXXXXADGEERVIXXXXXXXXXXXXXXXXGRIGRNPRNEXXXXXXXXXXXXXXXXXXXXXXXXXXXXXXXXXXXXXXXXXXXXXXXXXXXXXXXXXXXXXXXXXXXXXXXXXLPVWLAYKVAAEGINYTDRRWCFDGIRNNQILEENMEVEVWTKXXXXXXXXXXXXXXXXXXXXXXXXXXXXXXXGRKSLTLSLITEMXXXXXFMTQKARDALDNLAVLHTAEAGGKAYTHALSXXXXXXXXXLLLTLLAAVTGXXFLFLMSGKGVGKMTLXXXXXXTASGLLWYAXXXXXXXXXXXXXXXXXXXXXXXXXXXXXXXXXXXXXXVVIAILTLVXXXXXXXXXXXXKTKKDLGFGXXXXXEPEINILDIXXXXXXXXXXXXXXXXXXXXXXXXXXXXXXXXXXXXXXXXXXXXXXXXXXXXXXXXXXXXXXXXXXXXXXXXXXVTLTAALLSLMAHYAIIGXXXXXXXXXXXXXXXXXXXXXXXXXXGVTVIDLDPXXXXXXXXXXXXXXXXXXXXXXXXXXXXXXXXXXXXXXXXXXXXXXXXXXXXXXXXXXXXXXXXXXXXXXXXXXXXXXXFSIMKNTANXRRGTGNTGETLGEKWKSRLNALGRSEFQTYKKSGIQXXXXXXXXXXXXXXXXXXXXXXXXXXXXXXFVERNMVAPEGKVVDXXXXXXXXXYYCGGLKDVREVKGLXXXXXXXXXXXXXXXXXXXXXXXXSGVDVFFVPPEKCDTXXXXXXXXXXXXXXXXXXXXXXXNLVENWLNNDTQFCIKVXXXXXXSVIERMETLQRKFGGALVRXXXXXXXXXXXXXXXXXXXXXXXXXXXXXXXXINRFTMRHKRATYEPXXXXXXXTRNIGIECEVPNLDIIGXXXXKIKEEHEASWHYDQDXXXXXXXXXXXXXXXXXXXXXXXXXXXXXXLTKPWDVIPMVTQMAXXXXXXXXXXXXXXXXXXXXXXXXXXXXXKLMKITAKWLWGELGRRKTPRICTRAEFCNKVRSNAAXXXXXXXXXXXXXAREAVEDSGFWELIEKERNLHLDXXXXXXXXXXXXXXXXXXXXXXXXXXXXXXXXXXXXXXXXXXXXXXXXXXXXXXXXXXXXXXVEGEGLYRLGYILREISKKAGGAMYXXXXXGWDTRITSEDLKNEEMITDQMXGRHKKLAEAIFRXXXXXXXXXXXXXXXXXXXXXXXXXXXXXXXXXXXXXXXXXXXXXXXXXXRQMEGEGLFKXXXXXXXXXXXXXXXXXXRVGRERLTRMAISGDXXXXXXXDDRFARALTALNDXXXXXXXXXXWEPSKGWSDWTQXXXXXXXXXXXXMKDGRILVVPCRXXXXXXXXXXXXXXXXXXXXXXXXXXXXXXXXXXXXXXXXXXXXXXXXXXXXXXXXXXXXXXXTTWSIHASHEWMTTEDMLTVWNRVWILENPWIEDKTPVESWEDIPYLGKRXXXXXXXXXXXXXXXTWAKNIQVAINQVRSLMGNEEYIDYMPSMKRFRSEEEESGVXX

SEQ ID NO: 265720 - protein, 3391 aa, Dengue virus
  MOD_RES (1)..(2): Any amino acid
  MOD_RES (11)..(94): Any amino acid
  MOD_RES (104)..(108): Any amino acid
  MOD_RES (120)..(122): Any amino acid
  MOD_RES (151)..(161): Any amino acid
  MOD_RES (174)..(187): Any amino acid
  MOD_RES (204)..(241): Any amino acid
  MOD_RES (253)..(257): Any amino acid
  MOD_RES (282)..(324): Any amino acid
  MOD_RES (340)..(355): Any amino acid
  MOD_RES (379)..(392): Any amino acid
  MOD_RES (414)..(425): Any amino acid
  MOD_RES (450)..(450): Any amino acid
  MOD_RES (459)..(480): Any amino acid
  MOD_RES (491)..(500): Any amino acid
  MOD_RES (514)..(601): Any amino acid
  MOD_RES (648)..(704): Any amino acid
  MOD_RES (713)..(733): Any amino acid
  MOD_RES (743)..(757): Any amino acid
  MOD_RES (779)..(820): Any amino acid
  MOD_RES (833)..(853): Any amino acid
  MOD_RES (888)..(891): Any amino acid
  MOD_RES (903)..(903): Any amino acid
  MOD_RES (912)..(913): Any amino acid
  MOD_RES (924)..(939): Any amino acid
  MOD_RES (952)..(952): Any amino acid
  MOD_RES (971)..(991): Any amino acid
  MOD_RES (1005)..(1017): Any amino acid
  MOD_RES (1044)..(1045): Any amino acid
  MOD_RES (1069)..(1137): Any amino acid
  MOD_RES (1147)..(1176): Any amino acid
  MOD_RES (1190)..(1190): Any amino acid
  MOD_RES (1203)..(1208): Any amino acid
  MOD_RES (1223)..(1227): Any amino acid
  MOD_RES (1242)..(1243): Any amino acid
  MOD_RES (1263)..(1263): Any amino acid
  MOD_RES (1317)..(1334): Any amino acid
  MOD_RES (1349)..(1395): Any amino acid
  MOD_RES (1413)..(1451): Any amino acid
  MOD_RES (1462)..(1481): Any amino acid
  MOD_RES (1490)..(1498): Any amino acid
  MOD_RES (1511)..(1528): Any amino acid
  MOD_RES (1542)..(1584): Any amino acid
  MOD_RES (1600)..(1638): Any amino acid
  MOD_RES (1663)..(1716): Any amino acid
  MOD_RES (1728)..(1818): Any amino acid
  MOD_RES (1834)..(1862): Any amino acid
  MOD_RES (1874)..(2019): Any amino acid
  MOD_RES (2050)..(2050): Any amino acid
  MOD_RES (2060)..(2124): Any amino acid
  MOD_RES (2140)..(2163): Any amino acid
  MOD_RES (2177)..(2182): Any amino acid
  MOD_RES (2192)..(2264): Any amino acid
  MOD_RES (2274)..(2350): Any amino acid
  MOD_RES (2364)..(2480): Any amino acid
  MOD_RES (2489)..(2489): Any amino acid
  MOD_RES (2522)..(2581): Any amino acid
  MOD_RES (2594)..(2618): Any amino acid
  MOD_RES (2634)..(2658): Any amino acid
  MOD_RES (2673)..(2679): Any amino acid
  MOD_RES (2696)..(2752): Any amino acid
  MOD_RES (2770)..(2773): Any amino acid
  MOD_RES (2785)..(2820): Any amino acid
  MOD_RES (2834)..(2862): Any amino acid
  MOD_RES (2893)..(2912): Any amino acid
  MOD_RES (2936)..(3004): Any amino acid
  MOD_RES (3022)..(3038): Any amino acid
  MOD_RES (3049)..(3139): Any amino acid
  MOD_RES (3149)..(3161): Any amino acid
  MOD_RES (3175)..(3208): Any amino acid
  MOD_RES (3221)..(3283): Any amino acid
  MOD_RES (3299)..(3302): Any amino acid
  MOD_RES (3318)..(3319): Any amino acid
  MOD_RES (3328)..(3351): Any amino acid
  MOD_RES (3371)..(3391): Any amino acid
XXNQRKKAKTXXXXXXXXXXXXXXXXXXXXXXXXXXXXXXXXXXXXXXXXXXXXXXXXXXXXXXXXXXXXXXXXXXXXXXXXXXXXXXXXXXXXLNRRRRSVGXXXXXIPTAIAFHLTTXXXEPHMIVSIQEKGKSLLFKTENGINMCTLXXXXXXXXXXXTVTYKCPLLKQNXXXXXXXXXXXXXXWITYGTCTSTGEHRREXXXXXXXXXXXXXXXXXXXXXXXXXXXXXXXXXXXXXXLRHPGFAIMAAXXXXXIGTTHFQKTLIFILLTAIAPSMAMXXXXXXXXXXXXXXXXXXXXXXXXXXXXXXXXXXXXXXXXXXXLIKTEAKEPATLRKYXXXXXXXXXXXXXXXXTQGEPSLVEEQDKRFLCKHSMVDXXXXXXXXXXXXXXIVTCAMFTCLKNMKGKVVQPEXXXXXXXXXXXXGEEYAVGDDTGKHGKEIKITPQSPXAEAELTGYXXXXXXXXXXXXXXXXXXXXXXMESKAWLVHRXXXXXXXXXXLPGADTQESNWIQXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRVQYEGDGSPCKVPFEIMDLERRYILGRLITVNPIITEKDNPINIXXXXXXXXXXXXXXXXXXXXXXXXXXXXXXXXXXXXXXXXXXXXXXXXXXXXXXXXXLGGAFTSIXXXXXXXXXXXXXXXXXXXXXTMKIFIGVIXXXXXXXXXXXXXXXTLVLVGVITLYLGVMVQADTGXXXXXXXXXXXXXXXXXXXXXXXXXXXXXXXXXXXXXXXXXXIQKAHEDGICGIXXXXXXXXXXXXXXXXXXXXXLSENEVKMTIMTGEIKGIMQAGKRYLQPQPTELKXXXXTWGKAKILSTEXQNQTFLIDXXETVECPNTNRXXXXXXXXXXXXXXXXTNIWLRLREKQDXSCDSKLMSAAIKNNRAVHXXXXXXXXXXXXXXXXXXXXXFIEVKSCHWPRSHXXXXXXXXXXXXXIPKGFAGPVSQHNNRPGYHTQITGPWXXGKLEMDFEFCDGTTVVVTENCGNXXXXXXXXXXXXXXXXXXXXXXXXXXXXXXXXXXXXXXXXXXXXXXXXXXXXXXXXXXXXXXXXXXXXXGVLGMALLLXXXXXXXXXXXXXXXXXXXXXXXXXXXXXXFRDLGRVVVMVGTXMTDDIGIGVTYLXXXXXXKVRPTFAAGLLLKKXXXXXLMMATIGVVLLSQSXXPENILELTDALALGMMILKXVRSMEKYQLAVTIMTILCVPNAVILQHAWKVSCTILATVSVFPLLLTSSRQKAXXXXXXXXXXXXXXXXXXLTTLSRPNKIRSWPXXXXXXXXXXXXXXXXXXXXXXXXXXXXXXXXXXXXXXXXXXXXXXXLELEKAADVRWEDQAEIXXXXXXXXXXXXXXXXXXXXXXXXXXXXXXXXXXXXXXXSGLFPVSMPIXXXXXXXXXXXXXXXXXXXXVPSPPPIGXXXXXXXXXRIKQKGIFGYSQXXXXXXXXXXXXXXXXXXRGAVLTHKGKRIEXXXXXXXXXXXXXXXXXXXXXXXXXXXXXXXXXXXXXXXXXXXQTKPGLFKTSTGTIGXXXXXXXXXXXXXXXXXXXXXXXXXXXXXXXXXXXXXXXAIAQTEKGIEDNPEIEDHIFRKRRXXXXXXXXXXXXXXXXXXXXXXXXXXXXXXXXXXXXXXXXXXXXXXXXXXXXXXYQTTAIKTEHTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWNTGHEWITDFKGKTXXXXXXXXXXXXXXXXXXXXXXXXXXXXXKTFDTEYTKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWLAFKVASEGISYADRRWCFDGTRNNQILEXNIEVEIWTKXXXXXXXXXXXXXXXXXXXXXXXXXXXXXXXXXXXXXXXXXXXXXXXXXXXXXXXXXXXXXXXXXHTAEVGGRAHNHALSXXXXXXXXXXXXXXXXXXXXXXXXFLMSGRGVGKMTLXXXXXXTASILLWHAXXXXXXXXXXXXXXXXXXXXXXXXXXXXXXXXXXXXXXXXXXXXXXXXXXXXXXXXXXXXXXXXXXXXXXXXXQHESNILDIXXXXXXXXXXXXXXXXXXXXXXXXXXXXXXXXXXXXXXXXXXXXXXXXXXXXXXXXXXXXXXXXXXXXXXXXXXXXXTAALLLLMAHYAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIMRNTTSXRRGTGNVGETLGEKWKNRLNSLGKNEFQIYKKXXXXXXXXXXXXXXXXXXXXXXXXXXXXXXXXXXXXXXXXXXXXXXXXXXXXXXXXXXXXCGGLKSVREVKGXXXXXXXXXXXXXXXXXXXXXXXXXSGIDVFFTPPERCDTXXXXXXXXXXXXXXXXXXXXXXXXXVENWLGSNTQFCVKXXXXXXXSVIERMEAMQRKYGGAXXXXXXXXXXXXXXXXXXXXXXXXXXXXXXXXXXXXXXXXXXXXXXXXXXXXXXXXXTRNIGTESETPNMDIIGXXXXKIKQEHEASWHXXXXXXXXXXXXXXXXXXXXXXXXXXXXXXXXXXXXKPWDVLPMVTQMAXXXXXXXXXXXXXXXXXXXXXXXXXXXXXKLMRITAKWLWKELGRKKIPRMCTREEFARXXXXXXXXXXXXXXXXXXXXAREAVEDERFWELVERERNLHLDXXXXXXXXXXXXXXXXXXXXXXXXXXXXXXXXXXXXXXXXXXXXXXXXXXXXXXXXXXXXXXXXXXXXXKLGYILREISKKAGGAMXXXXXXXXXXXXXXXXXKNEEMITGQMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREGRERLSRXXXXXXXXXXXXXDDRFAKALTALNDXXXXXXXXXXXXXXXXXXXXXXXXXXXXXXXXXXMKDGRKLVVPCRXXXXXXXXXXXXXXXXXXXXXXXXXXXXXXXXXXXXXXXXXXXXXXXXXXXXXXXXXXXXXXXTTWSIHARHEWMTTEXXXXVWNRVWIQENPWIEDXXPVETWEEIXXXXXXXXXXXXXXXXXXXXXXXXRNIQTAINQVRSLIGSEEYXXXXXXXXXXXXXXXXXXXXX

SEQ ID NO: 265721 - protein, 3391 aa, Dengue virus
  MOD_RES (1)..(2): Any amino acid
  MOD_RES (11)..(94): Any amino acid
  MOD_RES (104)..(122): Any amino acid
  MOD_RES (137)..(142): Any amino acid
  MOD_RES (151)..(163): Any amino acid
  MOD_RES (174)..(241): Any amino acid
  MOD_RES (253)..(258): Any amino acid
  MOD_RES (270)..(272): Any amino acid
  MOD_RES (281)..(355): Any amino acid
  MOD_RES (369)..(403): Any amino acid
  MOD_RES (412)..(436): Any amino acid
  MOD_RES (448)..(480): Any amino acid
  MOD_RES (490)..(500): Any amino acid
  MOD_RES (514)..(607): Any amino acid
  MOD_RES (617)..(618): Any amino acid
  MOD_RES (640)..(704): Any amino acid
  MOD_RES (713)..(757): Any amino acid
  MOD_RES (772)..(821): Any amino acid
  MOD_RES (830)..(853): Any amino acid
  MOD_RES (863)..(865): Any amino acid
  MOD_RES (886)..(894): Any amino acid
  MOD_RES (903)..(903): Any amino acid
  MOD_RES (912)..(913): Any amino acid
  MOD_RES (924)..(941): Any amino acid
  MOD_RES (952)..(994): Any amino acid
  MOD_RES (1003)..(1020): Any amino acid
  MOD_RES (1039)..(1046): Any amino acid
  MOD_RES (1061)..(1176): Any amino acid
  MOD_RES (1185)..(1190): Any amino acid
  MOD_RES (1200)..(1231): Any amino acid
  MOD_RES (1242)..(1243): Any amino acid
  MOD_RES (1253)..(1263): Any amino acid
  MOD_RES (1274)..(1276): Any amino acid
  MOD_RES (1297)..(1297): Any amino acid
  MOD_RES (1306)..(1336): Any amino acid
  MOD_RES (1347)..(1395): Any amino acid
  MOD_RES (1413)..(1453): Any amino acid
  MOD_RES (1462)..(1481): Any amino acid
  MOD_RES (1490)..(1500): Any amino acid
  MOD_RES (1511)..(1586): Any amino acid
  MOD_RES (1600)..(1639): Any amino acid
  MOD_RES (1649)..(1822): Any amino acid
  MOD_RES (1831)..(1862): Any amino acid
  MOD_RES (1874)..(2035): Any amino acid
  MOD_RES (2044)..(2124): Any amino acid
  MOD_RES (2135)..(2163): Any amino acid
  MOD_RES (2176)..(2182): Any amino acid
  MOD_RES (2192)..(2264): Any amino acid
  MOD_RES (2273)..(2350): Any amino acid
  MOD_RES (2361)..(2480): Any amino acid
  MOD_RES (2489)..(2489): Any amino acid
  MOD_RES (2503)..(2503): Any amino acid
  MOD_RES (2518)..(2660): Any amino acid
  MOD_RES (2672)..(2760): Any amino acid
  MOD_RES (2770)..(2873): Any amino acid
  MOD_RES (2892)..(2913): Any amino acid
  MOD_RES (2934)..(3006): Any amino acid
  MOD_RES (3022)..(3208): Any amino acid
  MOD_RES (3221)..(3303): Any amino acid
  MOD_RES (3318)..(3361): Any amino acid
  MOD_RES (3370)..(3391): Any amino acid
XXDQRKKARNXXXXXXXXXXXXXXXXXXXXXXXXXXXXXXXXXXXXXXXXXXXXXXXXXXXXXXXXXXXXXXXXXXXXXXXXXXXXXXXXXXXXLNRRRRTVGXXXXXXXXXXXXXXXXXXXEPHMIVSKNEKGKSXXXXXXVGVNMCTLXXXXXXXXXXXXXTYNCPLLKQNXXXXXXXXXXXXXXXXXXXXXXXXXXXXXXXXXXXXXXXXXXXXXXXXXXXXXXXXXXXXXXXXXXXXLRHPGFTTMAAXXXXXXGTTHFQKALIFXXXTAIAPSMAXXXXXXXXXXXXXXXXXXXXXXXXXXXXXXXXXXXXXXXXXXXXXXXXXXXXXXXXXXXXXXXXXXXXXXXXXXXTQGEPSLVEEQDKXXXXXXXXXXXXXXXXXXXXXXXXXXXXXXXXXXXKMEGKVVQXXXXXXXXXXXXXXXXXXXXXXXXXKHGMEIKVTPQXXXXXXXXXXXXXXXXXXXXXXXXXXXXXXXXXMGNKAWLVHXXXXXXXXXXXLPGADIQGSNWIQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGEDSPCKIPXXIMDLEKRYILGRLITVNPIATXXXXXXXXXXXXXXXXXXXXXXXXXXXXXXXXXXXXXXXXXXXXXXXXXXXXXXXXXXXXXXXXXLGGVFTSMXXXXXXXXXXXXXXXXXXXXXXXXXXXXXXXXXXXXXXXXXXXXXTLVIVGVVILYLGAXXXXXXXXXXXXXXXXXXXXXXXXXXXXXXXXXXXXXXXXXXXXXXXXXXQKAYEEGIXXXXXXXXXXXXXXXXXXXXXXXXLTENEVKLTXXXGDIKGIMHAGRRSLRPQPTQXXXXXXXXXKAKMLSTGXHNRTFLIDXXKTTECPSSNRXXXXXXXXXXXXXXXXXXIWLRLKEKQDXXXXXXXXXXXXXXXXXXXXXXXXXXXXXXXXXXXXXXXXXXXVKSCHWPRXXXXXXXXXXXXXXXXXXNIAGPVSQHNYRLGYHTQXXXXXXXXKLEMDFNFCEGTTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFKDLGRVMXXXXXXMTDDIGIGVXXXXXXXXXXXXXXXXXXXXXXXXXXXXXXXXTIGVALLSQSXXPENILELTDXXXXXXXXXXXVKNLEKYQLAXXXMVISCVPNAVVLQNAWKVGCXILAAVSVFXXXXXXXXXXXXXXXXXXXXXXXXXXXXXXXTLTRTSKKRSXXXXXXXXXXXXXXXXXXXXXXXXXXXXXXXXXXXXXXXXXXXXXXXXXLELERAAEVKWEEQAEIXXXXXXXXXXXXXXXXXXXXXXXXXXXXXXXXXXXXXXXXXVFPVSIPVXXXXXXXXXXXXXXXXXXXXVPSPPPMEXXXXXXXXXXXKQKRILGYSQXXXXXXXXXXXXXXXXXXXXXXXXXXXXXXXXXXXXXXXXXXXXXXXXXXXXXXXXXXXXXXXXXXXXXXXXXXXXKPGFFRTNAGTIGXXXXXXXXXXXXXXXXXXXXXXXXXXXXXXXXXXXXXXXXIAQTETSVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEWITDFKXXXXXXXXXXXXXXXXXXXXXXXXXXXXXXXXKTFDTEYIKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKWCFDGIRXXXXXXXXXXXXXXXXXXXXXXXXXXXXXXXXXXXXXXXXXXXXXXXXXXXXXXXXXXXXXXXXXXXXXXXXXXXXXXXXXHSAEMGGRAYXXXXXXXXXXXXXXXXXXXXXXXXXXXXXFLMSARGIGKMTXXXXXXXTASSLLWYAXXXXXXXXXXXXXXXXXXXXXXXXXXXXXXXXXXXXXXXXXXXXXXXXXXXXXXXXXXXXXXXXXXXXXXXXXQHESNILDXXXXXXXXXXXXXXXXXXXXXXXXXXXXXXXXXXXXXXXXXXXXXXXXXXXXXXXXXXXXXXXXXXXXXXXXXXXXXXTAALLMLVAHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSIMKNTINXRRGTGTIGETLGEXWKSRLNTLGKSEFQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNWLKNNTQFCIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKPNLDIIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKELGKKKTPRVCTREEFTXXXXXXXXXXXXXXXXXXXXXXREAVEDNRFWELVERERNLHXXXXXXXXXXXXXXXXXXXXXXXXXXXXXXXXXXXXXXXXXXXXXXXXXXXXXXXXXXXXXXXXXXXXXXXXXGYILRDISKKEGGTMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKDGRMLVVPCRXXXXXXXXXXXXXXXXXXXXXXXXXXXXXXXXXXXXXXXXXXXXXXXXXXXXXXXXXXXXXXXXXXXXXXXXXXXXXXXXXXXWNKVWIQDNPWMEDXXXXXXXXXXXXXXXXXXXXXXXXXXXXXXXXXXXXXXXXXXXXRSLIGNEGXXXXXXXXXXXXXXXXXXXXXX

SEQ ID NO: 265722 - protein, 3391 aa, Dengue virus
  MOD_RES (104)..(108): Any amino acid
  MOD_RES (450)..(450): Any amino acid
  MOD_RES (903)..(903): Any amino acid
  MOD_RES (952)..(952): Any amino acid
  MOD_RES (1160)..(1165): Any amino acid
  MOD_RES (1190)..(1191): Any amino acid
  MOD_RES (1242)..(1243): Any amino acid
  MOD_RES (1263)..(1263): Any amino acid
  MOD_RES (2260)..(2264): Any amino acid
  MOD_RES (2489)..(2489): Any amino acid
  MOD_RES (3049)..(3049): Any amino acid
  MOD_RES (3122)..(3139): Any amino acid
MNNQRKKARSTPFNMLKRERNRVSTVQQLTKRFSLGMLQGRGPLKLFMALVAFLRFLTIPPTAGILKRWGTIKKSKAINVLRGFRKEIGRMLNILNRRRRTAGXXXXXIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSSXTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEXHNQTFLIDGPETAECPNTNRAWNSLEVEDYGFGVFTTNIWLKLREKQDXFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAXXXXXXSFVTLITGNMSFRDLGRVMVMVGAXXTDDIGMGVTYLALLAAFKVRPTFAAGLLLRKLTSKELMMATIGIALLSQSXXPETILELTDALALGMMVLKXVRNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASILLWYAQIQPHWIAASIILEFFLIVLLIPEPEKQRTPQDNQLTYVVIAILTVVAATMANEMGFLEKTKKDLGLGXXXXXEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNXRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMXGEHKKLAEAIFKLTYQNKVVRVQRPTPRGTVMDIISRRDQRGSGQVGTYGLNTFTNMEAQLIRQMEGEGIFKXXXXXXXXXXXXXXXXXXRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 265723 - protein, 3391 aa, Dengue virus
  MOD_RES (35)..(36): Any amino acid
  MOD_RES (104)..(108): Any amino acid
  MOD_RES (180)..(180): Any amino acid
  MOD_RES (219)..(224): Any amino acid
  MOD_RES (295)..(317): Any amino acid
  MOD_RES (382)..(389): Any amino acid
  MOD_RES (450)..(450): Any amino acid
  MOD_RES (492)..(497): Any amino acid
  MOD_RES (536)..(545): Any amino acid
  MOD_RES (569)..(579): Any amino acid
  MOD_RES (691)..(696): Any amino acid
  MOD_RES (837)..(837): Any amino acid
  MOD_RES (903)..(903): Any amino acid
  MOD_RES (952)..(952): Any amino acid
  MOD_RES (1074)..(1107): Any amino acid
  MOD_RES (1160)..(1165): Any amino acid
  MOD_RES (1190)..(1191): Any amino acid
  MOD_RES (1242)..(1243): Any amino acid
  MOD_RES (1263)..(1263): Any amino acid
  MOD_RES (1362)..(1391): Any amino acid
  MOD_RES (1515)..(1525): Any amino acid
  MOD_RES (1561)..(1581): Any amino acid
  MOD_RES (1604)..(1606): Any amino acid
  MOD_RES (1626)..(1626): Any amino acid
  MOD_RES (1697)..(1711): Any amino acid
  MOD_RES (1733)..(1739): Any amino acid
  MOD_RES (1757)..(1799): Any amino acid
  MOD_RES (1883)..(1884): Any amino acid
  MOD_RES (1902)..(1903): Any amino acid
  MOD_RES (1950)..(1985): Any amino acid
  MOD_RES (2003)..(2004): Any amino acid
  MOD_RES (2065)..(2066): Any amino acid
  MOD_RES (2084)..(2087): Any amino acid
  MOD_RES (2199)..(2200): Any amino acid
  MOD_RES (2214)..(2222): Any amino acid
  MOD_RES (2246)..(2247): Any amino acid
  MOD_RES (2260)..(2264): Any amino acid
  MOD_RES (2277)..(2282): Any amino acid
  MOD_RES (2300)..(2314): Any amino acid
  MOD_RES (2343)..(2344): Any amino acid
  MOD_RES (2367)..(2371): Any amino acid
  MOD_RES (2408)..(2409): Any amino acid
  MOD_RES (2427)..(2435): Any amino acid
  MOD_RES (2463)..(2475): Any amino acid
  MOD_RES (2489)..(2489): Any amino acid
  MOD_RES (2530)..(2552): Any amino acid
  MOD_RES (2578)..(2578): Any amino acid
  MOD_RES (2701)..(2707): Any amino acid
  MOD_RES (2725)..(2728): Any amino acid
  MOD_RES (2749)..(2749): Any amino acid
  MOD_RES (2793)..(2808): Any amino acid
  MOD_RES (2837)..(2857): Any amino acid
  MOD_RES (2944)..(2952): Any amino acid
  MOD_RES (2962)..(2983): Any amino acid
  MOD_RES (3026)..(3026): Any amino acid
  MOD_RES (3049)..(3049): Any amino acid
  MOD_RES (3070)..(3070): Any amino acid
  MOD_RES (3122)..(3139): Any amino acid
  MOD_RES (3230)..(3231): Any amino acid
  MOD_RES (3263)..(3267): Any amino acid
  MOD_RES (3336)..(3347): Any amino acid
MNNQRKKAKNTPFNMLKRERNRVSTIQQLTKRFSXXMLQGRGPLKLFMAFVAFLRFLTIPPTVGILKRWGTVKKSKAISVLRGFRREIGRMLNILNRRRRSAGXXXXXIPTVVAFHLTTRNGEPHMIVGINEKGKSLLFKTENGVNMCTLMAMDLGELCEDTITYNCPFLKQNEPEDIDXWCNSTSTWVTYGTCSAMGEHRREKRSVALVPHVRMGLEXXXXXXMSSEGAWKHAQRIETWVLRHPGFTMMAAILAYTIGTTHFQRVLIFILLAAVTPSMTMRCIGMSNRDFVEGXXXXXXXXXXXXXXXXXXXXXXXKPTLDFELIKTEAKHPATLRKFCVEAKLTNTTTASRCPTQGEPSLKEEQDKRFICRHSMVDRGWXXXXXXXXKGGIVTCAMFRCKKNMEGKVVLPENLEYTIVVTPHSGEENAVGNDTGKHGKEIKVTPQSSXAEAELTDYGTITMECSPRTSLDFNEMVLLQMENKAWLVHRQXXXXXXLPWLPGADKQESNWIQKEMLVTFKNPHAKRQDVVVLGSXXXXXXXXXXGATEIQMSLGNILFMGHLKCRLRXXXXXXXXXXXSMCTGKFKVVKEIAETQHGTIVIRVQYEGDDSPCKIPFEIMDLEKRYILGRLITVNPIVIEKDSPINIEAEPPFGDSYIIVGVEPGQLKLSWFKKGSSIGQMIETTMRGAKXXXXXXDTAWDFGSIGGVFTSVGKALHQVFGAIYGAAFSGVSWTMKILIGVVITWIGMNSRSTSLSVSLVLVGIVTLYLGAVVQADTGCIVSWKSKELKCGSGIFVTDNVHTWTEQYKFQPDSPSKLASAIQKAQEEDICGIRSVTXLENLMWKQITPELNHILAENEVKLTIMTGDIRGIMQVGRRSLRPQPTELKYSWKAWGKAKVLSTEXYNHTFLIDGPETTECPNSNRAWNSLEVEDYGFGVFTTNIWLKLKEKQDXICDSKLMSAAVKDDRAVHADMGYWIESALNDTWKIEKASFIEVKNCYWPRSHTLWSNGVLESEMIIPKNLAGPVSQHNYRPGYHTQIAGPWHLGKLEMDFDFCDGTTVIVTEECGNRGPSLXXXXXXXXXXXXXXXXXXXXXXXXXXXXXXXXXXMEIRPLKEKEENLVSSLVTAGHGQVDNFSLGILGMALLLEEMLRTRIGTKHAXXXXXXSFMTLITGNMSFKDLGRVVVMVGAXXADEMGMGITYLALLAAFRVRPTFAVGLFLRKLTSKELMMTTIGIVLLSQSXXPETVLELTDALALGMMALKXVRDLEKYQLAVTVMAILCVPNAVILRNAWKVSCTILAVVSVSPLFLTSSQQKTDWIPLVLTIKGLSPTAIFLTTLSRTNKTRSWPLNEAVMAVGMVSIXXXXXXXXXXXXXXXXXXXXXXXXXXXXXXRSADLELERATDVRWEEQAEISGSSPILSITIAEDGSMSIKNEEEEHILTILIRTGLLVISGLFPISMPITAAAWYLWETKKQRAGVLWDVPSPPPMERAELEDGAYRIKQRGIFGYSQIGAGXXXXXXXXXXXHVTRGAVLMHKGKRIEPSWADVRKDLVSYGGGWKLXXXXXXXXXXXXXXXXXXXXXRAVQTKPGIFKTNAGTIGAVSLXXXPGTSGSPIIDKKGKVVGLYXNGVVTRSGTYVSSIAQTEKSIEDNPDIEDDIFRKRKLTIMDLHPGAGKTKKYLPAIVREAIRRGLRTLILXXXXXXXXXXXXXXXGLPIRYQTPAIKTEHTGREIVXXXXXXXFTMRLLSPIRVPNYNLIXXXXXXXXXXXXXXXXXXXXXXXXXXXXXXXXXXXXXXXXXXXFPQSNAPIIDEEREIPERSWNSGHEWITNFKGKTVWFVPSIKTGNDIAACLRKNGKRVIQLSRKTFDSEYIKTRANDWDFVVTXXISEMGANFRAERVIDPRXXMKPVILTDGEERVVLAGPMPVTHFSAAQRRGRVGRNPRNENDQYIYXXXXXXXXXXXXXXXXXXXXXXXXXXXXXXXXXXXXPEREKVDAVDGEYRLRGXXRKTFVDLMKRGDLPVWLAYRVASEGINYADRKWCFDGVRNNQILEENMEVEVWTKEGERKXXKPRWLDARTYSDPLALKXXXXFAAGRKSLALSLITEMGRLPTFMTQKTRNALDNLAVLHTAEVGGKAYTHALSELPETLETLLLLGLLAAVTGGIFLFLMSGRGVGKMTLGMCCIVTASVLLWHAQIQPHWIXXSIILVFFLIVLLIXXXXXXXXXQDNQLTYVIIAILTLVAATMANEXXFLEKTKKDFGLGXXXXXQSEINILDIDLRXXXXXXLYAVATTFITPMLRHSIXXXXXXXXXXXXXXXATVLMGLGRGWPLSKMDIGAPLLAIGCYXXVNPITLTAALFLLIAHYAIIGPXXXXXATREAQKRTAAGIMKNPTVDGITVIDLEPIPYDPKFXXQLGQVMLLVLCVTQVLMXXXXXXXXXALTLATGPVSTLWEGNPGKFWNTTIAVXXXXXXXXXXXXXAGLLFSIMKNTTSXRRGTGNMGETLGEKWKNRLNALGKSEFQIYKRSGIQEVDRXXXXXXXXXXXXXXXXXXXXXXXLRWFVERNLVTPEGKVMDLGCGRGGXSYYCGGLKNVKEVKGLTKGGPGHEEPVPMSTYGWNLVRLQSGVDVFFIPPERCDTLLCDIGESSPNPTVEAGRTLRVLSLVENWLNNNTQFCVKVLNPYMPSVIEKMETLQRQFGGALVRNPXXXXXXXEMYWVSNASGNIVSSVNXXXXMLINRFTMRYKKTTYEPDVDXGSGTRNIGIENETPNMDIIGKRIEKIKQEHEISWHYDQDHPYRXXXXXXXXXXXXXXXXSSMVNGVVKLLTKPWDVLPTVTQMAMTDXXXXXXXXXXXXXXXXXXXXXKEGTKKLMRITAKWLWKELGKEKKPRICTREEFTKKVRSNAALGAVFTDENKWKSAREAVEDGRFWELVDRERNLHLDGKCETCVYXXXXXXXXXIGEFGKAKGXXXXXXXXXXXXXXXXXXXXXXNEDHWFSRGNSLSGVEGEGLHRLGYILRDVGRKAGGAMYADDXAGWDTRITIEDLKNEEMITNHMXGEHKRLAEAIFRLTYQNKVVXVQRPTPKGTVMDIISRKDQRGSGQVVTYGLNTFTNMGAQLIRQMEGEGVFKXXXXXXXXXXXXXXXXXXREGRERLARMAISGDDCVVKPIDDRFANALTALNDMGKIRKDIQQWEPSKGWSDWTQVPFCSHHFHELVMKDGRTLVVPCRSQDELIGRAXXSQGAGWSLRETACLGKSYAQMWTLMYFHRRDXXXXXNAICSAVPPHWVPTSRTTWSIHATHEWMTTEDMLTVWNRVWIRDNPWIEDKTPVESWEEIPYLGKREDXXXXXXXXXXXXATWAKNIQAAINQVRALIGEEGYIDYMPSMKRFRKEEEESGVLW

SEQ ID NO: 265724 - protein, 3392 aa, Dengue virus
  MOD_RES (19)..(43): Any amino acid
  MOD_RES (54)..(62): Any amino acid
  MOD_RES (88)..(92): Any amino acid
  MOD_RES (104)..(108): Any amino acid
  MOD_RES (154)..(157): Any amino acid
  MOD_RES (178)..(186): Any amino acid
  MOD_RES (205)..(225): Any amino acid
  MOD_RES (289)..(323): Any amino acid
  MOD_RES (380)..(391): Any amino acid
  MOD_RES (450)..(450): Any amino acid
  MOD_RES (466)..(480): Any amino acid
  MOD_RES (492)..(497): Any amino acid
  MOD_RES (517)..(548): Any amino acid
  MOD_RES (561)..(595): Any amino acid
  MOD_RES (689)..(699): Any amino acid
  MOD_RES (717)..(725): Any amino acid
  MOD_RES (750)..(755): Any amino acid
  MOD_RES (789)..(818): Any amino acid
  MOD_RES (834)..(839): Any amino acid
  MOD_RES (903)..(903): Any amino acid
  MOD_RES (925)..(930): Any amino acid
  MOD_RES (952)..(952): Any amino acid
  MOD_RES (1008)..(1012): Any amino acid
  MOD_RES (1073)..(1113): Any amino acid
  MOD_RES (1160)..(1165): Any amino acid
  MOD_RES (1190)..(1191): Any amino acid
  MOD_RES (1206)..(1206): Any amino acid
  MOD_RES (1242)..(1243): Any amino acid
  MOD_RES (1263)..(1263): Any amino acid
  MOD_RES (1331)..(1332): Any amino acid
  MOD_RES (1351)..(1393): Any amino acid
  MOD_RES (1430)..(1430): Any amino acid
  MOD_RES (1447)..(1448): Any amino acid
  MOD_RES (1466)..(1479): Any amino acid
  MOD_RES (1513)..(1525): Any amino acid
  MOD_RES (1543)..(1543): Any amino acid
  MOD_RES (1557)..(1583): Any amino acid
  MOD_RES (1603)..(1608): Any amino acid
  MOD_RES (1624)..(1630): Any amino acid
  MOD_RES (1670)..(1714): Any amino acid
  MOD_RES (1732)..(1799): Any amino acid
  MOD_RES (1850)..(1861): Any amino acid
  MOD_RES (1883)..(1908): Any amino acid
  MOD_RES (1919)..(1932): Any amino acid
  MOD_RES (1945)..(2015): Any amino acid
  MOD_RES (2061)..(2089): Any amino acid
  MOD_RES (2105)..(2107): Any amino acid
  MOD_RES (2141)..(2147): Any amino acid
  MOD_RES (2178)..(2182): Any amino acid
  MOD_RES (2192)..(2228): Any amino acid
  MOD_RES (2240)..(2249): Any amino acid
  MOD_RES (2260)..(2264): Any amino acid
  MOD_RES (2275)..(2346): Any amino acid
  MOD_RES (2367)..(2390): Any amino acid
  MOD_RES (2402)..(2478): Any amino acid
  MOD_RES (2489)..(2489): Any amino acid
  MOD_RES (2527)..(2554): Any amino acid
  MOD_RES (2572)..(2578): Any amino acid
  MOD_RES (2596)..(2617): Any amino acid
  MOD_RES (2635)..(2655): Any amino acid
  MOD_RES (2675)..(2678): Any amino acid
  MOD_RES (2700)..(2729): Any amino acid
  MOD_RES (2747)..(2751): Any amino acid
  MOD_RES (2771)..(2772): Any amino acid
  MOD_RES (2790)..(2817): Any amino acid
  MOD_RES (2835)..(2861): Any amino acid
  MOD_RES (2901)..(2911): Any amino acid
  MOD_RES (2937)..(2996): Any amino acid
  MOD_RES (3024)..(3026): Any amino acid
  MOD_RES (3049)..(3049): Any amino acid
  MOD_RES (3063)..(3110): Any amino acid
  MOD_RES (3122)..(3139): Any amino acid
  MOD_RES (3156)..(3161): Any amino acid
  MOD_RES (3176)..(3183): Any amino acid
  MOD_RES (3198)..(3208): Any amino acid
  MOD_RES (3221)..(3282): Any amino acid
  MOD_RES (3335)..(3347): Any amino acid
  MOD_RES (3391)..(3392): Any amino acid
MNNQRKKARTTPFNMLKRXXXXXXXXXXXXXXXXXXXXXXXXXLRLFMALVAFXXXXXXXXXTGILKRWGTIKKSKAINVLRGFRREXXXXXNILNKRRRTAGXXXXXIPTVIAFHLTTRNGEPHMIVSKNEKGKSLLFKTKDGTNMCTLMAMXXXXLCEDTITYKCPLLKQNEPEDXXXXXXXXXTWVTYGTCATMGEHRREKXXXXXXXXXXXXXXXXXXXXXSSEGAWKHAQRIETWILRHPGFTLMAAVLAYTVGTTYFQRALIFILLTAIAPSMAMRCIGISNXXXXXXXXXXXXXXXXXXXXXXXXXXXXXXXXXXXELIKTEAKQPATLRKYCIEAKLTNTTTDSRCPTQGEPTLSEEQDKRFVCRHSMVDRXXXXXXXXXXXXGIVTCAMFTCLKNMEGKVVQPENLEYTVVITPHSGEEHAVGNDTGKHGQEVKITPQSSXAEAELTGYGTITMECXXXXXXXXXXXXXXXMEEKAWLVHRQXXXXXXLPWLPGADKQGSNWIQKEMXXXXXXXXXXXXXXXXXXXXXXXXXXXXXXXXEIQMSSGNILFMXXXXXXXXXXXXXXXXXXXXXXXXXXXXXXXXXXXQHGTIVIRIQYEGDGSPCRVPFEITDLEKKYILGRLITVNPIVAGKDNPINIEAEPPFGDSYIVIGVEPGQLKLDWFKKGSSIGQMFATTMRGXXXXXXXXXXXWDFGSLGGAFTSIGKALXXXXXXXXXVAFNGVSWTMKILIGAIITWIGMNXXXXXXSVSLVLVGVVTLYLGAMVQADSGCVVSWKSKELXXXXXXXXXXXXXXXXXXXXXXXXXXXXXXSAIQKAHEEDICGIRXXXXXXNLMWRQITSELNHILSENEAKLTIMTGDTKGIMQAGKRSLKPQPTELRYSWKTWGKAKMLPTEXHNRTFLIDGPETTECPNSNRAXXXXXXEDYGFGVFSTNIWLKLKERQDXSCDSKLMSAAVKNNRAVHADMGYWMESRLNDTWKMEKASFIEIKSCHWPRSHTLWXXXXXESEMVIPKSFAGPVSQHNNRPGYYTQTTGPWHLGRLEMDFDLCDGTTVVVTENCGNRGPSXXXXXXXXXXXXXXXXXXXXXXXXXXXXXXXXXXXXXXXXXKEREENLVNSLVTAGQGQIDNFSLGILGMALLLEEMLKTRVGTKHAXXXXXXSLVTLITGNLSFKDLGRVIIMVGAXXTDDIGIGVTYLALLXAFRVRPTFAAGLLLKKLTSKELLMATIGITLLSQSXXPGTVLELTDAIALGIMVLKXVRKMEKYQLAVTIMTMLCIPNVMILQHAWKVGCTTLATVSVSPLILTSSRQKTDWIPLALTIKGLSPXXIFLTTLSRPNKTRSWPLNXXXXXXXXXXXXXXXXXXXXXXXXXXXXXXXXXXXXXXXXXXXADLELEKAAEVKWDDQAEISGSSPILSVTISEDGSMXIKNEEEEQILTILIRTXXLVISGLFPVSMPITAAAXXXXXXXXXXXXXXWDVPSPPPVGRAELEDGAYRIKQRRILGYSQIGXXXXXXXXXXXXXHVTRGAVLVHKGKRIEPXWADVKKDLVSYGGXXXXXXXXXXXXXXXXXXXXXXXXXXXVQTKPGLFRTSTGTIGAVSXXXXXXTSGSPIVDKKGKVVGXXXXXXXTRSGTYVSAIAQTEKNVENNPEIEDDIFRKRKLTIMDLHXXXXXXXXXXXXXXXXXXXXXXXXXXXXXXXXXXXXXXXXXXXXXIRYQTPAIKAEHTGREIXXXXXXXXXXXXXXXXXXXXXXXXXXXXXXXXXXXXXXXXXXXXXXXXXXXXXXXXXXXXXXXXXXXXFPQSNAPIVDEEREIPERSWSTGHEWITNFEGKTVWFVPSIRAGNDIAACXXXXXXXXXXXXRKTFDTEYTKTRSNDWDFVVTXXXXXXXXXXXXXXXXXXXXXXXXXXLTEGEERVILXXXXXXXXXXXXXXRGRIGRNPRNENXXXXXXXXXXXXXXXXXXXXXXXXXXXXXXXXXXXXXXXXXXXXXXXXXXXXXXXXXXXXXXXXXXXXXXXDLPVWLAYKVAAEGINYTDRRWCFDGIRNNQILEENMEVEVWTKEXXXXXXXXXXXXXXXXXXXXXXXXXXXXXAGRKSLTLSLITEMGXXXTFMTQKARDALDNLAVLHTAEAGGKAYTHALSEXXXXXXXLLLLTLLAAVTGGIFLFLMSGKGVGKMTLGXXXXXTASGLLWYAXXXXXXXXXXXXXXXXXXXXXXXXXXXXXXXXXXXXXYVVIAILTLVAXXXXXXXXXXEKTKKDLGFGXXXXXEPEINILDIDXXXXXXXXXXXXXXXXXXXXXXXXXXXXXXXXXXXXXXXXXXXXXXXXXXXXXXXXXXXXXXXXXXXXXXXXPITLTAALLSLMAHYAIIGPXXXXXXXXXXXXXXXXXXXXXXXXDGVTVIDLDPIXXXXXXXXXXXXXXXXXXXXXXXXXXXXXXXXXXXXXXXXXXXXXXXXXXXXXXXXXXXXXXXXXXXXXXXXXXXXXLFSIMKNTANXRRGTGNTGETLGEKWKSRLNALGRSEFQTYKKSGIQEXXXXXXXXXXXXXXXXXXXXXXXXXXXXWFVERNLVAPEGKVVDLXXXXXXXSYYCGGLKDVREVKGLTXXXXXXXXXXXXXXXXXXXXXXQSGVDVFFVPPEKCDTLXXXXXXXXXXXXXXXXXXXXXLNLVENWLNNDTQFCIKVLXXXXPSVIERMETLQRKFGGALVRNXXXXXXXXXXXXXXXXXXXXXXXXXXXXXXLINRFTMRHKKTTYEPDXXXXXGTRNIGIECEVPNLDIIGKXXEKIKEEHEASWHYDQDHXXXXXXXXXXXXXXXXXXXXXXXXXXXXLLTKPWDVIPMVTQMAMXXXXXXXXXXXXXXXXXXXXXXXXXXXKKLMRITAEWLWGELGRRKTPRICTRAEFCNKVRSNAALXXXXXXXXXXXSAREAVEDSGFWELIEKERNLHLDGXXXXXXXXXXXXXXXXXXXXXXXXXXXXXXXXXXXXXXXXXXXXXXXXXXXXXXXXXXXXGVEGEGLHRLGYILREISKKAGGAMYAXXXAGWDTRITSEDLKNEEMITDQMXGRHKKLAEAIFRLXXXXXXXXXXXXXXXXXXXXXXXXXXXXXXXXXXXXXXXXXXXXXXXXIRQMEGEGLFKXXXXXXXXXXXXXXXXXXRVGRERLTRMAISGDDXXXXXXDDRFARALTALNDMXXXXXXXXQWEPSKGWSDWTQVXXXXXXXXXXXMKDGRILVVPCRXXXXXXXXXXXXXXXXXXXXXXXXXXXXXXXXXXXXXXXXXXXXXXXXXXXXXXXXXXXXXXRTTWSIHASHEWMTTEDMLTVWNRVWILENPWMEEKTPVESWEDIPYLGKREXXXXXXXXXXXXXATWAKNIQVAINQVRSLMGNEEYIDYMPSMKRFRSEEEESGVLXX

SEQ ID NO: 265725 - protein, 3391 aa, Dengue virus
  MOD_RES (1)..(1): Any amino acid
  MOD_RES (11)..(70): Any amino acid
  MOD_RES (83)..(93): Any amino acid
  MOD_RES (104)..(108): Any amino acid
  MOD_RES (121)..(121): Any amino acid
  MOD_RES (154)..(160): Any amino acid
  MOD_RES (175)..(186): Any amino acid
  MOD_RES (205)..(232): Any amino acid
  MOD_RES (253)..(256): Any amino acid
  MOD_RES (283)..(323): Any amino acid
  MOD_RES (342)..(354): Any amino acid
  MOD_RES (380)..(391): Any amino acid
  MOD_RES (415)..(420): Any amino acid
  MOD_RES (450)..(450): Any amino acid
  MOD_RES (460)..(480): Any amino acid
  MOD_RES (492)..(499): Any amino acid
  MOD_RES (517)..(600): Any amino acid
  MOD_RES (649)..(703): Any amino acid
  MOD_RES (714)..(732): Any amino acid
  MOD_RES (744)..(756): Any amino acid
  MOD_RES (786)..(819): Any amino acid
  MOD_RES (834)..(852): Any amino acid
  MOD_RES (903)..(903): Any amino acid
  MOD_RES (913)..(914): Any amino acid
  MOD_RES (925)..(936): Any amino acid
  MOD_RES (952)..(952): Any amino acid
  MOD_RES (972)..(990): Any amino acid
  MOD_RES (1006)..(1017): Any amino acid
  MOD_RES (1070)..(1136): Any amino acid
  MOD_RES (1148)..(1150): Any amino acid
  MOD_RES (1160)..(1166): Any amino acid
  MOD_RES (1190)..(1191): Any amino acid
  MOD_RES (1204)..(1206): Any amino acid
  MOD_RES (1224)..(1226): Any amino acid
  MOD_RES (1242)..(1243): Any amino acid
  MOD_RES (1263)..(1263): Any amino acid
  MOD_RES (1318)..(1333): Any amino acid
  MOD_RES (1350)..(1394): Any amino acid
  MOD_RES (1414)..(1450): Any amino acid
  MOD_RES (1463)..(1480): Any amino acid
  MOD_RES (1490)..(1497): Any amino acid
  MOD_RES (1512)..(1527): Any amino acid
  MOD_RES (1543)..(1583): Any amino acid
  MOD_RES (1601)..(1637): Any amino acid
  MOD_RES (1664)..(1715): Any amino acid
  MOD_RES (1729)..(1817): Any amino acid
  MOD_RES (1835)..(1861): Any amino acid
  MOD_RES (1874)..(2018): Any amino acid
  MOD_RES (2061)..(2123): Any amino acid
  MOD_RES (2141)..(2162): Any amino acid
  MOD_RES (2178)..(2182): Any amino acid
  MOD_RES (2192)..(2264): Any amino acid
  MOD_RES (2275)..(2347): Any amino acid
  MOD_RES (2365)..(2479): Any amino acid
  MOD_RES (2489)..(2489): Any amino acid
  MOD_RES (2523)..(2560): Any amino acid
  MOD_RES (2570)..(2580): Any amino acid
  MOD_RES (2595)..(2617): Any amino acid
  MOD_RES (2635)..(2657): Any amino acid
  MOD_RES (2674)..(2678): Any amino acid
  MOD_RES (2697)..(2736): Any amino acid
  MOD_RES (2746)..(2751): Any amino acid
  MOD_RES (2771)..(2772): Any amino acid
  MOD_RES (2786)..(2819): Any amino acid
  MOD_RES (2835)..(2861): Any amino acid
  MOD_RES (2897)..(2911): Any amino acid
  MOD_RES (2937)..(3003): Any amino acid
  MOD_RES (3023)..(3037): Any amino acid
  MOD_RES (3049)..(3139): Any amino acid
  MOD_RES (3150)..(3161): Any amino acid
  MOD_RES (3176)..(3208): Any amino acid
  MOD_RES (3221)..(3282): Any amino acid
  MOD_RES (3300)..(3301): Any amino acid
  MOD_RES (3329)..(3350): Any amino acid
  MOD_RES (3371)..(3391): Any amino acid
XNNQRKKAKTXXXXXXXXXXXXXXXXXXXXXXXXXXXXXXXXXXXXXXXXXXXXXXXXXXXXXXXXXXXXAIKKSKAINILRXXXXXXXXXXXILNRRRRSVGXXXXXIPTAIAFHLTTRXGEPHMIVSIQEKGKSLLFKTENGINMCTLMAMXXXXXXXDTVTYKCPLLKQNEXXXXXXXXXXXXTWITYGTCTSTGEHRREKXXXXXXXXXXXXXXXXXXXXXXXXXXXXQAQRIETWILRHPGFAIMAAXXXXTIGTTHFQRTLIFILLTTVAPSMTMRXXXXXXXXXXXXXXXXXXXXXXXXXXXXXXXXXXXXXXXXXELTKTEAKESATLRKYCIXXXXXXXXXXXXXPTQGEPSLVEEQDKRFLCKHSMVDRXXXXXXXXXXXXGIVTCAMFTCKKKMKGKVVQPENXXXXXXVTPHSGEEHSVGDDTGKHGKEIKITPQSPXSEAELTDYGXXXXXXXXXXXXXXXXXXXXXMESKAWLVHRQXXXXXXXXWLPGADTQESNWIQKEMXXXXXXXXXXXXXXXXXXXXXXXXXXXXXXXXXXXXXXXXXXXXXXXXXXXXXXXXXXXXXXXXXXXXXXXXXXXXXXXXXXXXVVRLQYEGDGSPCKVPFEIMDLERRYILGRLITVNPIITEKDNPINIEXXXXXXXXXXXXXXXXXXXXXXXXXXXXXXXXXXXXXXXXXXXXXXXXXXXXXXXSLGGAFTSIGXXXXXXXXXXXXXXXXXXXWIMKIFIGVIIXXXXXXXXXXXXXVTLVLVGVITLYLGVMVQADSGCIVSWKNXXXXXXXXXXXXXXXXXXXXXXXXXXXXXXXXXXAIQKAYEEGICGIRXXXXXXXXXXXXXXXXXXXILSENEVKLTIMTGEIKGIMQAGKRYLQPQPTQLKYSWKTWGKAKILSTEXQNQTFLIDGXXTVECPNTNRAXXXXXXXXXXXXIFTTNIWLRLREKQDXVCDSKLMSAAIKNNRAVHAXXXXXXXXXXXXXXXXXXXSFIEVKSCHWPRSHTXXXXXXXXXXXXIPKGFAGPVSQHNYRPGYHTQITGPWHLGKLEMDFEFCDGTTVVVTENCGNRXXXXXXXXXXXXXXXXXXXXXXXXXXXXXXXXXXXXXXXXXXXXXXXXXXXXXXXXXXXXXXXXXXXLGVLGMALLLEXXXRTRMGTKHAXXXXXXXFVTLITGNLSFRDLGRVVVMVGTXXTDDIGIGVTYLAXXXAYKVRPTFAAGLLLKKLXXXELMMATIGVVLLSQSXXPESILELTDALALGMMILKXVRSMEKYQLAVTIMVILCVPNAVILLNAWKVSCTILATVSVSPLLLTSSRQKADXXXXXXXXXXXXXXXXFLTTLSRPNKIRSWPLXXXXXXXXXXXXXXXXXXXXXXXXXXXXXXXXXXXXXXXXXXXXXDLELEKAADVRWEDQAEISXXXXXXXXXXXXXXXXXXXXXXXXXXXXXXXXXXXXXISGLFPVSMPITXXXXXXXXXXXXXXXXXXDVPSPPPIGXXXXXXXXYRIKQKGIFGYSQIXXXXXXXXXXXXXXXXTRGAVLTHKGKRIEPXXXXXXXXXXXXXXXXXXXXXXXXXXXXXXXXXXXXXXXXXVQTKPGLFKTSTGTIGAXXXXXXXXXXXXXXXXXXXXXXXXXXXXXXXXXXXXXSAIAQTEKGIEDNPEIEDHIFRKRRLXXXXXXXXXXXXXXXXXXXXXXXXXXXXXXXXXXXXXXXXXXXXXXXXXXXXRYQTTAIKTEHTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSWNSGYEWITDFKGKTVXXXXXXXXXXXXXXXXXXXXXXXXXXXRKTFDSEYAKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVWLAFKVASEGISYADRRWCFDGTRNNQILEENIEVEIWTKEXXXXXXXXXXXXXXXXXXXXXXXXXXXXXXXXXXXXXXXXXXXXXXXXXXXXXXXXXXXXXXXLHTAEVGGRAHNHALSEXXXXXXXXXXXXXXXXXXXXXXLFLMSGRGVGKMTLGXXXXXTASILLWHAXXXXXXXXXXXXXXXXXXXXXXXXXXXXXXXXXXXXXXXXXXXXXXXXXXXXXXXXXXXXXXXXXXXXXXXXXQHESNILDIDXXXXXXXXXXXXXXXXXXXXXXXXXXXXXXXXXXXXXXXXXXXXXXXXXXXXXXXXXXXXXXXXXXXXXXXXXVTLTAALLLLMAHYAIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSIMRNTTSXRRGTGNVGETLGEKWKNRLNSLGKNEFQIYKKSXXXXXXXXXXXXXXXXXXXXXXXXXXXXXXXXXXXXXXMVAPEGKVVXXXXXXXXXXXYCGGLKSVREVKGLXXXXXXXXXXXXXXXXXXXXXXXQSGIDVFFTPPERCDTLXXXXXXXXXXXXXXXXXXXXXXXLVENWLGSNTQFCVKVXXXXXPSVIERMEALQRRYGGALXXXXXXXXXXXXXXXXXXXXXXXXXXXXXXXXXXXXXXXXRHKRATYEPXXXXXXGTRNIGTESETPNMDIIGKXXEKIKQEHEASWHYXXXXXXXXXXXXXXXXXXXXXXXXXXXXXXXXXXTKPWDVLPMVTQMAMXXXXXXXXXXXXXXXXXXXXXXXXXXXKKLMKITAKWLWKELGRKKIPRVCTREEFARKVRSXXXXXXXXXXXXXXXSAREAVEDERFWELVERERNLHLDGXXXXXXXXXXXXXXXXXXXXXXXXXXXXXXXXXXXXXXXXXXXXXXXXXXXXXXXXXXXXXXXXXXXHKLGYILREISKKAGGAMYXXXXXXXXXXXXXXXLKNEEMITGQMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREGRERLSRMXXXXXXXXXXXXDDRFAKALTALNDMXXXXXXXXXXXXXXXXXXXXXXXXXXXXXXXXXMKDGRKLVVPCRXXXXXXXXXXXXXXXXXXXXXXXXXXXXXXXXXXXXXXXXXXXXXXXXXXXXXXXXXXXXXXRTTWSIHARHEWMTTEDXXTVWNRVWIQENPWIEDKTPVETWEEIPXXXXXXXXXXXXXXXXXXXXXXARNIQTAINQVRSLIGSEEYXXXXXXXXXXXXXXXXXXXXX

SEQ ID NO: 265726 - protein, 3391 aa, Dengue virus
  MOD_RES (1)..(1): Any amino acid
  MOD_RES (11)..(93): Any amino acid
  MOD_RES (104)..(121): Any amino acid
  MOD_RES (138)..(142): Any amino acid
  MOD_RES (154)..(163): Any amino acid
  MOD_RES (175)..(241): Any amino acid
  MOD_RES (253)..(258): Any amino acid
  MOD_RES (282)..(330): Any amino acid
  MOD_RES (340)..(354): Any amino acid
  MOD_RES (370)..(395): Any amino acid
  MOD_RES (413)..(435): Any amino acid
  MOD_RES (449)..(480): Any amino acid
  MOD_RES (491)..(499): Any amino acid
  MOD_RES (515)..(601): Any amino acid
  MOD_RES (640)..(703): Any amino acid
  MOD_RES (714)..(733): Any amino acid
  MOD_RES (743)..(756): Any amino acid
  MOD_RES (772)..(820): Any amino acid
  MOD_RES (831)..(852): Any amino acid
  MOD_RES (887)..(893): Any amino acid
  MOD_RES (903)..(903): Any amino acid
  MOD_RES (913)..(914): Any amino acid
  MOD_RES (925)..(938): Any amino acid
  MOD_RES (952)..(993): Any amino acid
  MOD_RES (1004)..(1019): Any amino acid
  MOD_RES (1039)..(1045): Any amino acid
  MOD_RES (1061)..(1175): Any amino acid
  MOD_RES (1187)..(1191): Any amino acid
  MOD_RES (1201)..(1207): Any amino acid
  MOD_RES (1223)..(1231): Any amino acid
  MOD_RES (1242)..(1243): Any amino acid
  MOD_RES (1255)..(1263): Any amino acid
  MOD_RES (1275)..(1278): Any amino acid
  MOD_RES (1293)..(1297): Any amino acid
  MOD_RES (1314)..(1333): Any amino acid
  MOD_RES (1348)..(1394): Any amino acid
  MOD_RES (1414)..(1452): Any amino acid
  MOD_RES (1463)..(1480): Any amino acid
  MOD_RES (1490)..(1499): Any amino acid
  MOD_RES (1512)..(1585): Any amino acid
  MOD_RES (1601)..(1638): Any amino acid
  MOD_RES (1656)..(1821): Any amino acid
  MOD_RES (1832)..(1861): Any amino acid
  MOD_RES (1874)..(2022): Any amino acid
  MOD_RES (2032)..(2034): Any amino acid
  MOD_RES (2045)..(2123): Any amino acid
  MOD_RES (2135)..(2162): Any amino acid
  MOD_RES (2177)..(2182): Any amino acid
  MOD_RES (2192)..(2264): Any amino acid
  MOD_RES (2274)..(2347): Any amino acid
  MOD_RES (2365)..(2479): Any amino acid
  MOD_RES (2489)..(2489): Any amino acid
  MOD_RES (2522)..(2624): Any amino acid
  MOD_RES (2634)..(2658): Any amino acid
  MOD_RES (2673)..(2760): Any amino acid
  MOD_RES (2771)..(2865): Any amino acid
  MOD_RES (2892)..(2912): Any amino acid
  MOD_RES (2935)..(3004): Any amino acid
  MOD_RES (3023)..(3208): Any amino acid
  MOD_RES (3221)..(3301): Any amino acid
  MOD_RES (3319)..(3360): Any amino acid
  MOD_RES (3371)..(3391): Any amino acid
XNDQRKKARNXXXXXXXXXXXXXXXXXXXXXXXXXXXXXXXXXXXXXXXXXXXXXXXXXXXXXXXXXXXXXXXXXXXXXXXXXXXXXXXXXXXILNRRRRTVGXXXXXXXXXXXXXXXXXXGEPHMIVSKNEKGKSLXXXXXVGTNMCTLMALXXXXXXXXXXTYNCPLLKQNEXXXXXXXXXXXXXXXXXXXXXXXXXXXXXXXXXXXXXXXXXXXXXXXXXXXXXXXXXXXXXXXXXXXLRHPGFTTMAAXXXXXXGTTHFQKVLIFILLTAIAPSMAMXXXXXXXXXXXXXXXXXXXXXXXXXXXXXXXXXXXXXXXXXXXXXXXXXKQSATLRKYXXXXXXXXXXXXXXXPTQGEPSLSEEQDKRXXXXXXXXXXXXXXXXXXXXXXXXXXCAKFSCKKNMKGKVVQPXXXXXXXXXXXXXXXXXXXXXXXGKHGMEIKVTPQSXXXXXXXXXXXXXXXXXXXXXXXXXXXXXXXXMGNKAWLVHRXXXXXXXXXWLPGADIQGSNWIQKXXXXXXXXXXXXXXXXXXXXXXXXXXXXXXXXXXXXXXXXXXXXXXXXXXXXXXXXXXXXXXXXXXXXXXXXXXXXXXXXXXXXXXXIRLQYEGDGSPCKTPFEIMDLEKRYILGRLITVNPIATXXXXXXXXXXXXXXXXXXXXXXXXXXXXXXXXXXXXXXXXXXXXXXXXXXXXXXXXXXXXXXXXSLGGMFTSIGXXXXXXXXXXXXXXXXXXXXTMKIFIGVIXXXXXXXXXXXXXXVSLILVGVVILYLGAXXXXXXXXXXXXXXXXXXXXXXXXXXXXXXXXXXXXXXXXXXXXXXXXXIQKAHEDGICXXXXXXXXXXXXXXXXXXXXXXILTENEVKMTIMTGDIKGIMHAGRRSLRPQPTQLXXXXXXXGKAKMLSTGXHNRTFLIDGXXTTECPSSNRAXXXXXXXXXXXXXXTTNIWLRLKEKQDXXXXXXXXXXXXXXXXXXXXXXXXXXXXXXXXXXXXXXXXXXEVKSCHWPRSXXXXXXXXXXXXXXXXKNIAGPVSQHNNRPGYYTQXXXXXXXGKLEMDFNFCEGTTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSFKDLGRVMVMXXXXXTDDIGIGVTXXXXXXXFKVRPTFVAGLLLRKXXXXXXXXXTIGVALLSQSXXPENILELTDALXXXXXXXXXVKNLEKYQLAVXXXXISCVPNAVVLQNAWXXXXXILAAVSVFPLLLTSSQXXXXXXXXXXXXXXXXXXXXFLTTLTRTSKKRSWXXXXXXXXXXXXXXXXXXXXXXXXXXXXXXXXXXXXXXXXXXXXXXXDLELERAAEVKWEEQAEISXXXXXXXXXXXXXXXXXXXXXXXXXXXXXXXXXXXXXXXGVFPVSIPVTXXXXXXXXXXXXXXXXXXDVPSPPPMEXXXXXXXXXXIKQKRILGYSQIXXXXXXXXXXXXXXXXXXXXXXXXXXXXXXXXXXXXXXXXXXXXXXXXXXXXXXXXXXXXXXXXXXXXXXXXXXTKPGFFRTNAGTIGAXXXXXXXXXXXXXXXXXXXXXXXXXXXXXXXXXXXXXXSIAQTETSIEDNPEIEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGHEWITNFEGXXXXXXXXXXXXXXXXXXXXXXXXXXXXXXRKTFDTEYIKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYKVASEGISXXXRKWCFDGIRNXXXXXXXXXXXXXXXXXXXXXXXXXXXXXXXXXXXXXXXXXXXXXXXXXXXXXXXXXXXXXXXXXXXXXXXXXXXXXXXLHSAEMGGRAYXXXXXXXXXXXXXXXXXXXXXXXXXXXXLFLMSARGIGKMTLXXXXXXTASSLLWYAXXXXXXXXXXXXXXXXXXXXXXXXXXXXXXXXXXXXXXXXXXXXXXXXXXXXXXXXXXXXXXXXXXXXXXXXXQHESNILDIXXXXXXXXXXXXXXXXXXXXXXXXXXXXXXXXXXXXXXXXXXXXXXXXXXXXXXXXXXXXXXXXXXXXXXXXXXTTLTAALLSLIAHYAIIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFSIMKNTINXRRGTGTIGETLGEKWKSRLNTLGKNEFQIYKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFIPPERCDTXXXXXXXXXXXXXXXXXXXXXXXXXVENWLNNNTKFCIKXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKPNLDIIGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRITAKWLWKELGKKKTPRMCTREEFAXXXXXXXXXXXXXXXXXXXXXAREAVEDNRFWELVERERNLHLXXXXXXXXXXXXXXXXXXXXXXXXXXXXXXXXXXXXXXXXXXXXXXXXXXXXXXXXXXXXXXXXXXXXXXKLGYILRDVSRKAGGAIYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKDGRMLVVPCRXXXXXXXXXXXXXXXXXXXXXXXXXXXXXXXXXXXXXXXXXXXXXXXXXXXXXXXXXXXXXXXXXXXXXXXXXXXXXXXXXTVWNKVWIQDNPWMEDKXXXXXXXXXXXXXXXXXXXXXXXXXXXXXXXXXXXXXXXXXXVRSLIGNEGYXXXXXXXXXXXXXXXXXXXXX

SEQ ID NO: 265727 - protein, 3391 aa, Dengue virus
  MOD_RES (104)..(108): Any amino acid
  MOD_RES (449)..(450): Any amino acid
  MOD_RES (903)..(903): Any amino acid
  MOD_RES (952)..(952): Any amino acid
  MOD_RES (1160)..(1165): Any amino acid
  MOD_RES (1190)..(1191): Any amino acid
  MOD_RES (1242)..(1243): Any amino acid
  MOD_RES (1263)..(1265): Any amino acid
  MOD_RES (2186)..(2186): Any amino acid
  MOD_RES (2260)..(2264): Any amino acid
  MOD_RES (2489)..(2489): Any amino acid
  MOD_RES (3049)..(3049): Any amino acid
  MOD_RES (3122)..(3139): Any amino acid
MNNQRKKARSTPFNMLKRERNRVSTVQQLTKRFSLGMLQGRGPLKLFMALVAFLRFLTIPPTAGILKRWGTIKKSKAINVLRGFRKEIGRMLNILNRRRRTAGXXXXXIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSXXTEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQAGKRSLRPQPTELKYSWKTWGKAKMLSTEXHNQTFLIDGPETAECPNTNRAWNSLEVEDYGFGVFTTNIWLKLREKQDXFCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAXXXXXXSFVTLITGNMSFRDLGRVMVMVGAXXTDDIGMGVTYLALLAAFKVRPTFAAGLLLRKLTSKELMMATIGIALLSQSXXPETILELTDALALGMMVLKXXXNMEKYQLAVTIMAISCVPNAVILQNAWKVSCTILAAVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASXLLWYAQIQPHWIAASIILEFFLIVLLIPEPEKQRTPQDNQLTYVVIAILTVVAATMANEMGFLEKTKKDLGLGXXXXXEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNXRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMXGEHKKLAEAIFKLTYQNKVVRVQRPTPRGTVMDIISRRDQRGSGQVGTYGLNTFTNMEAQLIRQMEGEGIFKXXXXXXXXXXXXXXXXXXRVGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 265728 - protein, 3391 aa, Dengue virus
  MOD_RES (104)..(108): Any amino acid
  MOD_RES (220)..(223): Any amino acid
  MOD_RES (296)..(316): Any amino acid
  MOD_RES (383)..(388): Any amino acid
  MOD_RES (449)..(450): Any amino acid
  MOD_RES (493)..(496): Any amino acid
  MOD_RES (537)..(544): Any amino acid
  MOD_RES (570)..(578): Any amino acid
  MOD_RES (692)..(695): Any amino acid
  MOD_RES (903)..(903): Any amino acid
  MOD_RES (952)..(952): Any amino acid
  MOD_RES (1075)..(1106): Any amino acid
  MOD_RES (1160)..(1165): Any amino acid
  MOD_RES (1190)..(1191): Any amino acid
  MOD_RES (1242)..(1243): Any amino acid
  MOD_RES (1263)..(1265): Any amino acid
  MOD_RES (1363)..(1390): Any amino acid
  MOD_RES (1516)..(1524): Any amino acid
  MOD_RES (1562)..(1580): Any amino acid
  MOD_RES (1605)..(1605): Any amino acid
  MOD_RES (1698)..(1710): Any amino acid
  MOD_RES (1734)..(1738): Any amino acid
  MOD_RES (1758)..(1798): Any amino acid
  MOD_RES (1951)..(1984): Any amino acid
  MOD_RES (2085)..(2086): Any amino acid
  MOD_RES (2186)..(2186): Any amino acid
  MOD_RES (2215)..(2221): Any amino acid
  MOD_RES (2260)..(2264): Any amino acid
  MOD_RES (2278)..(2281): Any amino acid
  MOD_RES (2301)..(2313): Any amino acid
  MOD_RES (2368)..(2370): Any amino acid
  MOD_RES (2428)..(2434): Any amino acid
  MOD_RES (2464)..(2474): Any amino acid
  MOD_RES (2489)..(2489): Any amino acid
  MOD_RES (2531)..(2551): Any amino acid
  MOD_RES (2702)..(2706): Any amino acid
  MOD_RES (2726)..(2727): Any amino acid
  MOD_RES (2794)..(2807): Any amino acid
  MOD_RES (2838)..(2856): Any amino acid
  MOD_RES (2945)..(2951): Any amino acid
  MOD_RES (2963)..(2982): Any amino acid
  MOD_RES (3049)..(3049): Any amino acid
  MOD_RES (3122)..(3139): Any amino acid
  MOD_RES (3264)..(3266): Any amino acid
  MOD_RES (3337)..(3346): Any amino acid
MNNQRKKAKNTPFNMLKRERNRVSTIQQLTKRFSLGMLQGRGPLKLFMAFVAFLRFLTIPPTAGILKRWGTVKKSKAISVLRGFRREIGRMLNILNRRRRSAGXXXXXIPTVVAFHLTTRNGEPHMIVGINEKGKSLLFKTENGVNMCTLMAMDLGELCEDTITYNCPFLKQNEPEDIDCWCNSTSTWVTYGTCSAMGEHRREKRSVALVPHVRMGLETXXXXWMSSEGAWKHAQRIETWVLRHPGFTMMAAILAYTIGTTHFQRVLIFILLAAVTPSMTMRCIGMSNRDFVEGVXXXXXXXXXXXXXXXXXXXXXNKPTLDFELIKTEAKHPATLRKFCVEAKLTNTTTASRCPTQGEPSLKEEQDKRFICRHSMVDRGWGXXXXXXGKGGIVTCAMFRCKKNMEGKVVLPENLEYTIVVTPHSGEENAVGNDTGKHGKEIKVTPQSXXAEAELTDYGTITMECSPRTSFDFNEMVLLQMENKAWLVHRQWXXXXPLPWLPGADKQESNWIQKEMLVTFKNPHAKRQDVVVLGSQXXXXXXXXTGATEIQMSLGNILFMGHLKCRLRMXXXXXXXXXYSMCTGKFKVVKEIAETQHGTIVIRVQYEGDDSPCKIPFEIMDLEKRYILGRLITVNPIVIEKDSPINIEAEPPFGDSYIIVGVEPGQLKLSWFKKGSSIGQMIETTMRGAKRXXXXGDTAWDFGSIGGVFTSVGKALHQVFGAIYGAAFSGVSWTMKILIGVVITWIGMNSRSTSLSVSLVLVGIVTLYLGAVVQADTGCIVSWKSKELKCGSGIFVTDNVHTWTEQYKFQPDSPSKLASAIQKAQEEDICGIRSVTRLENLMWKQITPELNHILAENEVKLTIMTGDIRGIMQVGRRSLRPQPTELKYSWKAWGKAKVLSTEXYNHTFLIDGPETTECPNSNRAWNSLEVEDYGFGVFTTNIWLKLKEKQDXICDSKLMSAAVKDDRAVHADMGYWIESALNDTWKIEKASFIEVKNCYWPRSHTLWSNGVLESEMIIPKNLAGPVSQHNYRPGYHTQIAGPWHLGKLEMDFDFCDGTTVIVTEECGNRGPSLRXXXXXXXXXXXXXXXXXXXXXXXXXXXXXXXXGMEIRPLKEKEENLVSSLVTAGHGQVDNFSLGILGMALFLEEMLRTRIGTKHAXXXXXXSFMTLITGNMSFKDLGRVVVMVGAXXADEMGMGITYLALLAAFRVRPTFAVGLFLRKLTSKELMMTTIGIVLLSQSXXPETVLELTDALALGMMALKXXXDMEKYQLAVTVMAILCVPNAVILRNAWKVSCTILAVVSVSPLFLTSSQQKTDWIPLVLIIKGLNPTAIFLTTLSRTNKKRSWPLNEAVMAVGMVSILXXXXXXXXXXXXXXXXXXXXXXXXXXXXGRSADLELERATDVRWEEHAEISGSSPILSITIAEDGSMSIKNEEEEHILTILIRTGLLVISGLFPISMPITAAAWYLWETKKQRAGVLWDVPSPPPMERAELEDGAYRIKQRGIFGYSQIGAGVXXXXXXXXXWHVTRGAVLMHKGKRIEPSWADVRKDLVSYGGGWKLEXXXXXXXXXXXXXXXXXXXPRAVQTKPGIFKTNAGTIGAVSLDXSPGTSGSPIIDKKGKVVGLYGNGVVTRSGTYVSSIAQTEKSVEDNPEIEDDIFRKRKLTIMDLHPGAGKTKKYLPAIVREAIRRGLRTLILAXXXXXXXXXXXXXRGLPIRYQTPAIKTEHTGREIVDXXXXXTFTMRLLSPIRVPNYNLIIXXXXXXXXXXXXXXXXXXXXXXXXXXXXXXXXXXXXXXXXXPFPQSNAPIIDEEREIPERSWSSGHEWITNFKGKTVWFVPSIKTGNDIAACLRKNGKRVIQLSRKTFDSEYIKTRANDWDFVVTTDISEMGANFRAERVIDPRRCMKPVILTDGEERVVLAGPMPVTHSSAAQRRGRVGRNPRNENDQYIYMXXXXXXXXXXXXXXXXXXXXXXXXXXXXXXXXXXEPEREKVDAVDGEYRLRGEARKTFVDLMKRGDLPVWLAYRVASEGINYADRKWCFDGVKNNQILEENMEVEVWTKEGERKKLKPRWLDARTYSDPLALKEXXEFAAGRKSLALSLITEMGRLPTFMTQKTRNALDNLAVLHTAEVGGKAYTHALSELPETLETLLLLGLLAAVTGGIFLFLMSGRGVGKMTLGMCCIVTASXLLWHAQIQPHWIAASIILVFFLIVLLIPXXXXXXXPQDNQLTYVIIAILTLVAATMANEMGFLEKTKKDFGLGXXXXXQSEINILDIDLRPXXXXTLYAVATTFITPMLRHSIEXXXXXXXXXXXXXQATVLMGLGRGWPLSKMDIGAPLLAIGCYSQVNPITLTAALFLLIAHYAIIGPGXXXKATREAQKRTAAGIMKNPTVDGITVIDLEPIPYDPKFEKQLGQVMLLVLCVTQVLMMXXXXXXXEALTLATGPVSTLWEGNPGKFWNTTIAVSXXXXXXXXXXXGAGLLFSIMKNTTSXRRGTGNMGETLGEKWKNRLNALGKSEFQIYKRSGIQEVDRTXXXXXXXXXXXXXXXXXXXXXKLRWFVERNLVTPEGKVMDLGCGRGGWSYYCGGLKNVKEVKGLTKGGPGHEEPVPMSTYGWNLVRLQSGVDVFFIPPERCDTLLCDIGESSPNPTVEAGRTLRVLSLVENWLNNNTQFCVKVLNPYMPSVIEKMETLQRQFGGALVRNPLXXXXXHEMYWVSNASGNIVSSVNMXXRMLINRFTMRYKKTTYEPDVDLGSGTRNIGIENETPNMDIIGKRIEKIKQEHEISWHYDQDHPYRTXXXXXXXXXXXXXXASSMVNGVVRLLTKPWDVLPTVTQMAMTDTXXXXXXXXXXXXXXXXXXXPKEGTKKLMRITAEWLWKELGKEKKPRICTREEFTKKVRSNAALGAVFTDENKWKSAREAVEDGRFWELVDRERNLHLDGKCETCVYNXXXXXXXKIGEFGKAKGSXXXXXXXXXXXXXXXXXXXXLNEDHWFSRGNSLSGVEGEGLHRLGYILRDVGRKAGGAMYADDTAGWDTRITIEDLKNEEMITNHMXGEHKRLAEAIFRLTYQNKVVRVQRPTSRGTVMDIISRKDQRGSGQVVTYGLNTFTNMGAQLIRQMEGEGVFKXXXXXXXXXXXXXXXXXXREGRERLARMAISGDDCVVKPIDDRFANALTALNDMGKIRKDIQQWEPSKGWSDWTQVPFCSHHFHELVMKDGRTLVVPCRSQDELIGRARISQGAGWSLRETACLGKSYAQMWTLMYFHRRDLXXXANAICSAVPPHWVPTSRTTWSIHATHEWMTTEDMLTVWNRVWIRENPWIEDKTPVESWEEIPYLGKREDQXXXXXXXXXXRATWAKNIQAAINQVRALIGEEGYIDYMPSMKRFRKEEEEAGVLW

SEQ ID NO: 265729 - protein, 3391 aa, Dengue virus
  MOD_RES (20)..(40): Any amino acid
  MOD_RES (55)..(61): Any amino acid
  MOD_RES (89)..(91): Any amino acid
  MOD_RES (104)..(108): Any amino acid
  MOD_RES (155)..(156): Any amino acid
  MOD_RES (179)..(185): Any amino acid
  MOD_RES (206)..(224): Any amino acid
  MOD_RES (290)..(322): Any amino acid
  MOD_RES (381)..(390): Any amino acid
  MOD_RES (449)..(450): Any amino acid
  MOD_RES (493)..(496): Any amino acid
  MOD_RES (518)..(547): Any amino acid
  MOD_RES (562)..(594): Any amino acid
  MOD_RES (690)..(698): Any amino acid
  MOD_RES (718)..(724): Any amino acid
  MOD_RES (751)..(751): Any amino acid
  MOD_RES (790)..(817): Any amino acid
  MOD_RES (835)..(838): Any amino acid
  MOD_RES (903)..(903): Any amino acid
  MOD_RES (926)..(929): Any amino acid
  MOD_RES (952)..(952): Any amino acid
  MOD_RES (1009)..(1011): Any amino acid
  MOD_RES (1074)..(1112): Any amino acid
  MOD_RES (1160)..(1165): Any amino acid
  MOD_RES (1190)..(1191): Any amino acid
  MOD_RES (1242)..(1243): Any amino acid
  MOD_RES (1263)..(1265): Any amino acid
  MOD_RES (1354)..(1392): Any amino acid
  MOD_RES (1467)..(1478): Any amino acid
  MOD_RES (1514)..(1524): Any amino acid
  MOD_RES (1558)..(1582): Any amino acid
  MOD_RES (1604)..(1607): Any amino acid
  MOD_RES (1625)..(1629): Any amino acid
  MOD_RES (1671)..(1713): Any amino acid
  MOD_RES (1733)..(1798): Any amino acid
  MOD_RES (1851)..(1860): Any amino acid
  MOD_RES (1884)..(1907): Any amino acid
  MOD_RES (1920)..(1931): Any amino acid
  MOD_RES (1946)..(2014): Any amino acid
  MOD_RES (2062)..(2088): Any amino acid
  MOD_RES (2106)..(2106): Any amino acid
  MOD_RES (2142)..(2146): Any amino acid
  MOD_RES (2180)..(2227): Any amino acid
  MOD_RES (2241)..(2248): Any amino acid
  MOD_RES (2260)..(2264): Any amino acid
  MOD_RES (2276)..(2345): Any amino acid
  MOD_RES (2368)..(2389): Any amino acid
  MOD_RES (2403)..(2477): Any amino acid
  MOD_RES (2489)..(2489): Any amino acid
  MOD_RES (2528)..(2553): Any amino acid
  MOD_RES (2573)..(2577): Any amino acid
  MOD_RES (2597)..(2616): Any amino acid
  MOD_RES (2636)..(2654): Any amino acid
  MOD_RES (2676)..(2677): Any amino acid
  MOD_RES (2701)..(2728): Any amino acid
  MOD_RES (2748)..(2750): Any amino acid
  MOD_RES (2791)..(2816): Any amino acid
  MOD_RES (2836)..(2860): Any amino acid
  MOD_RES (2902)..(2910): Any amino acid
  MOD_RES (2938)..(2995): Any amino acid
  MOD_RES (3025)..(3025): Any amino acid
  MOD_RES (3049)..(3049): Any amino acid
  MOD_RES (3064)..(3086): Any amino acid
  MOD_RES (3097)..(3109): Any amino acid
  MOD_RES (3122)..(3139): Any amino acid
  MOD_RES (3157)..(3161): Any amino acid
  MOD_RES (3177)..(3182): Any amino acid
  MOD_RES (3199)..(3208): Any amino acid
  MOD_RES (3221)..(3281): Any amino acid
  MOD_RES (3336)..(3346): Any amino acid
MNNQRKKARTTPFNMLKREXXXXXXXXXXXXXXXXXXXXXRGPLRLFMALVAFLXXXXXXXTVGILKRWGTIKKSRAINVLRGFRREIXXXLNILNKRRRTAGXXXXXIPTVIAFHLTTRNGEPHMIVSKNEKGKSLLFKTKDGTNMCTLMAMDXXELCEDTITYKCPLLKQNEPEDIXXXXXXXSTWVTYGTCATMGEHRREKRXXXXXXXXXXXXXXXXXXXMSSEGAWKHAQRIETWILRHPGFTLMAAILAYTVGTTYFQRALIFILLTAIAPSMAMRCIGISNRXXXXXXXXXXXXXXXXXXXXXXXXXXXXXXXXXFELTKTEAKQPATLRKYCIEAKLTNTTTDSRCPTQGEPTLNEEQDKRFVCRHSMVDRGXXXXXXXXXXGGIVTCAMFTCKKNMEGKVVQPENLEYTVVITPHSGEEHAVGNDTGKHGQEIKVTPQSXXAEAELTGYGTVTMECSPRTGFDFNEMVLLQMEEKAWLVHRQWXXXXPLPWLPGADKQGSNWIQKEMLXXXXXXXXXXXXXXXXXXXXXXXXXXXXXXTEIQMSSGNILFMGXXXXXXXXXXXXXXXXXXXXXXXXXXXXXXXXXTQHGTIVIRIQYEGDGSPCRVPFEITDLEKKYILGRLITVNPIVAGKDNPINIEAEPPFGDSYIVIGVEPGQLKLDWFKKGSSIGQMFATTMRGAXXXXXXXXXAWDFGSLGGAFTSIGKALHXXXXXXXGVAFSGVSWTMKILIGAIITWIGMNSXSTSLSVSLVLVGVVTLYLGAMVQADSGCVVSWKSKELKXXXXXXXXXXXXXXXXXXXXXXXXXXXXASAIQKAHEEDICGIRSXXXXENLMWRQITSELNHILSENEVKLTIMTGDTKGIMQAGKRSLKPQPTELRYSWKTWGKAKMLPTEXHNRTFLIDGPETTECPNSNRAWXXXXVEDYGFGVFSTNIWLKLKERQDXVCDSKLMSAAVKNNRAVHADMGYWMESRLNDTWKMEKASFIEIKSCHWPRSHTLWSXXXLESEMVIPKSFAGPVSQHNNRPGYYTQTTGPWHLGRLEMDFDLCDGTTVVVTENCGNRGPSLXXXXXXXXXXXXXXXXXXXXXXXXXXXXXXXXXXXXXXXLKEREENLVNSLVTAGQGQIDNFSLGILGMALLLEEMLKTRVGTKHAXXXXXXSLLTLITGNLSFKDLGRVIIMVGAXXTDDIGIGVTYLALLAAFRVRPTFAAGLLLKKLTSKELLMATIGITLLSQSXXPGTVLELTDAIALGIMVLKXXXKLEKYQLAVTIMTMLCIPNVMILQHAWKVGCTTLAVVSVSPLILTSSRQKTDWIPLALTIKGLSPTAIFLTTLSRPNKTRSWPLNEAIXXXXXXXXXXXXXXXXXXXXXXXXXXXXXXXXXXXXXXXSADLELEKAAEVKWDDHAEISGSSPILSVTISEDGSMSIKNEEEEQILTILIRTGLLVISGLFPVSMPITAAAWXXXXXXXXXXXXLWDVPSPPPVGRAELEDGAYRIKQRRILGYSQIGAXXXXXXXXXXXWHVTRGAVLVHKGKRIEPSWADVKKDLVSYGGGXXXXXXXXXXXXXXXXXXXXXXXXXAVQTKPGLFRTSTGTIGAVSLXXXXGTSGSPIVDKKGKVVGLXXXXXVTRSGTYVSAIAQTEKNIEDNPDIEDDIFRKRKLTIMDLHPXXXXXXXXXXXXXXXXXXXXXXXXXXXXXXXXXXXXXXXXXXXPIRYQTPAIKAEHTGREIVXXXXXXXXXXXXXXXXXXXXXXXXXXXXXXXXXXXXXXXXXXXXXXXXXXXXXXXXXXXXXXXXXXPFPQSNAPIVDEEREIPERSWNSGYEWITDFKGKTVWFVPSIRAGNDIAACLXXXXXXXXXXSRKTFDSEYAKTRSNDWDFVVTTXXXXXXXXXXXXXXXXXXXXXXXXILADGEERVILAXXXXXXXXXXXXRRGRIGRNPRNENDXXXXXXXXXXXXXXXXXXXXXXXXXXXXXXXXXXXXXXXXXXXXXXXXXXXXXXXXXXXXXXXXXXXXXGDLPVWLAYKVAAEGINYADRRWCFDGIRNNQILEENMEVEVWTKEGXXXXXXXXXXXXXXXXXXXXXXXXXXXAAGRKSLTLSLITEMGRXPTFMTQKARDALDNLAVLHTAEAGGKAYTHALSELXXXXXTLLLLTLLAAVTGGIFLFLMSGKGMGKMTLGMCXXXXXXXXXXXXXXXXXXXXXXXXXXXXXXXXXXXXXXXXXXXXXXXXTYVVIAILTLVAAXXXXXXXXLEKTKKDLGFGXXXXXEPEINILDIDLXXXXXXXXXXXXXXXXXXXXXXXXXXXXXXXXXXXXXXXXXXXXXXXXXXXXXXXXXXXXXXXXXXXXXXNPITLTAALLLLMAHYAIIGPGXXXXXXXXXXXXXXXXXXXXXXVDGVTVIDLDPIPXXXXXXXXXXXXXXXXXXXXXXXXXXXXXXXXXXXXXXXXXXXXXXXXXXXXXXXXXXXXXXXXXXXXXXXXXXXLLFSIMKNTANXRRGTGNTGETLGEKWKSRLNALGRSEFQTYKKSGIQEVXXXXXXXXXXXXXXXXXXXXXXXXXXRWFVERNLVAPEGKVVDLGXXXXXWSYYCGGLKDVREVKGLTKXXXXXXXXXXXXXXXXXXXXLQSGVDVFFVPPEKCDTLLXXXXXXXXXXXXXXXXXXXVLNLVENWLNNDTQFCIKVLNXXMPSVIERMETLQRKFGGALVRNPXXXXXXXXXXXXXXXXXXXXXXXXXXXXMLINRFTMRHKRATYEPDVXXXSGTRNIGIECEVPNLDIIGKRIEKIKEEHEASWHYDQDHPXXXXXXXXXXXXXXXXXXXXXXXXXXRLLTKPWDVIPMVTQMAMTXXXXXXXXXXXXXXXXXXXXXXXXXTKKLMRITAKWLWGELGRRKTPRICTRAEFCNKVRSNAALGXXXXXXXXXKSAREAVEDSGFWELIEKERNLHLDGKXXXXXXXXXXXXXXXXXXXXXXXXXXXXXXXXXXXXXXXXXXXXXXXXXXXXXXXXXXSGVEGEGLHRLGYILREISKKAGGAMYADXTAGWDTRITSEDLKNEEMITDQMXGRHKKLAEAIFRLTXXXXXXXXXXXXXXXXXXXXXXXRDQRGSGQVVXXXXXXXXXXXXXLIRQMEGEGLFKXXXXXXXXXXXXXXXXXXRVGRERLTRMAISGDDCXXXXXDDRFARALTALNDMGXXXXXXQQWEPSKGWSDWTQVPXXXXXXXXXXMKDGRILVVPCRXXXXXXXXXXXXXXXXXXXXXXXXXXXXXXXXXXXXXXXXXXXXXXXXXXXXXXXXXXXXXSRTTWSIHASHEWMTTEDMLTVWNRVWILDNPWMEDKTPVESWEDIPYLGKREDXXXXXXXXXXXRATWAKNIQVAINQVRSLMGNEEYIDYMPSMKRFRSEEEESGVLW

SEQ ID NO: 265730 - protein, 3391 aa, Dengue virus
  MOD_RES (11)..(62): Any amino acid
  MOD_RES (84)..(92): Any amino acid
  MOD_RES (104)..(108): Any amino acid
  MOD_RES (155)..(159): Any amino acid
  MOD_RES (176)..(185): Any amino acid
  MOD_RES (206)..(231): Any amino acid
  MOD_RES (284)..(322): Any amino acid
  MOD_RES (345)..(353): Any amino acid
  MOD_RES (381)..(390): Any amino acid
  MOD_RES (416)..(419): Any amino acid
  MOD_RES (449)..(450): Any amino acid
  MOD_RES (461)..(480): Any amino acid
  MOD_RES (493)..(498): Any amino acid
  MOD_RES (518)..(599): Any amino acid
  MOD_RES (650)..(702): Any amino acid
  MOD_RES (715)..(725): Any amino acid
  MOD_RES (745)..(754): Any amino acid
  MOD_RES (787)..(818): Any amino acid
  MOD_RES (835)..(845): Any amino acid
  MOD_RES (903)..(903): Any amino acid
  MOD_RES (914)..(914): Any amino acid
  MOD_RES (926)..(935): Any amino acid
  MOD_RES (952)..(952): Any amino acid
  MOD_RES (973)..(979): Any amino acid
  MOD_RES (1007)..(1017): Any amino acid
  MOD_RES (1071)..(1135): Any amino acid
  MOD_RES (1160)..(1165): Any amino acid
  MOD_RES (1190)..(1191): Any amino acid
  MOD_RES (1205)..(1205): Any amino acid
  MOD_RES (1225)..(1225): Any amino acid
  MOD_RES (1242)..(1243): Any amino acid
  MOD_RES (1263)..(1265): Any amino acid
  MOD_RES (1323)..(1332): Any amino acid
  MOD_RES (1351)..(1393): Any amino acid
  MOD_RES (1415)..(1449): Any amino acid
  MOD_RES (1464)..(1479): Any amino acid
  MOD_RES (1490)..(1496): Any amino acid
  MOD_RES (1513)..(1526): Any amino acid
  MOD_RES (1544)..(1582): Any amino acid
  MOD_RES (1602)..(1636): Any amino acid
  MOD_RES (1665)..(1714): Any amino acid
  MOD_RES (1730)..(1816): Any amino acid
  MOD_RES (1836)..(1860): Any amino acid
  MOD_RES (1874)..(2017): Any amino acid
  MOD_RES (2062)..(2122): Any amino acid
  MOD_RES (2142)..(2161): Any amino acid
  MOD_RES (2179)..(2264): Any amino acid
  MOD_RES (2276)..(2346): Any amino acid
  MOD_RES (2368)..(2478): Any amino acid
  MOD_RES (2489)..(2489): Any amino acid
  MOD_RES (2524)..(2559): Any amino acid
  MOD_RES (2571)..(2579): Any amino acid
  MOD_RES (2596)..(2616): Any amino acid
  MOD_RES (2636)..(2656): Any amino acid
  MOD_RES (2675)..(2677): Any amino acid
  MOD_RES (2699)..(2735): Any amino acid
  MOD_RES (2747)..(2750): Any amino acid
  MOD_RES (2787)..(2816): Any amino acid
  MOD_RES (2836)..(2860): Any amino acid
  MOD_RES (2898)..(2910): Any amino acid
  MOD_RES (2938)..(3002): Any amino acid
  MOD_RES (3024)..(3036): Any amino acid
  MOD_RES (3049)..(3139): Any amino acid
  MOD_RES (3151)..(3161): Any amino acid
  MOD_RES (3177)..(3208): Any amino acid
  MOD_RES (3221)..(3281): Any amino acid
  MOD_RES (3330)..(3349): Any amino acid
  MOD_RES (3371)..(3391): Any amino acid
MNNQRKKAKTXXXXXXXXXXXXXXXXXXXXXXXXXXXXXXXXXXXXXXXXXXXXXXXXXXXXTGILKRWGTIKKSRAINVLRGXXXXXXXXXNILNRRRRSVGXXXXXIPTAIAFHLTTRNGEPHMIVSIQEKGKSLLFKTENGINMCTLMAMDXXXXXEDTVTYKCPLLKQNEPXXXXXXXXXXSTWITYGTCTSTGEHRREKRXXXXXXXXXXXXXXXXXXXXXXXXXXKQAQRIETWILRHPGFAIMAAVLAYTIGTTHFQRTLIFILLTAIAPSMAMRCXXXXXXXXXXXXXXXXXXXXXXXXXXXXXXXXXXXXXXXFELIKTEAKESATLRKYCIEARXXXXXXXXXCPTQGEPSLVEEQDKRFLCKHSMVDRGXXXXXXXXXXGGIVTCAMFTCKKKMKGKVVQPENLXXXXVVTPHSGEEYAVGNDTGKHGKEVKITPQSXXSEAELTDYGTXXXXXXXXXXXXXXXXXXXXMESKAWLVHRQWXXXXXXPWLPGADTQESNWIQKEMLXXXXXXXXXXXXXXXXXXXXXXXXXXXXXXXXXXXXXXXXXXXXXXXXXXXXXXXXXXXXXXXXXXXXXXXXXXXXXXXXXXIVVRLQYEGDGSPCKIPFEIMDLERRYILGRLITVNPIITEKDNPINIEAXXXXXXXXXXXXXXXXXXXXXXXXXXXXXXXXXXXXXXXXXXXXXXXXXXXXXGSLGGAFTSIGKXXXXXXXXXXXAAFNGVSWIMKIFIGVIITXXXXXXXXXXLSVTLVLVGVITLYLGVMVQADSGCIVSWKNKXXXXXXXXXXXXXXXXXXXXXXXXXXXXXXXXSAIQKAHEDGICGIRSXXXXXXXXXXXITPELNHILSENEAKLTIMTGEIKGIMQAGKRYLQPQPTQLKYSWKTWGKAKILSTEXQNQTFLIDGPXTVECPNTNRAWXXXXXXXXXXGIFTTNIWLRLREKQDXSCDSKLMSAAIKNNRAVHADXXXXXXXALNDTWKMERASFIEVKSCHWPRSHTLXXXXXXXXXXXIPKNFAGPVSQHNYRPGYHTQITGPWHLGKLEMDFEFCEGTTVVVTENCGNRGXXXXXXXXXXXXXXXXXXXXXXXXXXXXXXXXXXXXXXXXXXXXXXXXXXXXXXXXXXXXXXXXXSLGVLGMALFLEEMLRTRVGTKHVXXXXXXSFVTLITGNLSFRDLGRVVVMVGTXXTDDIGIGVTYLALXAAFKVRPTFAAGLLLKKLTXKELMMATIGVVLLSQSXXPESILELTDALALGMMILKXXXSMEKYQLAVTIMVILCVPNAVILLNAWKVSCAILATVSVSPLLLTSSQQKTDWIPLVXXXXXXXXXXIFLTTLSRPNKIRSWPLNXXXXXXXXXXXXXXXXXXXXXXXXXXXXXXXXXXXXXXXXXXXADLELEKAADVRWEDQAEISGXXXXXXXXXXXXXXXXXXXXXXXXXXXXXXXXXXXVISGLFPVSMPITAXXXXXXXXXXXXXXXXWDVPSPPPIGXXXXXXXAYRIKQKGIFGYSQIGXXXXXXXXXXXXXXVTRGAVLTHKGKRIEPSXXXXXXXXXXXXXXXXXXXXXXXXXXXXXXXXXXXXXXXAVQTKPGLFKTSTGTIGAVXXXXXXXXXXXXXXXXXXXXXXXXXXXXXXXXXXXVSAIAQTEKGIENNPEIEDHIFRKRRLTXXXXXXXXXXXXXXXXXXXXXXXXXXXXXXXXXXXXXXXXXXXXXXXXXXIRYQTTAIKTEHTGRXXXXXXXXXXXXXXXXXXXXXXXXXXXXXXXXXXXXXXXXXXXXXXXXXXXXXXXXXXXXXXXXXXXXXXXXXXXXXXXXXXXXXXXRSWNTGHEWITNFEGKTVWXXXXXXXXXXXXXXXXXXXXXXXXXSRKTFDTEYTKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVWLAFKVASEGISYADRRWCFDGTRNNQILEENIEVEIWTKEGXXXXXXXXXXXXXXXXXXXXXXXXXXXXXXXXXXXXXXXXXXXXXXXXXXXXXXXXXXXXXVLHTAEVGGRAYNHALNELXXXXXXXXXXXXXXXXXXXXFLFLMSGRGVGKMTLGMXXXXXXXXXXXXXXXXXXXXXXXXXXXXXXXXXXXXXXXXXXXXXXXXXXXXXXXXXXXXXXXXXXXXXXXXXXXXXXXXXXXXXXQHESNILDIDLXXXXXXXXXXXXXXXXXXXXXXXXXXXXXXXXXXXXXXXXXXXXXXXXXXXXXXXXXXXXXXXXXXXXXXXPVTLTAALLSLVAHYAIIGPAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLFSIMRNTTSXRRGTGNVGETLGEKWKNRLNSLGKNEFQIYKKSGXXXXXXXXXXXXXXXXXXXXXXXXXXXXXXXXXXXXNMVAPEGKVVDXXXXXXXXXYYCGGLKSVREVKGLTXXXXXXXXXXXXXXXXXXXXXLQSGVDVFFTPPERCDTLLXXXXXXXXXXXXXXXXXXXXXNLVENWLGSNTQFCVKVLXXXMPSVIERMEALQRRYGGALVRXXXXXXXXXXXXXXXXXXXXXXXXXXXXXXXXXXXXXMRHKRATYEPDXXXXSGTRNIGTESETPNMDIIGKRIEKIKQEHEASWHYDXXXXXXXXXXXXXXXXXXXXXXXXXXXXXXKLLTKPWDVLPMVTQMAMTXXXXXXXXXXXXXXXXXXXXXXXXXTKKLMKITAKWLWKELGKKKIPRVCTREEFARKVRSNXXXXXXXXXXXXXKSAREAVEDNRFWELVERERNLHLDGKXXXXXXXXXXXXXXXXXXXXXXXXXXXXXXXXXXXXXXXXXXXXXXXXXXXXXXXXXXXXXXXXXLHKLGYILREISKKAGGAMYAXXXXXXXXXXXXXDLKNEEMITGQMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXREGRERLSRMAXXXXXXXXXXXDDRFAKALTALNDMGXXXXXXXXXXXXXXXXXXXXXXXXXXXXXXXXMKDGRKLVVPCRXXXXXXXXXXXXXXXXXXXXXXXXXXXXXXXXXXXXXXXXXXXXXXXXXXXXXXXXXXXXXSRTTWSIHARHEWMTTEDMLTVWNRVWIQENPWMEDKTPVETWEEIPYXXXXXXXXXXXXXXXXXXXXWARNIQTAINQVRSLIGSEEYXXXXXXXXXXXXXXXXXXXXX

SEQ ID NO: 265731 - protein, 3391 aa, Dengue virus
  MOD_RES (11)..(70): Any amino acid
  MOD_RES (81)..(92): Any amino acid
  MOD_RES (104)..(120): Any amino acid
  MOD_RES (139)..(142): Any amino acid
  MOD_RES (155)..(163): Any amino acid
  MOD_RES (176)..(241): Any amino acid
  MOD_RES (253)..(258): Any amino acid
  MOD_RES (283)..(329): Any amino acid
  MOD_RES (341)..(353): Any amino acid
  MOD_RES (371)..(392): Any amino acid
  MOD_RES (414)..(432): Any amino acid
  MOD_RES (449)..(450): Any amino acid
  MOD_RES (461)..(480): Any amino acid
  MOD_RES (492)..(498): Any amino acid
  MOD_RES (516)..(600): Any amino acid
  MOD_RES (640)..(702): Any amino acid
  MOD_RES (715)..(732): Any amino acid
  MOD_RES (744)..(755): Any amino acid
  MOD_RES (781)..(819): Any amino acid
  MOD_RES (832)..(851): Any amino acid
  MOD_RES (887)..(892): Any amino acid
  MOD_RES (903)..(903): Any amino acid
  MOD_RES (914)..(914): Any amino acid
  MOD_RES (926)..(937): Any amino acid
  MOD_RES (952)..(952): Any amino acid
  MOD_RES (963)..(992): Any amino acid
  MOD_RES (1005)..(1018): Any amino acid
  MOD_RES (1039)..(1044): Any amino acid
  MOD_RES (1066)..(1177): Any amino acid
  MOD_RES (1188)..(1191): Any amino acid
  MOD_RES (1202)..(1206): Any amino acid
  MOD_RES (1224)..(1231): Any amino acid
  MOD_RES (1242)..(1243): Any amino acid
  MOD_RES (1256)..(1265): Any amino acid
  MOD_RES (1276)..(1278): Any amino acid
  MOD_RES (1293)..(1297): Any amino acid
  MOD_RES (1323)..(1332): Any amino acid
  MOD_RES (1349)..(1393): Any amino acid
  MOD_RES (1415)..(1451): Any amino acid
  MOD_RES (1464)..(1479): Any amino acid
  MOD_RES (1490)..(1498): Any amino acid
  MOD_RES (1513)..(1584): Any amino acid
  MOD_RES (1602)..(1637): Any amino acid
  MOD_RES (1649)..(1819): Any amino acid
  MOD_RES (1833)..(1860): Any amino acid
  MOD_RES (1874)..(2021): Any amino acid
  MOD_RES (2046)..(2122): Any amino acid
  MOD_RES (2134)..(2161): Any amino acid
  MOD_RES (2178)..(2264): Any amino acid
  MOD_RES (2275)..(2346): Any amino acid
  MOD_RES (2361)..(2478): Any amino acid
  MOD_RES (2489)..(2489): Any amino acid
  MOD_RES (2523)..(2620): Any amino acid
  MOD_RES (2635)..(2656): Any amino acid
  MOD_RES (2674)..(2760): Any amino acid
  MOD_RES (2772)..(2864): Any amino acid
  MOD_RES (2892)..(2911): Any amino acid
  MOD_RES (2935)..(3003): Any amino acid
  MOD_RES (3024)..(3140): Any amino acid
  MOD_RES (3151)..(3208): Any amino acid
  MOD_RES (3221)..(3300): Any amino acid
  MOD_RES (3320)..(3355): Any amino acid
  MOD_RES (3371)..(3391): Any amino acid
MNDQRKKARNXXXXXXXXXXXXXXXXXXXXXXXXXXXXXXXXXXXXXXXXXXXXXXXXXXXXXXXXXXXXAIKKSKAINVXXXXXXXXXXXXNILNRRRRTVGXXXXXXXXXXXXXXXXXNGEPHMIVSKNEKGKSLLXXXXVGTNMCTLMALDXXXXXXXXXTYNCPLLKQNEPXXXXXXXXXXXXXXXXXXXXXXXXXXXXXXXXXXXXXXXXXXXXXXXXXXXXXXXXXXXXXXXXXXLRHPGFTTMAAXXXXXXGTTHFQKALIFILLTTVAPSMTMRXXXXXXXXXXXXXXXXXXXXXXXXXXXXXXXXXXXXXXXXXXXXXXXAKQSATLRKYCXXXXXXXXXXXXXCPTQGEPSLSEEQDKRFXXXXXXXXXXXXXXXXXXXXXXIVTCAMFSCLKNMKGKVVQPEXXXXXXXXXXXXXXXXXXXNDTGKHGMEIKVTPQSXXTDAELTGYGTXXXXXXXXXXXXXXXXXXXXMGNKAWLVHRQXXXXXXXPWLPGADIQGSNWIQKEXXXXXXXXXXXXXXXXXXXXXXXXXXXXXXXXXXXXXXXXXXXXXXXXXXXXXXXXXXXXXXXXXXXXXXXXXXXXXXXXXXXXXVIRVQYEGEGAPCKIPFEIMDLEKRYILGRLITVNPIATXXXXXXXXXXXXXXXXXXXXXXXXXXXXXXXXXXXXXXXXXXXXXXXXXXXXXXXXXXXXXXXGSLGGVFTSMGKXXXXXXXXXXXXXXXXXXWTMKIFIGVIIXXXXXXXXXXXXSVSLILVGVVILYLGAMVQADSGCIXXXXXXXXXXXXXXXXXXXXXXXXXXXXXXXXXXXXXXXAIQKAHEDGICGXXXXXXXXXXXXXXXXXXXXHILTENEVKMTIMTGDIKGIMHAGRRSLRPQPTQLXXXXXXWGKAKMLSTGXHNRTFLIDGPXTAECPNANRAWXXXXXXXXXXXXFTTNIWLRLKEKQDXLCDSKLMSAAXXXXXXXXXXXXXXXXXXXXXXXXXXXXXXIEVKSCHWPRSHXXXXXXXXXXXXXXPKGIAGPVSQHNNRPGYYTQXXXXXXLGKLEMDFNFCEGTTVVVTENXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRDLGRVIIMVXXXXTDDIGIGVTYXXXXXAYKVRPTFVAGLLLRKLXXXXXXXXTIGVALLSQSXXPENILELTDALAXXXXXXXXXXNLEKYQLAVTXXXTLCVPNAVVLQNAWXXXXXILAAVSVFPLLLTSSRQKADWIPLAXXXXXXXXXXIFLTTLTRTSKKRSWPXXXXXXXXXXXXXXXXXXXXXXXXXXXXXXXXXXXXXXXXXXXXXADLELERAAEVKWEEQAEISGXXXXXXXXXXXXXXXXXXXXXXXXXXXXXXXXXXXXXSGVFPVSIPVTAXXXXXXXXXXXXXXXXWDVPSPPPMEXXXXXXXXXRIKQRGFLGYSQIGXXXXXXXXXXXXXXXXXXXXXXXXXXXXXXXXXXXXXXXXXXXXXXXXXXXXXXXXXXXXXXXXXXXXXXXXQTKPGFFRTNAGTIGAVXXXXXXXXXXXXXXXXXXXXXXXXXXXXXXXXXXXXSSIAQTETSVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSGHEWITDFKGKXXXXXXXXXXXXXXXXXXXXXXXXXXXXSRKTFDTEYIKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKVASEGISYTDRKWCFDGIRNNXXXXXXXXXXXXXXXXXXXXXXXXXXXXXXXXXXXXXXXXXXXXXXXXXXXXXXXXXXXXXXXXXXXXXXXXXXXXXVLHSAEMGGRAXXXXXXXXXXXXXXXXXXXXXXXXXXXXFLFLMSARGIGKMTLGXXXXXXXXXXXXXXXXXXXXXXXXXXXXXXXXXXXXXXXXXXXXXXXXXXXXXXXXXXXXXXXXXXXXXXXXXXXXXXXXXXXXXXXQHESNILDIDXXXXXXXXXXXXXXXXXXXXXXXXXXXXXXXXXXXXXXXXXXXXXXXXXXXXXXXXXXXXXXXXXXXXXXXXPTTLTAALLLLMAHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLFSIMKNTINXRRGTGTIGETLGEKWKSQLNTLGKNEFQIYKKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIDVFFIPPERCDTLXXXXXXXXXXXXXXXXXXXXXXNLVENWLNNNTKFCIKVXXXXXXXXXXXXXXXXXXXXXXXXXXXXXXXXXXXXXXXXXXXXXXXXXXXXXXXXXXXXXXXXXXXXXXXXXXXXXXXXXXXXXXXEKPNLDIIGKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMRITAKWLWKELGRKKTPRMCTREEFAXXXXXXXXXXXXXXXXXXXXSAREAVEDERFWELVERERNLHLXXXXXXXXXXXXXXXXXXXXXXXXXXXXXXXXXXXXXXXXXXXXXXXXXXXXXXXXXXXXXXXXXXXXXHKLGYILRDVSKKEGGTMYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGRERLSRMVXXXXXXXXXXXXXXXXXXXXXXXXXXXXXXXXXXXXXXXXXXXXXXXXXXXXXXXXXXMKDGRMLVVPCRXXXXXXXXXXXXXXXXXXXXXXXXXXXXXXXXXXXXXXXXXXXXXXXXXXXXXXXXXXXXXXXXXXXXXXXXXXXXXXXXLTVWNKVWIQDNPWMEDKTXXXXXXXXXXXXXXXXXXXXXXXXXXXXXXXXXXXXTAINQVRSLIGNEGYXXXXXXXXXXXXXXXXXXXXX

SEQ ID NO: 265732 - protein, 3391 aa, Dengue virus
  MOD_RES (1)..(9): Any amino acid
  MOD_RES (104)..(108): Any amino acid
  MOD_RES (449)..(451): Any amino acid
  MOD_RES (874)..(878): Any amino acid
  MOD_RES (900)..(903): Any amino acid
  MOD_RES (952)..(953): Any amino acid
  MOD_RES (1160)..(1165): Any amino acid
  MOD_RES (1190)..(1191): Any amino acid
  MOD_RES (1236)..(1245): Any amino acid
  MOD_RES (1263)..(1266): Any amino acid
  MOD_RES (1279)..(1280): Any amino acid
  MOD_RES (1293)..(1301): Any amino acid
  MOD_RES (2186)..(2186): Any amino acid
  MOD_RES (2260)..(2264): Any amino acid
  MOD_RES (2489)..(2489): Any amino acid
  MOD_RES (3049)..(3049): Any amino acid
  MOD_RES (3122)..(3141): Any amino acid
XXXXXXXXXSTPFNMLKRERNRVSTVQQLTKRFSLGMLQGRGPLKLFMALVAFLRFLTIPPTAGILKRWGTIKKSKAINVLRGFRKEIGRMLNILNRRRRTAGXXXXXIPTAMAFHLTTRNGEPHMIVGRQEKGKSLLFKTEDGVNMCTLMAIDLGELCEDTITYKCPLLRQNEPEDIDCWCNSTSTWVTYGTCTTTGEHRREKRSVALVPHVGMGLETRTETWMSSEGAWKHVQRIETWILRHPGFTIMAAILAYTIGTTHFQRALIFILLTAVAPSMTMRCIGISNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFTCKKNMEGKIVQPENLEYTIVITPHSGEEHAVGNDTGKHGKEIKITPQSXXXEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVSLVLVGVVTLYLGVMVQADSGCVVSWKNKELKCGSGIFITDNVHTWTEQYKFQPESPSKLASAIQKAHEEGICGIRSVTRLENLMWKQITPELNHILSENEVKLTIMTGDIKGIMQXXXXXLRPQPTELKYSWKTWGKAKMLXXXXHNQTFLIDGPETAECPNTNRAWNSLEVEDYGFGVFTTNIWLKLREKQDXXCDSKLMSAAIKDNRAVHADMGYWIESALNDTWKMEKASFIEVKSCHWPKSHTLWSNGVLESEMIIPKNFAGPVSQHNYRPGYHTQTAGPWHLGKLEMDFDFCEGTTVVVTEDCGNRGPSLRTTTASGKLITEWCCRSCTLPPLRYRGEDGCWYGMEIRPLKEKEENLVNSLVTAGHGQIDNFSLGVLGMALFLEEMLRTRVGTKHAXXXXXXSFVTLITGNMSFRDLGRVMVMVGAXXTDDIGMGVTYLALLAAFKVRPTFAAGLLLRKLTSKELMMATIGIXXXXXXXXXXTILELTDALALGMMVLKXXXXMEKYQLAVTIMAXXCVPNAVILQNAWXXXXXXXXXVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERAADVKWEDQAEISGSSPILSITISEDGSMSIKNEEEEQTLTILIRTGLLVISGVFPVSIPITAAAWYLWEVKKQRAGVLWDVPSPPPVGKAELEDGAYRIKQKGILGYSQIGAGVYKEGTFHTMWHVTRGAVLMHRGKRIEPSWADVKKDLISYGGGWKLEGEWKEGEEVQVLALEPGKNPRAVQTKPGLFKTNTGTIGAVSLDFSPGTSGSPIVDRKGKVVGLYGNGVVTRSGAYVSAIAQTEKSIEDNPEIEDDIFRKKRLTIMDLHPGAGKTKRYLPAIVREAIKRGLRTLILAPTRVVAAEMEEALRGLPIRYQTPAIRAEHTGREIVDLMCHATFTMRLLSPVRVPNYNLIIMDEAHFTDPASIAARGYISTRVEMGEAAGIFMTATPPGSRDPFPQSNAPIMDEEREIPERSWNSGHEWVTDFKGKTVWFVPSIKAGNDIAACLRKNGKKVIQLSRKTFDSEYVKTRTNDWDFVVTTDISEMGANFKAERVIDPRRCMKPVILTDGEERVILAGPMPVTHSSAAQRRGRIGRNPKNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGIKNNQILEENVEVEIWTKEGERKKLKPRWLDARIYSDPLALKEFKEFAAGRKSLTLNLITEMGRLPTFMTQKARDALDNLAVLHTAEAGGRAYNHALSELPETLETLLLLTLLATVTGGIFLFLMSGKGIGKMTLGMCCIITASXLLWYAQIQPHWIAASIILEFFLIVLLIPEPEKQRTPQDNQLTYVVIAILTVVAATMANEMGFLEKTKKDLGLGXXXXXEPESNILDIDLRPASAWTLYAVATTFVTPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLILCVTQVLMMRTTWALCEALTLATGPISTLWEGNPGRFWNTTIAVSMANIFRGSYLAGAGLLFSIMKNTTNXRRGTGNIGETLGEKWKSRLNALGKSEFQIYKKSGIQEVDRTLAKEGIKRGETDHHAVSRGSAKLRWFVERNMVTPEGKVVDLGCGRGGWSYYCGGLKNVREVKGLTKGGPGHEEPIPMSTYGWNLVRLQSGVDVFFTPPEKCDTLLCDIGESSPNPTIEAGRTLRVLNLVENWLNNNTQFCIKVLNPYMPSVIEKMEALQRKYGGALVRNPLSRNSTHEMYWVSNATGNIVSSVNMISRMLINRFTMKHKKATYEPDVDLGSGTRNIGIESEIPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTRKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILRDVSKKEGGAMYADDTAGWDTRITLEDLKNEEMVTNHMXGEHKKLAEAIFKLTYQNKVVRVQRPTPRGTVMDIISRRDQRGSGQVGTYGLNTFTNMEAQLIRQMEGEGIFKXXXXXXXXXXXXXXXXXXXXGRERLSRMAISGDDCVVKPLDDRFASALTALNDMGKVRKDIQQWEPSRGWNDWTQVPFCSHHFHELIMKDGRVLVVPCRNQDELIGRARISQGAGWSLKETACLGKSYAQMWSLMYFHRRDLRLAANAICSAVPSHWVPTSRTTWSIHAKHEWMTTEDMLAVWNRVWIQENPWMEDKTPVESWEEVPYLGKREDQWCGSLIGLTSRATWAKNIQTAINQVRSLIGNEEYTDYMPSMKRFRREEEEAGVLW

SEQ ID NO: 265733 - protein, 3391 aa, Dengue virus
  MOD_RES (1)..(9): Any amino acid
  MOD_RES (104)..(108): Any amino acid
  MOD_RES (221)..(222): Any amino acid
  MOD_RES (297)..(315): Any amino acid
  MOD_RES (384)..(387): Any amino acid
  MOD_RES (449)..(451): Any amino acid
  MOD_RES (494)..(495): Any amino acid
  MOD_RES (538)..(543): Any amino acid
  MOD_RES (571)..(577): Any amino acid
  MOD_RES (693)..(694): Any amino acid
  MOD_RES (874)..(878): Any amino acid
  MOD_RES (900)..(903): Any amino acid
  MOD_RES (952)..(953): Any amino acid
  MOD_RES (1076)..(1105): Any amino acid
  MOD_RES (1160)..(1165): Any amino acid
  MOD_RES (1190)..(1191): Any amino acid
  MOD_RES (1236)..(1245): Any amino acid
  MOD_RES (1263)..(1266): Any amino acid
  MOD_RES (1279)..(1280): Any amino acid
  MOD_RES (1293)..(1301): Any amino acid
  MOD_RES (1364)..(1389): Any amino acid
  MOD_RES (1517)..(1523): Any amino acid
  MOD_RES (1563)..(1579): Any amino acid
  MOD_RES (1699)..(1709): Any amino acid
  MOD_RES (1735)..(1737): Any amino acid
  MOD_RES (1759)..(1797): Any amino acid
  MOD_RES (1952)..(1983): Any amino acid
  MOD_RES (2186)..(2186): Any amino acid
  MOD_RES (2216)..(2220): Any amino acid
  MOD_RES (2260)..(2264): Any amino acid
  MOD_RES (2279)..(2280): Any amino acid
  MOD_RES (2302)..(2312): Any amino acid
  MOD_RES (2369)..(2369): Any amino acid
  MOD_RES (2429)..(2433): Any amino acid
  MOD_RES (2465)..(2473): Any amino acid
  MOD_RES (2489)..(2489): Any amino acid
  MOD_RES (2532)..(2550): Any amino acid
  MOD_RES (2703)..(2705): Any amino acid
  MOD_RES (2795)..(2806): Any amino acid
  MOD_RES (2839)..(2855): Any amino acid
  MOD_RES (2946)..(2950): Any amino acid
  MOD_RES (2964)..(2981): Any amino acid
  MOD_RES (3049)..(3049): Any amino acid
  MOD_RES (3122)..(3141): Any amino acid
  MOD_RES (3265)..(3265): Any amino acid
  MOD_RES (3338)..(3345): Any amino acid
XXXXXXXXXNTPFNMLKRERNRVSTIQQLTKRFSLGMLQGRGPLKLFMAFVAFLRFLTIPPTAGILKRWGTVKKSKAISVLRGFRREIGRMLNILNRRRRSAGXXXXXIPTVVAFHLTTRNGEPHMIVGINEKGKSLLFKTENGVNMCTLMAMDLGELCEDTITYNCPFLKQNEPEDIDCWCNSTSTWVTYGTCSAMGEHRREKRSVALVPHVRMGLETRXXTWMSSEGAWKHAQRIETWVLRHPGFTMMAAILAYTIGTTHFQRVLIFILLAAVTPSMTMRCIGMSNRDFVEGVSXXXXXXXXXXXXXXXXXXXKNKPTLDFELIKTEAKHPATLRKFCIEAKLTNTTTASRCPTQGEPSLKEEQDKRFICRHSMVDRGWGNXXXXFGKGGIVTCAMFRCKKNMEGKVVQPENLEYTIVVTPHSGEENAVGNDTGKHGKEIKVTPQSXXXEAELTDYGTITMECSPRTSFDFNEMVLLQMENKAWLVHRQWFXXLPLPWLPGADKQESNWIQKEMLVTFKNPHAKRQDVVVLGSQEXXXXXXLTGATEIQMSLGNILFMGHLKCRLRMDXXXXXXXSYSMCTGKFKVVKEIAETQHGTIVIRVQYEGDDSPCKIPFEIMDLEKRYILGRLITVNPIVIEKDSPINIEAEPPFGDSYIIIGVEPGQLKLSWFKKGSSIGQMIETTMRGAKRMXXLGDTAWDFGSIGGVFTSVGKALHQVFGAIYGAAFSGVSWTMKILIGVVITWIGMNSRSTSLSVSLVLVGIVTLYLGAVVQADTGCVVSWKSKELKCGSGIFVTDNVHTWTEQYKFQPDSPSKLASAIQKAQEEDICGIRSVTRLENLMWKQITPELNHILAENEVKLTIMTGDIRGIMQXXXXXLRPQPTELKYSWKAWGKAKMLXXXXYNHTFLIDGPETTECPNSNRAWNSLEVEDYGFGVFTTNIWLKLKEKQDXXCDSKLMSAAVKDDRAVHADMGYWIESALNDTWKIEKASFIEVKNCYWPRSHTLWSNGVLESEMIIPKNLAGPVSQHNYRPGYHTQIAGPWHLGKLEMDFDFCDGTTVIVTEECGNRGPSLRTXXXXXXXXXXXXXXXXXXXXXXXXXXXXXXYGMEIRPLKEKEENLVNSLVTAGHGQVDNFSLGILGMALFLEEMLRTRIGTKHAXXXXXXSFMTLITGNMSFKDLGRVVVMVGAXXADEMGMGVTYLALLAAFRVRPTFAVGLLLRKLTSKELMMTTIGIXXXXXXXXXXTVLELTDALALGMMALKXXXXMEKYQLAVTVMAXXCVPNAVILRNAWXXXXXXXXXVSVSPLFLTSSQQKTDWIPLVLIIKGLNPTAIFLTTLSRTNKKRSWPLNEAVMAVGMVSILAXXXXXXXXXXXXXXXXXXXXXXXXXXTGRSADLELERATDVRWEEHAEISGSSPILSITIAEDGSMSIKNEEEEHILTILIRTGLLVISGLFPISMPITAAAWYLWETKKQRAGVLWDVPSPPPMERAELEDGAYRIKQRGIFGYSQIGAGVYXXXXXXXMWHVTRGAVLMHKGKRIEPSWADVRKDLVSYGGGWKLEGXXXXXXXXXXXXXXXXXNPRAVQTKPGIFKTNAGTIGAVSLDFSPGTSGSPIIDKKGKVVGLYGNGVVTRSGTYVSSIAQTEKSVEDNPEIEDDIFRKRKLTIMDLHPGAGKTKKYLPAIVREAIRRGLRTLILAPXXXXXXXXXXXLRGLPIRYQTPAIKTEHTGREIVDLXXXATFTMRLLSPIRVPNYNLIIMXXXXXXXXXXXXXXXXXXXXXXXXXXXXXXXXXXXXXXXDPFPQSNAPIIDEEREIPERSWSSGHEWITNFKGKTVWFVPSIKTGNDIAACLRKNGKRVIQLSRKTFDSEYIKTRANDWDFVVTTDISEMGANFRAERVIDPRRCMKPVILTDGEERVVLAGPMPVTHSSAAQRRGRVGRNPRNENDQYIYMGXXXXXXXXXXXXXXXXXXXXXXXXXXXXXXXXFEPEREKVDAVDGEYRLRGEARKTFVDLMKRGDLPVWLAYRVASEGINYADRKWCFDGVKNNQILEENMEVEVWTKEGERKKLKPRWLDARTYSDPLALKEFKEFAAGRKSLALSLITEMGRLPTFMTQKTRNALDNLAVLHTAEVGGKAYTHALSELPETLETLLLLGLLAAVTGGIFLFLMSGRGVGKMTLGMCCIVTASXLLWHAQIQPHWIAASIILVFFLIVLLIPEXXXXXTPQDNQLTYVIIAILTLVAATMANEMGFLEKTKKDFGLGXXXXXQSEINILDIDLRPAXXWTLYAVATTFITPMLRHSIENXXXXXXXXXXXNQATVLMGLGRGWPLSKMDIGAPLLAIGCYSQVNPITLTAALFLLIAHYAIIGPGLXAKATREAQKRTAAGIMKNPTVDGITVIDLEPIPYDPKFEKQLGQVMLLVLCVTQVLMMRXXXXXCEALTLATGPVSTLWEGNPGKFWNTTIAVSMXXXXXXXXXAGAGLLFSIMKNTTSXRRGTGNMGETLGEKWKNRLNALGKSEFQIYKRSGIQEVDRTLXXXXXXXXXXXXXXXXXXXAKLRWFVERNLVTPEGKVMDLGCGRGGWSYYCGGLKNVKEVKGLTKGGPGHEEPVPMSTYGWNLVRLQSGVDVFFIPPERCDTLLCDIGESSPNPTVEAGRTLRVLSLVENWLNNNTQFCVKVLNPYMPSVIEKMETLQRQFGGALVRNPLSXXXTHEMYWVSNASGNIVSSVNMISRMLINRFTMRYKKTTYEPDVDLGSGTRNIGIENETPNMDIIGKRIEKIKQEHEISWHYDQDHPYRTWXXXXXXXXXXXXSASSMVNGVVRLLTKPWDVLPTVTQMAMTDTTXXXXXXXXXXXXXXXXXEPKEGTKKLMRITAKWLWKELGKEKKPRICTREEFTKKVRSNAALGAVFTDENKWKSAREAVEDGRFWELVDRERNLHLDGKCETCVYNMXXXXXKKIGEFGKAKGSRXXXXXXXXXXXXXXXXXXFLNEDHWFSRGNSLSGVEGEGLHRLGYILRDVGRKAGGAMYADDTAGWDTRITIEDLKNEEMITNHMXGEHKRLAEAIFRLTYQNKVVRVQRPTPRGTVMDIISRKDQRGSGQVVTYGLNTFTNMGAQLIRQMEGEGVFKXXXXXXXXXXXXXXXXXXXXGRERLARMAISGDDCVVKPIDDRFANALTALNDMGKIRKDIQQWEPSKGWSDWTQVPFCSHHFHELVMKDGRTLVVPCRSQDELIGRARISQGAGWSLRETACLGKSYAQMWTLMYFHRRDLRXAANAICSAVPPHWVPTSRTTWSIHATHEWMTTEDMLTVWNRVWIRENPWIEDKTPVESWEEIPYLGKREDQWXXXXXXXXSRATWAKNIQAAINQVRALIGEEGYIDYMPSMKRFRKEEEEAGVLW

SEQ ID NO: 265734 - protein, 3391 aa, Dengue virus
  MOD_RES (1)..(9): Any amino acid
  MOD_RES (21)..(39): Any amino acid
  MOD_RES (56)..(60): Any amino acid
  MOD_RES (90)..(90): Any amino acid
  MOD_RES (104)..(108): Any amino acid
  MOD_RES (180)..(184): Any amino acid
  MOD_RES (207)..(223): Any amino acid
  MOD_RES (291)..(321): Any amino acid
  MOD_RES (382)..(389): Any amino acid
  MOD_RES (449)..(451): Any amino acid
  MOD_RES (494)..(495): Any amino acid
  MOD_RES (519)..(546): Any amino acid
  MOD_RES (563)..(593): Any amino acid
  MOD_RES (691)..(697): Any amino acid
  MOD_RES (791)..(816): Any amino acid
  MOD_RES (836)..(837): Any amino acid
  MOD_RES (874)..(878): Any amino acid
  MOD_RES (900)..(903): Any amino acid
  MOD_RES (927)..(928): Any amino acid
  MOD_RES (952)..(954): Any amino acid
  MOD_RES (1010)..(1010): Any amino acid
  MOD_RES (1075)..(1111): Any amino acid
  MOD_RES (1160)..(1165): Any amino acid
  MOD_RES (1190)..(1191): Any amino acid
  MOD_RES (1236)..(1245): Any amino acid
  MOD_RES (1263)..(1266): Any amino acid
  MOD_RES (1279)..(1280): Any amino acid
  MOD_RES (1293)..(1301): Any amino acid
  MOD_RES (1355)..(1391): Any amino acid
  MOD_RES (1468)..(1477): Any amino acid
  MOD_RES (1515)..(1523): Any amino acid
  MOD_RES (1559)..(1581): Any amino acid
  MOD_RES (1605)..(1606): Any amino acid
  MOD_RES (1626)..(1628): Any amino acid
  MOD_RES (1672)..(1712): Any amino acid
  MOD_RES (1734)..(1797): Any amino acid
  MOD_RES (1852)..(1859): Any amino acid
  MOD_RES (1885)..(1906): Any amino acid
  MOD_RES (1921)..(1930): Any amino acid
  MOD_RES (1947)..(2013): Any amino acid
  MOD_RES (2063)..(2087): Any amino acid
  MOD_RES (2143)..(2145): Any amino acid
  MOD_RES (2181)..(2226): Any amino acid
  MOD_RES (2242)..(2247): Any amino acid
  MOD_RES (2260)..(2264): Any amino acid
  MOD_RES (2277)..(2344): Any amino acid
  MOD_RES (2369)..(2388): Any amino acid
  MOD_RES (2404)..(2443): Any amino acid
  MOD_RES (2455)..(2476): Any amino acid
  MOD_RES (2489)..(2489): Any amino acid
  MOD_RES (2529)..(2552): Any amino acid
  MOD_RES (2574)..(2576): Any amino acid
  MOD_RES (2598)..(2615): Any amino acid
  MOD_RES (2637)..(2646): Any amino acid
  MOD_RES (2702)..(2727): Any amino acid
  MOD_RES (2749)..(2749): Any amino acid
  MOD_RES (2792)..(2815): Any amino acid
  MOD_RES (2837)..(2859): Any amino acid
  MOD_RES (2903)..(2909): Any amino acid
  MOD_RES (2939)..(2994): Any amino acid
  MOD_RES (3049)..(3049): Any amino acid
  MOD_RES (3065)..(3085): Any amino acid
  MOD_RES (3098)..(3108): Any amino acid
  MOD_RES (3122)..(3141): Any amino acid
  MOD_RES (3158)..(3161): Any amino acid
  MOD_RES (3178)..(3181): Any amino acid
  MOD_RES (3200)..(3208): Any amino acid
  MOD_RES (3221)..(3280): Any amino acid
  MOD_RES (3337)..(3345): Any amino acid
XXXXXXXXXTTPFNMLKRERXXXXXXXXXXXXXXXXXXXGRGPLRLFMALVAFLRXXXXXPTVGILKRWGTIKKSKAINVLRGFRREIGXMLNILNKRRRTAGXXXXXIPTVIAFHLTTRNGEPHMIVSKNEKGKSLLFKTKDGTNMCTLMAMDLGELCEDTITYKCPLLKQNEPEDIDXXXXXTSTWVTYGTCATMGEHRREKRSXXXXXXXXXXXXXXXXXWMSSEGAWKHAQRIETWILRHPGFTLMAAILAYTVGTTYFQRALIFILLTAIAPSMAMRCIGISNRDXXXXXXXXXXXXXXXXXXXXXXXXXXXXXXXDFELIKTEAKQPATLRKYCIEAKLTNTTTDSRCPTQGEPTLNEEQDKRFVCRHSMVDRGWXXXXXXXXKGGIVTCAMFTCKKNMEGKVVLPENLEYTIVITPHSGEEHAVGNDTGKHGQEIKVTPQSXXXEAELTGYGTVTMECSPRTGFDFNEMVLLQMEEKAWLVHRQWFXXLPLPWLPGADKQGSNWIQKEMLVXXXXXXXXXXXXXXXXXXXXXXXXXXXXATEIQMSSGNILFMGHXXXXXXXXXXXXXXXXXXXXXXXXXXXXXXXETQHGTIVIRVQYEGDGSPCRIPFEITDLEKKYILGRLITVNPIVAGKDNPINIEAEPPFGDSYIVVGVEPGQLKLDWFRKGSSIGQMFATTMRGAKXXXXXXXTAWDFGSLGGAFTSIGKALHQVFGAIYGVAFSGVSWTMKILIGAIITWIGMNSRSTSLSVSLVLVGVVTLYLGAMVQADSGCIVSWKNKELKCXXXXXXXXXXXXXXXXXXXXXXXXXXLASAIQKAHEEDICGIRSVXXLENLMWRQITSELNHILSENEVKLTIMTGDTKGIMQXXXXXLKPQPTELRYSWKTWGKAKVLXXXXHNQTFLIDGPETTECPNSNRAWNXXEVEDYGFGVFSTNIWLKLKERQDXXXDSKLMSAAVKNNRAVHADMGYWIESRLNDTWKIEKASFIEIKSCHWPRSHTLWSNXVLESEMVIPKSFAGPVSQHNNRPGYYTQTTGPWHLGRLEMDFDLCDGTTVVVTENCGNRGPSLRXXXXXXXXXXXXXXXXXXXXXXXXXXXXXXXXXXXXXPLKEREENLVSSLVTAGHGQIDNFSLGILGMALLLEEMLKTRVGTKHAXXXXXXSLVTLITGNLSFKDLGRVIIMVGAXXTDDIGIGITYLALLAAFKVRPTFAAGLFLRKLTSKELLMATIGVXXXXXXXXXXTVLELTDAIALGIMVLKXXXXLEKYQLAVTIMTXXCIPNVMILQHAWXXXXXXXXXVSVSPLILTSSRQKTDWIPLALTVKGLNPTAIFLTTLSRPNKTRSWPLNEAIMXXXXXXXXXXXXXXXXXXXXXXXXXXXXXXXXXXXXXRSADLELEKAAEVKWDDHAEISGSSPILSVTISEDGSMSIKNEEEEQILTILIRTGLLVISGLFPVSMPITAAAWYXXXXXXXXXXVLWDVPSPPPVGRAELEDGAYRIKQRRILGYSQIGAGXXXXXXXXXMWHVTRGAVLVHKGKRIEPSWADVKKDLVSYGGGWXXXXXXXXXXXXXXXXXXXXXXXRAVQTKPGLFRTSTGTIGAVSLDXXPGTSGSPIVDKKGKVVGLYXXXVVTRSGTYVSAIAQTEKNIEDNPDIEDDIFRKRKLTIMDLHPGXXXXXXXXXXXXXXXXXXXXXXXXXXXXXXXXXXXXXXXXXLPIRYQTPAIKAEHTGREIVDXXXXXXXXXXXXXXXXXXXXXXXXXXXXXXXXXXXXXXXXXXXXXXXXXXXXXXXXXXXXXXXXDPFPQSNAPIVDEEREIPERSWNSGYEWITNFEGKTVWFVPSIRAGNDIAACLRXXXXXXXXLSRKTFDTEYTKTRSNDWDFVVTTDXXXXXXXXXXXXXXXXXXXXXXVILTEGEERVILAGXXXXXXXXXXQRRGRIGRNPRNENDQXXXXXXXXXXXXXXXXXXXXXXXXXXXXXXXXXXXXXXXXXXXXXXXXXXXXXXXXXXXXXXXXXXXRGDLPVWLAYKVAAEGINYADRRWCFDGIRNNQILEENMEVEVWTKEGEXXXXXXXXXXXXXXXXXXXXXXXXXFAAGRKSLTLSLITEMGKLPTFMTQKARDALDNLAVLHTAEAGGKAYTHALSELPXXXETLLLLTLLAAVTGGIFLFLMSGKGMGKMTLGMCCXXXXXXXXXXXXXXXXXXXXXXXXXXXXXXXXXXXXXXXXXXXXXXLTYVVIAILTLVAATXXXXXXFLEKTKKDLGFGXXXXXEPEINILDIDLRXXXXXXXXXXXXXXXXXXXXXXXXXXXXXXXXXXXXXXXXXXXXXXXXXXXXXXXXXXXXXXXXXXXXVNPITLTAALLSLMAHYAIIGPGLXXXXXXXXXXXXXXXXXXXXTVDGVTVIDLDPIPYXXXXXXXXXXXXXXXXXXXXXXXXXXXXXXXXXXXXXXXXISTLWEGNPGKXXXXXXXXXXXXXXXXXXXXXXGLLFSIMKNTANXRRGTGNTGETLGEKWKSRLNTLGRSEFQTYKKSGIQEVDXXXXXXXXXXXXXXXXXXXXXXXXLRWFVERNLVAPEGKVVDLGCXXXGWSYYCGGLKDVREVKGLTKGXXXXXXXXXXXXXXXXXXRLQSGVDVFFVPPEKCDTLLCXXXXXXXXXXIEAGRTLRVLNLVENWLNNDTQFCIKVLNPYMPSVIERMETLQRKFGGALVRNPLXXXXXXXXXXXXXXXXXXXXXXXXXXRMLINRFTMRHKKTTYEPDVDXGSGTRNIGIECEVPNLDIIGKRIEKIKEEHEASWHYDQDHPYXXXXXXXXXXXXXXXXXXXXXXXXVRLLTKPWDVIPMVTQMAMTDXXXXXXXXXXXXXXXXXXXXXXXGTKKLMRITAEWLWGELGRRKTPRICTRAEFCNKVRSNAALGAXXXXXXXWKSAREAVEDSGFWELIEKERNLHLDGKCXXXXXXXXXXXXXXXXXXXXXXXXXXXXXXXXXXXXXXXXXXXXXXXXXXXXXXXXLSGVEGEGLHRLGYILREISKKAGGAMYADDTAGWDTRITSEDLKNEEMITDQMXGRHKKLAEAIFRLTYXXXXXXXXXXXXXXXXXXXXXRRDQRGSGQVVTXXXXXXXXXXXQLIRQMEGEGLFKXXXXXXXXXXXXXXXXXXXXGRERLTRMAISGDDCVXXXXDDRFARALTALNDMGKXXXXIQQWEPSKGWSDWTQVPFXXXXXXXXXMKDGRILVVPCRXXXXXXXXXXXXXXXXXXXXXXXXXXXXXXXXXXXXXXXXXXXXXXXXXXXXXXXXXXXXTSRTTWSIHASHEWMTTEDMLTVWNRVWILDNPWMEDKTPVESWEDIPYLGKREDQXXXXXXXXXSRATWAKNIQVAINQVRSLMGNEEYIDYMPSMKRFRSEEEESGVLW

SEQ ID NO: 265735 - protein, 3391 aa, Dengue virus
  MOD_RES (1)..(61): Any amino acid
  MOD_RES (87)..(91): Any amino acid
  MOD_RES (104)..(108): Any amino acid
  MOD_RES (156)..(158): Any amino acid
  MOD_RES (177)..(184): Any amino acid
  MOD_RES (207)..(230): Any amino acid
  MOD_RES (287)..(321): Any amino acid
  MOD_RES (382)..(389): Any amino acid
  MOD_RES (449)..(480): Any amino acid
  MOD_RES (494)..(497): Any amino acid
  MOD_RES (519)..(598): Any amino acid
  MOD_RES (651)..(652): Any amino acid
  MOD_RES (674)..(701): Any amino acid
  MOD_RES (716)..(724): Any amino acid
  MOD_RES (746)..(753): Any amino acid
  MOD_RES (788)..(817): Any amino acid
  MOD_RES (836)..(844): Any amino acid
  MOD_RES (874)..(878): Any amino acid
  MOD_RES (900)..(903): Any amino acid
  MOD_RES (927)..(934): Any amino acid
  MOD_RES (952)..(955): Any amino acid
  MOD_RES (974)..(976): Any amino acid
  MOD_RES (1008)..(1017): Any amino acid
  MOD_RES (1072)..(1120): Any amino acid
  MOD_RES (1160)..(1165): Any amino acid
  MOD_RES (1190)..(1191): Any amino acid
  MOD_RES (1236)..(1245): Any amino acid
  MOD_RES (1263)..(1267): Any amino acid
  MOD_RES (1279)..(1280): Any amino acid
  MOD_RES (1293)..(1301): Any amino acid
  MOD_RES (1327)..(1331): Any amino acid
  MOD_RES (1352)..(1392): Any amino acid
  MOD_RES (1425)..(1448): Any amino acid
  MOD_RES (1468)..(1478): Any amino acid
  MOD_RES (1490)..(1495): Any amino acid
  MOD_RES (1514)..(1525): Any amino acid
  MOD_RES (1545)..(1581): Any amino acid
  MOD_RES (1603)..(1632): Any amino acid
  MOD_RES (1666)..(1713): Any amino acid
  MOD_RES (1731)..(1815): Any amino acid
  MOD_RES (1837)..(1859): Any amino acid
  MOD_RES (1874)..(2016): Any amino acid
  MOD_RES (2063)..(2121): Any amino acid
  MOD_RES (2143)..(2161): Any amino acid
  MOD_RES (2180)..(2264): Any amino acid
  MOD_RES (2277)..(2345): Any amino acid
  MOD_RES (2369)..(2477): Any amino acid
  MOD_RES (2489)..(2489): Any amino acid
  MOD_RES (2525)..(2558): Any amino acid
  MOD_RES (2572)..(2578): Any amino acid
  MOD_RES (2598)..(2615): Any amino acid
  MOD_RES (2637)..(2654): Any amino acid
  MOD_RES (2676)..(2676): Any amino acid
  MOD_RES (2700)..(2730): Any amino acid
  MOD_RES (2748)..(2749): Any amino acid
  MOD_RES (2788)..(2815): Any amino acid
  MOD_RES (2837)..(2859): Any amino acid
  MOD_RES (2899)..(2909): Any amino acid
  MOD_RES (2939)..(3001): Any amino acid
  MOD_RES (3025)..(3035): Any amino acid
  MOD_RES (3049)..(3050): Any amino acid
  MOD_RES (3062)..(3161): Any amino acid
  MOD_RES (3178)..(3208): Any amino acid
  MOD_RES (3221)..(3280): Any amino acid
  MOD_RES (3331)..(3348): Any amino acid
  MOD_RES (3371)..(3391): Any amino acid
XXXXXXXXXXXXXXXXXXXXXXXXXXXXXXXXXXXXXXXXXXXXXXXXXXXXXXXXXXXXXTTGILKRWGTIKKSRAINVLRGFRKXXXXXLNILNRRRRSVGXXXXXIPTAIAFHLTTRNGEPHMIVSIQEKGKSLLFKTEVGINMCTLMAMDLXXXCEDTVTYKCPLLKQNEPEXXXXXXXXTSTWITYGTCTSTGEHRREKRSXXXXXXXXXXXXXXXXXXXXXXXXWKQAQRIETWILRHPGFAIMAAVLAYTIGTTHFQRTLIFILLTTVAPSMAMRCIGIXXXXXXXXXXXXXXXXXXXXXXXXXXXXXXXXXXXDFELTKTEAKESATLRKYCVEAKLTNTTTDSRCPTQGEPSLVEEQDKRFLCKHSMVDRGWXXXXXXXXKGGIVTCAMFTCKKNMKGKIVQPENLEYTVVVTPHSGEEYAVGNDTGKHGKEVKITPQSXXXXXXXXXXXXXXXXXXXXXXXXXXXXXXXXMESKAWLVHRQWFXXXXLPWLPGADTQESNWIQKEMLVXXXXXXXXXXXXXXXXXXXXXXXXXXXXXXXXXXXXXXXXXXXXXXXXXXXXXXXXXXXXXXXXXXXXXXXXXXXXXXXXTIVVRIQYEGDGSPCKVPFEIMDLERRYILGRLITVNPIITEKDNPINIEAEXXFGDSYIIIGVEPGQLKLDWFRXXXXXXXXXXXXXXXXXXXXXXXXXXXXFGSLGGAFTSIGKAXXXXXXXXXGAAFNGVSWIMKIFIGVIITWXXXXXXXXSLSVTLVLVGVITLYLGVMVQADSGCIVSWKNKEXXXXXXXXXXXXXXXXXXXXXXXXXXXXXXASAIQKAHEDGICGIRSVXXXXXXXXXQITPELNHILSENEAKLTIMTGEIKGIMQXXXXXLQPQPTQLKYSWKTWGKAKILXXXXQNQTFLIDGPETVECPNTNRAWNXXXXXXXXFGIFTTNIWLRLREKQDXXXXSKLMSAAIKNNRAVHADMXXXMESALNDTWKMEKASFIEVKSCHWPRSHTLWXXXXXXXXXXIPKNFAGPVSQHNNRPGYHTQITGPWHLGKLEMDFEFCEGTTVVVTENCGNRGPXXXXXXXXXXXXXXXXXXXXXXXXXXXXXXXXXXXXXXXXXXXXXXXXXVNSLVTAGQGQVDNFSLGVLGMALFLEEMLRTRMGTKHAXXXXXXSFLTLITGNMSFRDLGRVVVMVGTXXTDDIGIGVTYLALLAAYRVRPTFAAGLLLKKLTSKELMMATIGVXXXXXXXXXXSILELTDALALGMMILKXXXXXEKYQLAVTIMVXXCVPNAVILLNAWXXXXXXXXXVSVSPLLLTSSQQKTDWIPLVLIIKXXXXXAIFLTTLSRPNKIRSWPLNEXXXXXXXXXXXXXXXXXXXXXXXXXXXXXXXXXXXXXXXXXSADLELEKAADVRWEDHAEISGSSPILSIIISXXXXXXXXXXXXXXXXXXXXXXXXLVISGLFPVSIPVTAAAWYXXXXXXXXXXXLWDVPSPPPIGXXXXXXGAYRIKQKGIFGYSQIGAXXXXXXXXXXXXHVTRGAVLTHKGKRIEPSWXXXXXXXXXXXXXXXXXXXXXXXXXXXXXXXXXXXXXRAVQTKPGLFKTSTGTIGAVSXXXXXXXXXXXXXXXXXXXXXXXXXXXXXXGGAYVSAIAQTEKGIENNPEIEDHIFRKRRLTIXXXXXXXXXXXXXXXXXXXXXXXXXXXXXXXXXXXXXXXXXXXXXXXXPIRYQTTAIKTEHTGREXXXXXXXXXXXXXXXXXXXXXXXXXXXXXXXXXXXXXXXXXXXXXXXXXXXXXXXXXXXXXXXXXXXXXXXXXXXXXXXXXXXXXERSWNTGHEWITDFKGKTVWFXXXXXXXXXXXXXXXXXXXXXXXLSRKTFDSEYAKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPVWLAFKVASEGISYADRRWCFDGTRNNQILEENIEVEIWTKEGEXXXXXXXXXXXXXXXXXXXXXXXXXXXXXXXXXXXXXXXXXXXXXXXXXXXXXXXXXXXAVLHTAEVGGRAHNHALSELPXXXXXXXXXXXXXXXXXXXFLFLMSGRGVGKMTLGMCXXXXXXXXXXXXXXXXXXXXXXXXXXXXXXXXXXXXXXXXXXXXXXXXXXXXXXXXXXXXXXXXXXXXXXXXXXXXXXXXXXXXXQHESNILDIDLRXXXXXXXXXXXXXXXXXXXXXXXXXXXXXXXXXXXXXXXXXXXXXXXXXXXXXXXXXXXXXXXXXXXXXNPVTLTAALLLLVAHYAIIGPALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLFSIMRNTTSXRRGTGNVGETLGEKWKNRLNSLGKNEFQIYKKSGIXXXXXXXXXXXXXXXXXXXXXXXXXXXXXXXXXXRNMVAPEGKVVDLXXXXXXXSYYCGGLKSVREVKGLTKGXXXXXXXXXXXXXXXXXXRLQSGVDVFFTPPERCDTLLCXXXXXXXXXXXXXXXXXXVLNLVESWLGSNTQFCVKVLNXYMPSVIERMEAMQRRYGGALVRNXXXXXXXXXXXXXXXXXXXXXXXXXXXXXXXINRFTMRHKRATYEPDVXXGSGTRNIGTESETPNMDIIGKRIEKIKQEHEASWHYDQXXXXXXXXXXXXXXXXXXXXXXXXXXXXVKLLTKPWDVLPMVTQMAMTDXXXXXXXXXXXXXXXXXXXXXXXGTKKLMKITAKWLWKELGKKKIPRMCTREEFARKVRSNAXXXXXXXXXXXWKSAREAVEDNRFWELVERERNLHLDGKCXXXXXXXXXXXXXXXXXXXXXXXXXXXXXXXXXXXXXXXXXXXXXXXXXXXXXXXXXXXXXXXGLHKLGYILREISKKAGGAMYADXXXXXXXXXXXEDLKNEEMITGQMXXEHKKLAEAIFRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDRFAKALTALNDMGKXXXXXXXXXXXXXXXXXXXXXXXXXXXXXXXMKDGRKLVVPCRXXXXXXXXXXXXXXXXXXXXXXXXXXXXXXXXXXXXXXXXXXXXXXXXXXXXXXXXXXXXTSRTTWSIHARHEWMTTEDMLTVWNRVWIQDNPWMEDKTPVETWEEIPYLXXXXXXXXXXXXXXXXXXTWARNIQTAINQVRSLIGSEEYXXXXXXXXXXXXXXXXXXXXX

SEQ ID NO: 265736 - protein, 3391 aa, Dengue virus
  MOD_RES (1)..(69): Any amino acid
  MOD_RES (83)..(91): Any amino acid
  MOD_RES (104)..(119): Any amino acid
  MOD_RES (140)..(143): Any amino acid
  MOD_RES (156)..(163): Any amino acid
  MOD_RES (177)..(241): Any amino acid
  MOD_RES (253)..(258): Any amino acid
  MOD_RES (284)..(328): Any amino acid
  MOD_RES (352)..(352): Any amino acid
  MOD_RES (371)..(391): Any amino acid
  MOD_RES (415)..(418): Any amino acid
  MOD_RES (449)..(480): Any amino acid
  MOD_RES (493)..(497): Any amino acid
  MOD_RES (516)..(600): Any amino acid
  MOD_RES (640)..(701): Any amino acid
  MOD_RES (716)..(731): Any amino acid
  MOD_RES (745)..(754): Any amino acid
  MOD_RES (782)..(818): Any amino acid
  MOD_RES (836)..(850): Any amino acid
  MOD_RES (874)..(903): Any amino acid
  MOD_RES (927)..(937): Any amino acid
  MOD_RES (952)..(955): Any amino acid
  MOD_RES (967)..(991): Any amino acid
  MOD_RES (1006)..(1017): Any amino acid
  MOD_RES (1039)..(1043): Any amino acid
  MOD_RES (1067)..(1121): Any amino acid
  MOD_RES (1140)..(1166): Any amino acid
  MOD_RES (1189)..(1191): Any amino acid
  MOD_RES (1203)..(1205): Any amino acid
  MOD_RES (1225)..(1245): Any amino acid
  MOD_RES (1257)..(1280): Any amino acid
  MOD_RES (1293)..(1302): Any amino acid
  MOD_RES (1324)..(1331): Any amino acid
  MOD_RES (1349)..(1392): Any amino acid
  MOD_RES (1416)..(1451): Any amino acid
  MOD_RES (1465)..(1478): Any amino acid
  MOD_RES (1490)..(1497): Any amino acid
  MOD_RES (1514)..(1583): Any amino acid
  MOD_RES (1603)..(1636): Any amino acid
  MOD_RES (1649)..(1651): Any amino acid
  MOD_RES (1663)..(1818): Any amino acid
  MOD_RES (1834)..(1859): Any amino acid
  MOD_RES (1874)..(2020): Any amino acid
  MOD_RES (2047)..(2121): Any amino acid
  MOD_RES (2134)..(2161): Any amino acid
  MOD_RES (2180)..(2264): Any amino acid
  MOD_RES (2276)..(2345): Any amino acid
  MOD_RES (2358)..(2477): Any amino acid
  MOD_RES (2489)..(2489): Any amino acid
  MOD_RES (2524)..(2619): Any amino acid
  MOD_RES (2636)..(2655): Any amino acid
  MOD_RES (2675)..(2687): Any amino acid
  MOD_RES (2699)..(2760): Any amino acid
  MOD_RES (2773)..(2773): Any amino acid
  MOD_RES (2786)..(2863): Any amino acid
  MOD_RES (2891)..(2910): Any amino acid
  MOD_RES (2935)..(3002): Any amino acid
  MOD_RES (3025)..(3208): Any amino acid
  MOD_RES (3221)..(3299): Any amino acid
  MOD_RES (3328)..(3354): Any amino acid
  MOD_RES (3371)..(3391): Any amino acid
XXXXXXXXXXXXXXXXXXXXXXXXXXXXXXXXXXXXXXXXXXXXXXXXXXXXXXXXXXXXXXXXXXXXXGAIKKSRAINVLRXXXXXXXXXLNILNRRRRTVGXXXXXXXXXXXXXXXXRNGEPHMIVSKNEKGKSLLFXXXXGINMCTLMAIDLXXXXXXXXTYNCPLLKQNEPEXXXXXXXXXXXXXXXXXXXXXXXXXXXXXXXXXXXXXXXXXXXXXXXXXXXXXXXXXXXXXXXXXLRHPGFTTMAAXXXXXXGTTHFQKALIFILLTTVAPSMTMRCXXXXXXXXXXXXXXXXXXXXXXXXXXXXXXXXXXXXXXXXXXXXXEAKQSATLRKYCIEARLTNTTTEXRCPTQGEPSLSEEQDKRFXXXXXXXXXXXXXXXXXXXXXGIVTCAMFSCLKKMEGKVVQPENXXXXIMITPHSGEEHAVGNDTGKHGMEIKVTPQSXXXXXXXXXXXXXXXXXXXXXXXXXXXXXXXXMGNKAWLVHRQWXXXXXLPWLPGADIQGSNWIQKEXXXXXXXXXXXXXXXXXXXXXXXXXXXXXXXXXXXXXXXXXXXXXXXXXXXXXXXXXXXXXXXXXXXXXXXXXXXXXXXXXXXXXVIRLQYEGEGAPCKIPFEIMDLEKRYILGRLITVNPIATXXXXXXXXXXXXXXXXXXXXXXXXXXXXXXXXXXXXXXXXXXXXXXXXXXXXXXXXXXXXXXFGSLGGVFTSMGKAXXXXXXXXXXXXXXXXSWTMKIFIGVIITXXXXXXXXXXLSVTLVLVGVVILYLGAMVQADSGCIVXXXXXXXXXXXXXXXXXXXXXXXXXXXXXXXXXXXXXSAIQKAYEEGICGIRSVXXXXXXXXXXXXXXXNHILTENEVKMTIMTGDIKGIMHXXXXXXXXXXXXXXXXXXXXXXXXXXXXXXHNRTFLIDGPETAECPNANRAWNXXXXXXXXXXXFTTNIWLRLKEKQDXXXXSKLMSAAIKDSXXXXXXXXXXXXXXXXXXXXXXXXXFIEVKSCHWPRSHTXXXXXXXXXXXXIPKGIAGPVSQHNYRLGYHTQXXXXXHLGKLEMDFNFCEGTTVVVTENCXXXXXXXXXXXXXXXXXXXXXXXXXXXXXXXXXXXXXXXXXXXXXXXXXXXXXXXNSLVTAGYGQIDNFSLGVXXXXXXXXXXXXXXXXXXXXXXXXXXXFVTLITGNLSFKDLGRVIVMVGXXXTDDIGIGVTYLXXXAAFKVRPTFAAGLLLRRLTXXXXXXXXXXXXXXXXXXXXXNILELTDALALXXXXXXXXXXXXXXXXXXXXXXXXCVPNAVVLQNAWXXXXXXXXXXSVFPLLLTSSRQKADWIPLALXXXXXXXXAIFLTTLTRTSKKRSWPXXXXXXXXXXXXXXXXXXXXXXXXXXXXXXXXXXXXXXXXXXXXSADLELERAAEVKWEEQAEISGSXXXXXXXXXXXXXXXXXXXXXXXXXXXXXXXXXXXXSGVFPVSIPVTAAXXXXXXXXXXXXXXLWDVPSPPPMEXXXXXXXXYRIKQRGFLGYSQIGAXXXXXXXXXXXXXXXXXXXXXXXXXXXXXXXXXXXXXXXXXXXXXXXXXXXXXXXXXXXXXXXXXXXXXXVQTKPGIFKTNTGIIGAVSXXXXXXXXXXXXXXXXXXXXXXXXXXXXXXXXXXVSSIAQTETSVEXXXEIEDHIFRKRRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWNSGHEWITNFEGKTXXXXXXXXXXXXXXXXXXXXXXXXXXLSRKTFDTEYIKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAYKVASEGISYTDRKWCFDGIRNNQXXXXXXXXXXXXXXXXXXXXXXXXXXXXXXXXXXXXXXXXXXXXXXXXXXXXXXXXXXXXXXXXXXXXXXXXXXXAVLHSAEMGGRAXXXXXXXXXXXXXXXXXXXXXXXXXXXXFLFLMSARGMGKMTLGMCXXXXXXXXXXXXXXXXXXXXXXXXXXXXXXXXXXXXXXXXXXXXXXXXXXXXXXXXXXXXXXXXXXXXXXXXXXXXXXXXXXXXXQHESNILDIDLXXXXXXXXXXXXXXXXXXXXXXXXXXXXXXXXXXXXXXXXXXXXXXXXXXXXXXXXXXXXXXXXXXXXXXNPITLTAALLMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLFSIMKNTINXRRGTGTIGETLGEKWKSQLNALGKNEFQIYKKSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGIDVFFIPPERCDTLLXXXXXXXXXXXXXXXXXXXXLNLVENWLNNNIQFCIKVLXXXXXXXXXXXXXLQRKHGGALVRXXXXXXXXXXXXXXXXXXXXXXXXXXXXXXXXXXXXXXXXXXXXXXXXXXXXXXXXXXXXXXEKPNLDIIGKRIXKIKQEHETSWHHXXXXXXXXXXXXXXXXXXXXXXXXXXXXXXXXXXXXXXXXXXXXXXXXXXXXXXXXXXXXXXXXXXXXXXXXXXXXXXLMRITAKWLWKELGRKKTPRVCTREEFXXXXXXXXXXXXXXXXXXXXKSAREAVEDERFWELVERERNLHLXXXXXXXXXXXXXXXXXXXXXXXXXXXXXXXXXXXXXXXXXXXXXXXXXXXXXXXXXXXXXXXXXXXXLHKLGYILRDISKKEGGTMYADXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKDGRMLVVPCRXXXXXXXXXXXXXXXXXXXXXXXXXXXXXXXXXXXXXXXXXXXXXXXXXXXXXXXXXXXXXXXXXXXXXXXXXXXXXXXMLTVWNKVWIQDNPWMEDKTLVESWEEVXXXXXXXXXXXXXXXXXXXXXXXXXXXQTAINQVRSLIGNEGYXXXXXXXXXXXXXXXXXXXXX

SEQ ID NO: 265737 - protein, 3391 aa, Dengue virus
  MOD_RES (1162)..(1162): Any amino acid
  MOD_RES (3101)..(3101): Any amino acid
  MOD_RES (3126)..(3130): Any amino acid
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVXFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTXFTNMEAQLIRQMEGEGVLSKADLEXXXXXEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 265738 - protein, 3391 aa, Dengue virus
  MOD_RES (16)..(27): Any amino acid
  MOD_RES (44)..(57): Any amino acid
  MOD_RES (120)..(121): Any amino acid
  MOD_RES (151)..(155): Any amino acid
  MOD_RES (179)..(192): Any amino acid
  MOD_RES (208)..(213): Any amino acid
  MOD_RES (229)..(231): Any amino acid
  MOD_RES (250)..(250): Any amino acid
  MOD_RES (288)..(309): Any amino acid
  MOD_RES (325)..(340): Any amino acid
  MOD_RES (369)..(396): Any amino acid
  MOD_RES (460)..(491): Any amino acid
  MOD_RES (519)..(542): Any amino acid
  MOD_RES (563)..(573): Any amino acid
  MOD_RES (591)..(595): Any amino acid
  MOD_RES (674)..(719): Any amino acid
  MOD_RES (747)..(751): Any amino acid
  MOD_RES (798)..(836): Any amino acid
  MOD_RES (927)..(939): Any amino acid
  MOD_RES (969)..(982): Any amino acid
  MOD_RES (998)..(1021): Any amino acid
  MOD_RES (1042)..(1053): Any amino acid
  MOD_RES (1075)..(1103): Any amino acid
  MOD_RES (1162)..(1162): Any amino acid
  MOD_RES (1200)..(1203): Any amino acid
  MOD_RES (1219)..(1229): Any amino acid
  MOD_RES (1248)..(1250): Any amino acid
  MOD_RES (1291)..(1291): Any amino acid
  MOD_RES (1351)..(1356): Any amino acid
  MOD_RES (1372)..(1387): Any amino acid
  MOD_RES (1410)..(1411): Any amino acid
  MOD_RES (1436)..(1444): Any amino acid
  MOD_RES (1460)..(1462): Any amino acid
  MOD_RES (1480)..(1496): Any amino acid
  MOD_RES (1521)..(1525): Any amino acid
  MOD_RES (1571)..(1577): Any amino acid
  MOD_RES (1601)..(1611): Any amino acid
  MOD_RES (1636)..(1641): Any amino acid
  MOD_RES (1650)..(1650): Any amino acid
  MOD_RES (1666)..(1674): Any amino acid
  MOD_RES (1690)..(1713): Any amino acid
  MOD_RES (1736)..(1747): Any amino acid
  MOD_RES (1764)..(1775): Any amino acid
  MOD_RES (1837)..(1864): Any amino acid
  MOD_RES (1880)..(1885): Any amino acid
  MOD_RES (1900)..(1917): Any amino acid
  MOD_RES (1957)..(2014): Any amino acid
  MOD_RES (2030)..(2033): Any amino acid
  MOD_RES (2049)..(2054): Any amino acid
  MOD_RES (2070)..(2078): Any amino acid
  MOD_RES (2119)..(2123): Any amino acid
  MOD_RES (2139)..(2152): Any amino acid
  MOD_RES (2210)..(2231): Any amino acid
  MOD_RES (2275)..(2342): Any amino acid
  MOD_RES (2365)..(2412): Any amino acid
  MOD_RES (2443)..(2467): Any amino acid
  MOD_RES (2497)..(2497): Any amino acid
  MOD_RES (2570)..(2605): Any amino acid
  MOD_RES (2625)..(2641): Any amino acid
  MOD_RES (2698)..(2711): Any amino acid
  MOD_RES (2727)..(2728): Any amino acid
  MOD_RES (2751)..(2752): Any amino acid
  MOD_RES (2787)..(2818): Any amino acid
  MOD_RES (2836)..(2846): Any amino acid
  MOD_RES (2897)..(2904): Any amino acid
  MOD_RES (2941)..(2964): Any amino acid
  MOD_RES (2980)..(3035): Any amino acid
  MOD_RES (3063)..(3067): Any amino acid
  MOD_RES (3083)..(3101): Any amino acid
  MOD_RES (3126)..(3130): Any amino acid
  MOD_RES (3155)..(3162): Any amino acid
  MOD_RES (3178)..(3184): Any amino acid
  MOD_RES (3200)..(3232): Any amino acid
  MOD_RES (3262)..(3268): Any amino acid
  MOD_RES (3287)..(3294): Any amino acid
  MOD_RES (3334)..(3347): Any amino acid
  MOD_RES (3375)..(3378): Any amino acid
MNNQRKKAGKPSINMXXXXXXXXXXXXQLAKRFSRELLNGQGPXXXXXXXXXXXXXXAIPPTAGILARWGTFKKSGAIKVLRGFKREISNMLSIINRRKKTSFCLMMMLPATLAFHLTSXXGEPRMIVAKNERGKSLLFKTATGINMCTLXXXXXGEMCDDTVTYKCPLIAEVEPEDIXXXXXXXXXXXXXXTCNQAGERRRDKRSVXXXXXXGMGLDTRAQTWMSAEXXXRQVEKVETWAFRHPGFTIXALFLAHYIGTSLTQKVVIFVLLMLVTPSMAMRCVGVGXXXXXXXXXXXXXXXXXXXXXXCVTTMAKSKPTLDIEXXXXXXXXXXXXXXXXIEGKITNVTTDSRCPTQGEAILPEEQDQXXXXXXXXXXXXXXXXXXXXXXXXXXXXAKFQCLESIEGKVVQHENLKYTVTITVHTGDQHQVGNDTQGVTVEITPQASTVEAVLPEYGTLXXXXXXXXXXXXXXXXXXXXXXXXXXXXXXXXFDLPLPWASGATTETPTWNKKELLVTFXXXXXXXXXXXXXXXXXXXXXXXXTGATEIQTSGGTNIFAGHLKXXXXXXXXXXXGMSYAMCLNAFVLKKEVXXXXXGTILIKVEYKGEDVPCKVPFSTEDGQGKAHSGRLITANPIVTKKDEPINIEAEPPFGESNIIIGIGDKSLKINWYRKGXXXXXXXXXXXXXXXXXXXXXXXXXXXXXXXXXXXXXXXXXXXXXXSAYTALFSGVSWIMKIGIGILLTWIGLXXXXXSMSFSCIVIGVITLYLGAVVQADTGCAVNWKGKELKCGNGIFVTNEXXXXXXXXXXXXXXXXXXXXXXXXXXXXXXXXXXXXXXXENLLWKQVANELNYILWENNIKLTVVVGDTIGILEQGKRALTLQPMELKYSWKTWGKARIVTAEIQNSSFIIDGPNTPECPNVSRAWNVWXXXXXXXXXXXXXIWLKLREMYTQSCDHRLMSAAIKDERAVHXXXXXXXXXXXXXXWKLEKASFIEVKTCTXXXXXXXXXXXXXXXXXXXXXXXXGPISQHNHRPGYYTQTAGPWXXXXXXXXXXXXEGTTVVITESCGTSGPSLTTTXXXXXXXXXXXXXXXXXXXXXXXXXXXXXYGMEIRPINEKEENMVKSLVSAGSGEMDNFTMGILCLAILFEEVLRGKFGKKHMIVGVXFMFVLLLSGQITWRDMARTFIMIGSNASDKMGMGVTYXXXXATFKIQPLLALGFFLXXXXXXXXXXXGVGLAMAATLRLPEDIEQXXXGIALGLMTLKLTTQFETYQLWTALVSLTCSNTMFTLTVAWXTATLILAGVSLLPLCQSSSMRKTDWLPMAVAAMGVPSLPLFIFNLKDTPKRKSWPLNEGXXXXXXVSILASSFLRNDVPMXXXXXXXXXXXXXXXXTGTSADLIVEKAADITWEEEAEXXGVSHNLMVTVDDDGTMKIKDDETEXXXXXXXXXALLIVSGVFPYSIPAXXXVWHTWQKQTRRSGVLWDXXXXXXXXXXXXXXXXXRIKQQGILGKTQVGVGIQKEGVFHXXXXXTRGAVLTHNGKRLEPNWANVKKDLISYGGGWRLNTQWKKGEEVQVXXXXXXXNPKNFQTMPGIFQTTMGEIGAIAXXXXXXXXXXXIINREGKIVGLYGNGVVTKSGGYVXXXXXXNAEPDGPAXELEEEMFRKRNLTIMXXXXXXXXXRKYLPAIIREAIKRRXXXXXXXXXXXXXXXXXXXXXXXXIRYQTTATKSEHTGKEIVDLMCXXXXXXXXXXXXRVPNYNLVVMDEAHFTXXXXXXXXXXXXTRVGMGETAAIFMTATPPGTAEAFPQSNAPIQDEEKDIPERSWNSGNEWITDFVGKTVWFVXXXXXXXXXXXXXXXXXXXXXXXXXXXXDTEYQKTRLNDWDFVXXXXXXEMGANFRADRVIDPXXXXXXXXXXXXXXXXXXAGPMPVTVASAAQRRGRVGRNPPKENDQYIFMGQPLNNDXXXXXXXXXXXXXXXXXXXXXXXXXXXXXXXXXXXXXXXXXXXXXXXXXXXXXXXXXXDLPVWLAYKVASEGIXXXXRKWCFDGERNNQILEXXXXXXIWTKEGERKKLRPRWXXXXXXXXXLALKEFKEFAAGRKSIAFDLVTEIGRVPTHLAYRTRNALDXXXXXHTSEHGGKAYRHAVEXXXXXXXXXXXXXXMILLTGGVMLFLISGKGVGKTSIGLICVIVSSGMLWMADVPLQWIASAIILEFFMMVXXXXXXXXXXXXXXXXXXXXXXGILTLAAIVTANEMGMLETTKRDLGMSKEPGVASSNSYLDVDLXXXXXXXXXXXXXXXXXXXXXXXXXXXXXXXXXXXXXXXXXXXXXXXXXXXXXXXXXXXXXXXXXXXXQVNPLTLTAAVLLLVTHYAIIGXXXXXXXXXXXXXXXXXXXXXXXXXXXXXXXXXXXXXXXXXXXXXXXXVMLLVLCAAQLLLMRTSWAFCEVLTLATGPXXXXXXXXXXXXXXXXXXXXXXXXXRGSYIAGAGLAFSVMKSVGTGRRGTGSQGXTLGEKWKKRLNQLSRKDFDLYKKSGITEVDRIEAKEGLKRGETTHHAVSRGTAKLQWFVERNMVVPEGRVIDXXXXXXXXXXXXXXXXXXXXXXXXXXXXXXXXXXXXMSTYGWNLVKLMTGKDVFYXXXXXXXXXXXXXXXXXPSPIVEEGRTIRVLKMVEPWLRNNQFCIKVLNPYMPAVVEHLERLQRKYGGMLVRNXXXXXXXXXXXXXXNGTGNIVSSVNMVSRXXLNRFTMTYRKPTIERDVDLGAGXXHVNAEPEIPNMDVIGERIRRIKEEHSKTWHYDDEXXXXXXXXXXXXXXXXXXXXXXXXXXXXXXXXKPWDVVPTVIQMAMTDTXXXXXXXXXXXKVDTRTPRPMPGTRRVMGITAGWLWRTLGRNKRPRLCTREEFIKKVRTNAXXXXXXXXENQWDSARAAVEDEEFWKLVDKERELHKQGKCGSCVXXXXXXXXXXXXXXXXXXXXXXXXYMWLGARFLEFEALGXXXXXXXXXXXXXXXXXXXXXXXXXXXXXXXXXXXXXXXXXXXXXXXXXXXXXXXXLHNEEKIIHQMDPEHRQLASAIFKLTYXXXXXKVQRPTPKGTVMDIIXXXXXXXXXXXXXXXXXXXFTNMEAQLVRQMEGEGVLTKADLEXXXXXEKKVTQWLETKGVERLRRMAISGDXXXXXXXXDRFANALFALNDMGKXXXXXXXWQPSKGWQDWQQVPFXXXXXXXXXXXXXXXXXXXXXXXXXXXXXXXXXQGAGWSLKETACLGKAYAQMWALMYFHRRXXXXXXXAICSAVPVHWIPTSRTTWXXXXXXXXMTTEDMLAVWNRVWIEENPWMEDKTPVTTWEDVPYLGKRXXXXXXXXXXXXXXATWAQNILIAIQQVRSLIGDEEFLDYMXXXXRFRKEEELEGAIW

SEQ ID NO: 265739 - protein, 3391 aa, Dengue virus
  MOD_RES (1)..(28): Any amino acid
  MOD_RES (43)..(75): Any amino acid
  MOD_RES (116)..(161): Any amino acid
  MOD_RES (178)..(254): Any amino acid
  MOD_RES (278)..(353): Any amino acid
  MOD_RES (369)..(396): Any amino acid
  MOD_RES (417)..(432): Any amino acid
  MOD_RES (459)..(494): Any amino acid
  MOD_RES (513)..(547): Any amino acid
  MOD_RES (559)..(573): Any amino acid
  MOD_RES (591)..(597): Any amino acid
  MOD_RES (629)..(631): Any amino acid
  MOD_RES (648)..(652): Any amino acid
  MOD_RES (672)..(724): Any amino acid
  MOD_RES (740)..(754): Any amino acid
  MOD_RES (786)..(849): Any amino acid
  MOD_RES (886)..(887): Any amino acid
  MOD_RES (909)..(910): Any amino acid
  MOD_RES (927)..(939): Any amino acid
  MOD_RES (959)..(1053): Any amino acid
  MOD_RES (1075)..(1104): Any amino acid
  MOD_RES (1119)..(1121): Any amino acid
  MOD_RES (1145)..(1153): Any amino acid
  MOD_RES (1162)..(1162): Any amino acid
  MOD_RES (1198)..(1235): Any amino acid
  MOD_RES (1246)..(1254): Any amino acid
  MOD_RES (1266)..(1267): Any amino acid
  MOD_RES (1288)..(1292): Any amino acid
  MOD_RES (1310)..(1311): Any amino acid
  MOD_RES (1348)..(1391): Any amino acid
  MOD_RES (1409)..(1464): Any amino acid
  MOD_RES (1474)..(1551): Any amino acid
  MOD_RES (1568)..(1580): Any amino acid
  MOD_RES (1600)..(1713): Any amino acid
  MOD_RES (1729)..(1748): Any amino acid
  MOD_RES (1763)..(1821): Any amino acid
  MOD_RES (1837)..(1936): Any amino acid
  MOD_RES (1947)..(2103): Any amino acid
  MOD_RES (2118)..(2157): Any amino acid
  MOD_RES (2199)..(2232): Any amino acid
  MOD_RES (2248)..(2256): Any amino acid
  MOD_RES (2274)..(2344): Any amino acid
  MOD_RES (2360)..(2413): Any amino acid
  MOD_RES (2425)..(2427): Any amino acid
  MOD_RES (2440)..(2486): Any amino acid
  MOD_RES (2495)..(2498): Any amino acid
  MOD_RES (2520)..(2521): Any amino acid
  MOD_RES (2548)..(2606): Any amino acid
  MOD_RES (2622)..(2670): Any amino acid
  MOD_RES (2686)..(2730): Any amino acid
  MOD_RES (2746)..(2767): Any amino acid
  MOD_RES (2786)..(2820): Any amino acid
  MOD_RES (2834)..(2847): Any amino acid
  MOD_RES (2870)..(2911): Any amino acid
  MOD_RES (2934)..(3035): Any amino acid
  MOD_RES (3060)..(3102): Any amino acid
  MOD_RES (3126)..(3130): Any amino acid
  MOD_RES (3149)..(3246): Any amino acid
  MOD_RES (3262)..(3271): Any amino acid
  MOD_RES (3284)..(3294): Any amino acid
  MOD_RES (3310)..(3314): Any amino acid
  MOD_RES (3329)..(3348): Any amino acid
  MOD_RES (3363)..(3378): Any amino acid
XXXXXXXXXXXXXXXXXXXXXXXXXXXXLAKRFSKELLNGQGXXXXXXXXXXXXXXXXXXXXXXXXXXXXXXXXXGAIKVLKSFKKEISNMLSIINKRKKTSLCLVMILPATLAFXXXXXXXXXXXXXXXXXXXXXXXXXXXXXXXXXXXXXXXXXXXXXXTVTYKCPLVAEVEPEDXXXXXXXXXXXXXXXXXXXXXXXXXXXXXXXXXXXXXXXXXXXXXXXXXXXXXXXXXXXXXXXXXXXXXXXXXXXXXAHYVGTSLTQKAVIFTLLMLVTPXXXXXXXXXXXXXXXXXXXXXXXXXXXXXXXXXXXXXXXXXXXXXXXXXXXXXXXXXXXXXXXXXXXXXXXXXXXXCPTQGEATLPEEQDQXXXXXXXXXXXXXXXXXXXXXXXXXXXXAKFQCLELIEGKAVQHENLKXXXXXXXXXXXXXXXXNDTQGVTAEITPQASTVEVILPEYGTXXXXXXXXXXXXXXXXXXXXXXXXXXXXXXXXXXXXPLPWTSGATAETPIWNRKXXXXXXXXXXXXXXXXXXXXXXXXXXXXXXXXXXXIQNSGGTTIFAXXXXXXXXXXXXXXXGMSYAMCSGSFVLKKEVXXXXXXXILIKVEYRGEDVPCKVPFSTEDEQGKVHNGRXXXANPVVTKKEEPINIEAXXXXXESNIVIGTGDNALKINWYRXXXXXXXXXXXXXXXXXXXXXXXXXXXXXXXXXXXXXXXXXXXXXXXXXXXXXLFGGVSWVMKIGIGIXXXXXXXXXXXXXXXFSCIAIGIITLYLGTVVQADMGCVVNWKGKEXXXXXXXXXXXXXXXXXXXXXXXXXXXXXXXXXXXXXXXXXXXXXXXXXXXXXXXXXXXXXXXXYILWENNVKLTVVVGDITGVLEQGKRTLIPQPMELKXXWKTWGKAKIVIAETQNFSFIIXXPNTPECPSTSRAWNVWXXXXXXXXXXXXXIWLKLREVHTQTCDHRLMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGTTVVIAENCGTRGPSLRATXXXXXXXXXXXXXXXXXXXXXXXXXXXXXXGMEIRPVNEKEENMXXXLVSAGSGKADNFTMGALCLAILFXXXXXXXXXKKHMIAGAXLIFVLLLSGQITWRDMTHTLIMIGSNATDRMGMGVXXXXXXXXXXXXXXXXXXXXXXXXXXXXXXXXXXXXXXTTTLQLPADIXXXXXXXXXGLMALKLTTQFXXYQLWTALVSLMCANTIFTLTXXXXXATLILAVISLLPMCQSSXXRKSDWLPVTVAAMGAQPLPLFIFSLKDTPKRKSWPLXXXXXXXXXXXXXXXXXXXXXXXXXXXXXXXXXXXXXXXXXXXXADLTVEKVAEVTWEEEAXXXXXXXXXXXXXXXXXXXXXXXXXXXXXXXXXXXXXXXXXXXXXXXXXXXXXXXXHTWQKRTQRXXXXXXXXXXXXXXXXXXXXXXXXXXXXXXXXXXXXXXXXXXXXXXXXXXXXXXXXXXXXXXXXXXXXXXXXXXXXXXYGGGWKLSAQWKKGEEXXXXXXXXXXXXXNFQTTPGIFQTITGEIGAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRYQTTVIKSEHTGRXXXXXXXXXXXXXXXXXXXXVPNYNLIVMDEAHFXXXXXXXXXXXXXXXXXXXXXXXXXXXXXXXXXXXXXXXXXXXXXXXXXXXXXXXXXXXNDWITDFTGKTVWFVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRNSQKENDQYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVPSHLAYRTRSALXXXXXXXXXXXXXXXXXXXXXXXXXXXXXXXXXXXXXXXXGGAMLFLISGKGIGKATIGLICVVASSGMLWMAEVPLQWIAXXXXXXXXXXXXXXXXXXXXXXXXXXXXXXXXXXILTLAAIVTANEMGLXXXXXXXXXMSKEPGVVSPNSYLDVDXXXXXXXXXXXXXXXXXXXXXXXXXXXXXXXXXXXXXXXXXXXXXXXXXXXXXXXXXXXXXXXXXXXXXXXNPLTLTAVVLLLVTHXXXXXXXXXXXXXXXXXXXXXXXXXXXXXXXXXXXXXXXXXXXXXXXXXXXXXXMLLILCAVQLLXXXTSWALCEVLTLAXXXXXXXXXXXXXXXXXXXXXXXXXXXXXXXXXXXXXXXXXXXXXXXTGKRGTGLXXXXLGEKWKRKLNQLSRREFDLYKXXGITEVDRSEAKEGLKKREVTHHAVSRXXXXXXXXXXXXXXXXXXXXXXXXXXXXXXXXXXXXXXXXXXXXXXXXXXXXXXXXXXXSTYGWNIIKLMSGKDXXXXXXXXXXXXXXXXXXXXXXXXXXXXXXXXXXXXXXXXXXXXXXXXXILNPYMPTVVEHLERXXXXXXXXXXXXXXXXXXXXXXXXXXXXXXXXXXXXXXXXXXXXXRFTMTYRRPTIERDVXXXXXXXXXXXXXXXXXXXXXXERIKRIKGEHSKTWHYDDXXXXXXXXXXXXXXXXXXXXXXXXXXXXXXXXXXXWDVVPMVIQMAMTXXXXXXXXXXXXXXVDTRTPKPMPGTRRAMGITAEWXXXXXXXXXXXXXXXXXXXXXXXXXXXXXXXXXXXXXXXXXXKAAVEDEEFWILVDRERELHKQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLHNEEKIMQQMDPEHRLLANAIFKXXXXXXXXXXXXXXXXXXXXXXXXXXXXXXXXXXXXXXXXXXXTNMEVQLIRQMEGEGVLSKTDLEXXXXXEKKIIQWLETEGVERLKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKAYAQMWTLMYFHRRXXXXXXXXXXSAVPAHWVPTSRXXXXXXXXXXXMTTEDMLSVWNRVWIXXXXXMGDKTPITTWENVPXXXXXXXXXXXXXXXXXXXXTWAQNILIAIQQVRXXXXXXXXXXXXXXXXRFRKEEETEGAIW

SEQ ID NO: 265740 - protein, 3391 aa, Dengue virus
  MOD_RES (1)..(78): Any amino acid
  MOD_RES (88)..(95): Any amino acid
  MOD_RES (116)..(161): Any amino acid
  MOD_RES (173)..(255): Any amino acid
  MOD_RES (274)..(353): Any amino acid
  MOD_RES (369)..(397): Any amino acid
  MOD_RES (412)..(441): Any amino acid
  MOD_RES (457)..(495): Any amino acid
  MOD_RES (512)..(575): Any amino acid
  MOD_RES (590)..(599): Any amino acid
  MOD_RES (615)..(618): Any amino acid
  MOD_RES (628)..(632): Any amino acid
  MOD_RES (645)..(652): Any amino acid
  MOD_RES (670)..(731): Any amino acid
  MOD_RES (740)..(755): Any amino acid
  MOD_RES (783)..(858): Any amino acid
  MOD_RES (869)..(874): Any amino acid
  MOD_RES (884)..(888): Any amino acid
  MOD_RES (908)..(911): Any amino acid
  MOD_RES (926)..(940): Any amino acid
  MOD_RES (957)..(1055): Any amino acid
  MOD_RES (1074)..(1104): Any amino acid
  MOD_RES (1119)..(1122): Any amino acid
  MOD_RES (1138)..(1153): Any amino acid
  MOD_RES (1162)..(1162): Any amino acid
  MOD_RES (1171)..(1176): Any amino acid
  MOD_RES (1193)..(1270): Any amino acid
  MOD_RES (1286)..(1295): Any amino acid
  MOD_RES (1308)..(1312): Any amino acid
  MOD_RES (1347)..(1393): Any amino acid
  MOD_RES (1409)..(1552): Any amino acid
  MOD_RES (1567)..(1580): Any amino acid
  MOD_RES (1593)..(1716): Any amino acid
  MOD_RES (1727)..(1821): Any amino acid
  MOD_RES (1831)..(2162): Any amino acid
  MOD_RES (2178)..(2179): Any amino acid
  MOD_RES (2199)..(2233): Any amino acid
  MOD_RES (2247)..(2258): Any amino acid
  MOD_RES (2272)..(2349): Any amino acid
  MOD_RES (2358)..(2504): Any amino acid
  MOD_RES (2519)..(2532): Any amino acid
  MOD_RES (2546)..(2610): Any amino acid
  MOD_RES (2621)..(2670): Any amino acid
  MOD_RES (2686)..(2735): Any amino acid
  MOD_RES (2744)..(2767): Any amino acid
  MOD_RES (2786)..(2849): Any amino acid
  MOD_RES (2870)..(2917): Any amino acid
  MOD_RES (2927)..(3041): Any amino acid
  MOD_RES (3060)..(3114): Any amino acid
  MOD_RES (3126)..(3130): Any amino acid
  MOD_RES (3148)..(3318): Any amino acid
  MOD_RES (3329)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXXKVLKSFKKEXXXXXXXXNRRKRTSLCLMMMFPATLAFXXXXXXXXXXXXXXXXXXXXXXXXXXXXXXXXXXXXXXXXXXXXXXTITYKCPHIAEXXXXXXXXXXXXXXXXXXXXXXXXXXXXXXXXXXXXXXXXXXXXXXXXXXXXXXXXXXXXXXXXXXXXXXXXXXXXXXXXXXXHYISTSLTQKVVIFTLLMXXXXXXXXXXXXXXXXXXXXXXXXXXXXXXXXXXXXXXXXXXXXXXXXXXXXXXXXXXXXXXXXXXXXXXXXXXXXXXXXCPTQGEAALPEEQDQXXXXXXXXXXXXXXXXXXXXXXXXXXXXXKFQCLESIEGKAVQXXXXXXXXXXXXXXXXXXXXXXXXXXXXXXITSQASTAEAILPEYXXXXXXXXXXXXXXXXXXXXXXXXXXXXXXXXXXXXXXXLPWTSGTTTETPIWNRXXXXXXXXXXXXXXXXXXXXXXXXXXXXXXXXXXXXXXXXXXXXXXXXXXXXXXXXXXXXXXXXSYAMCLNTFVLRKEXXXXXXXXXXVKVEYKGKDAPCKIPXXXXDGQGKVHNGXXXXXNPVVIKKEEPVNXXXXXXXXESNIIIGTGDNALRINWXXXXXXXXXXXXXXXXXXXXXXXXXXXXXXXXXXXXXXXXXXXXXXXXXXXXXXXXXXXXXXMMKIGIGVXXXXXXXXXXXXXXXXSCITIGIITLYLGVVVQADMGCVVNWKXXXXXXXXXXXXXXXXXXXXXXXXXXXXXXXXXXXXXXXXXXXXXXXXXXXXXXXXXXXXXXXXXXXXXXXXXXXXLTIVVGDVIGXXXXXXRILTPQPMEXXXXXKAWGKAKVVTAENQNSSFIXXXXNTPECPNTSRAWNVXXXXXXXXXXXXXXXWLKLREMYSQLCDHRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTTVVITEDCGTRGPALRTXXXXXXXXXXXXXXXXXXXXXXXXXXXXXXXGMEIRPVSEKEENMXXXXASAGSGKMDNFTMGVXXXXXXXXXXXXXXXXKKHMIAGIXFIFVLLLSXXXXXXDMAHTFIMIGSNTSDRXXXXXXXXXXXXXXXXXXXXXXXXXXXXXXXXXXXXXXXXXXXXXXXXXXXXXXXXXXXXXXXXXXXXXXXXXXXXXXWTALASLTCSNTILTXXXXXXXXXXVLAGVSLLPMCQXXXXXKTDWLPMTVAAMGVSPLPLFIFGLKDALKRRSWPXXXXXXXXXXXXXXXXXXXXXXXXXXXXXXXXXXXXXXXXXXXXXXXLTVEKAPNVTWEEEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGGWRLSAQWKKGEXXXXXXXXXXXXXXNFQTTPGIFQTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQTTVTKSEHTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEWITDFTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLVSGRGIGKASIGLXXVTVSSGMLWMADIPLQWIAXXXXXXXXXXXXXXXXXXXXXXXXXXXXXXXXXXXLTLAATIAANEMGXXXXXXXXXXXXREPGVVSPNSYLDXXXXXXXXXXXXXXXXXXXXXXXXXXXXXXXXXXXXXXXXXXXXXXXXXXXXXXXXXXXXXXXXXXXXXXXXXXXXXXIAAVLLLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKLNQLSRREFDLYXXXXXXXXXXXXXXEGLRRGEITRHAVXXXXXXXXXXXXXXXXXXXXXXXXXXXXXXXXXXXXXXXXXXXXXXXXXXXXXXXXXXXXXXXXXWNIVKLMTGKXXXXXXXXXXXXXXXXXXXXXXXXXXXXXXXXXXXXXXXXXXXXXXXXXXVLNPYMPNVIEHLERXXXXXXXXXXXXXXXXXXXXXXXXXXXXXXXXXXXXXXXXXXXXXXXXXXHRRPTIERXXXXXXXXXXXXXXXXXXXXXXXXERLRRIKEEHSSTWHYDEXXXXXXXXXXXXXXXXXXXXXXXXXXXXXXXXXXXXXXXXXXXXXXXXXXXXXXXXXXXXXXXXTRTPRPMPGTRKAMEITAEWXXXXXXXXXXXXXXXXXXXXXXXXXXXXXXXXXXXXXXXXXXXXXXXXEDFWILVDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITQQMDPEHRRLANAIFKXXXXXXXXXXXXXXXXXXXXXXXXXXXXXXXXXXXXXXXXXXXXXXXXXXXXXXXGEGVLSKVDLEXXXXXEKKITQWLENKGVERLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPITTWEDVPXXXXXXXXXXXXXXXXXXXXXXXXXXXXXXXXXXXXXXXXXXXXXXXXXXXXXXXXXXXXXXX

SEQ ID NO: 265741 - protein, 3391 aa, Dengue virus
  MOD_RES (1)..(95): Any amino acid
  MOD_RES (116)..(163): Any amino acid
  MOD_RES (173)..(262): Any amino acid
  MOD_RES (271)..(443): Any amino acid
  MOD_RES (457)..(496): Any amino acid
  MOD_RES (512)..(575): Any amino acid
  MOD_RES (587)..(654): Any amino acid
  MOD_RES (663)..(859): Any amino acid
  MOD_RES (869)..(888): Any amino acid
  MOD_RES (901)..(911): Any amino acid
  MOD_RES (926)..(941): Any amino acid
  MOD_RES (951)..(1055): Any amino acid
  MOD_RES (1074)..(1122): Any amino acid
  MOD_RES (1138)..(1176): Any amino acid
  MOD_RES (1185)..(1270): Any amino acid
  MOD_RES (1280)..(1299): Any amino acid
  MOD_RES (1308)..(1319): Any amino acid
  MOD_RES (1334)..(1335): Any amino acid
  MOD_RES (1347)..(1393): Any amino acid
  MOD_RES (1408)..(1555): Any amino acid
  MOD_RES (1565)..(2184): Any amino acid
  MOD_RES (2194)..(2259): Any amino acid
  MOD_RES (2271)..(2349): Any amino acid
  MOD_RES (2358)..(2536): Any amino acid
  MOD_RES (2545)..(2768): Any amino acid
  MOD_RES (2780)..(2857): Any amino acid
  MOD_RES (2867)..(2918): Any amino acid
  MOD_RES (2927)..(3044): Any amino acid
  MOD_RES (3059)..(3114): Any amino acid
  MOD_RES (3126)..(3130): Any amino acid
  MOD_RES (3143)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRRKRTSLCLMMVLPAALAFXXXXXXXXXXXXXXXXXXXXXXXXXXXXXXXXXXXXXXXXXXXXXXXXTYKCPFIAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIQKVVIFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPQASITEVILPEYXXXXXXXXXXXXXXXXXXXXXXXXXXXXXXXXXXXXXXXXPWTSGVITKTPTWNRXXXXXXXXXXXXXXXXXXXXXXXXXXXXXXXXXXXXXXXXXXXXXXXXXXXXXXXXXXXXXXXXSYAMCLGSFVLXXXXXXXXXXXXXXXXXXXXXXXXXXXXXXXXXXXXXXXXXXXXXXXXXXXXXXXXXXXXXXXXXXXXNIVIGVGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVVVGDVIGXXXXXXXXXXXXXXXXXXXXKTWGKAKMVTAEXXXXXXXXXXXSTPECPSALRAWNVXXXXXXXXXXXXXXXXLKLRDVYTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTTVVISENCGIRGPSLRTXXXXXXXXXXXXXXXXXXXXXXXXXXXXXXXXXXXXXXXXXXXXXXXXXVSAGSGKVDNFTMGAXXXXXXXXXXXXXXXXXXXXXXXXXXXXXXXXXXXXXXXDLAHTLIMXXXXXXXXXXXXXXXXXXXXXXXXXXXXXXXXXXXXXXXXXXXXXXXXXXXXXXXXXXXXXXXXXXXXXXXXXXXXXXXXXXXXXXWAALVSLMCXXXXXXXXXXXXXXXXXXXXISLLPLCQXXXXXXXXXXXXTVAAMGVQPLPLFIXXLKDAPKRRSWPXXXXXXXXXXXXXXXXXXXXXXXXXXXXXXXXXXXXXXXXXXXXXXXLTVEKAANVTWEEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWRLSAQWKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGMLWIAEIPXXXXXXXXXXXXXXXXXXXXXXXXXXXXXXXXXXXXXXXXXXXXXXXXXXXXXXXXXXXXXXXXXXEPGVVSPISYLXXXXXXXXXXXXXXXXXXXXXXXXXXXXXXXXXXXXXXXXXXXXXXXXXXXXXXXXXXXXXXXXXXXXXXXXXXXXXXXAAAVLLLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRETTHHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRIKRIKEEHDSXXXXXXXXXXXXXXXXXXXXXXXXXXXXXXXXXXXXXXXXXXXXXXXXXXXXXXXXXXXXXXXXXXXXXXXXXXXXXXGTRKAMEITXXXXXXXXXXXXXXXXXXXXXXXXXXXXXXXXXXXXXXXXXXXXXXXXXXXXNFWKLVDRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQMDPEHKQLANAIFXXXXXXXXXXXXXXXXXXXXXXXXXXXXXXXXXXXXXXXXXXXXXXXXXXXXXXXXGEGVLSEADLEXXXXXEKRIAQWLETKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265742 - protein, 3391 aa, Dengue virus
  MOD_RES (1162)..(1162): Any amino acid
  MOD_RES (3101)..(3101): Any amino acid
  MOD_RES (3123)..(3130): Any amino acid
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVXFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRKVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTXFTNMEAQLIRQMEGEGVLSKAXXXXXXXXEKKITQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 265743 - protein, 3391 aa, Dengue virus
  MOD_RES (17)..(18): Any amino acid
  MOD_RES (45)..(56): Any amino acid
  MOD_RES (152)..(154): Any amino acid
  MOD_RES (180)..(191): Any amino acid
  MOD_RES (209)..(212): Any amino acid
  MOD_RES (230)..(230): Any amino acid
  MOD_RES (289)..(308): Any amino acid
  MOD_RES (326)..(339): Any amino acid
  MOD_RES (370)..(395): Any amino acid
  MOD_RES (461)..(490): Any amino acid
  MOD_RES (520)..(541): Any amino acid
  MOD_RES (564)..(572): Any amino acid
  MOD_RES (592)..(594): Any amino acid
  MOD_RES (675)..(718): Any amino acid
  MOD_RES (748)..(750): Any amino acid
  MOD_RES (799)..(835): Any amino acid
  MOD_RES (928)..(938): Any amino acid
  MOD_RES (970)..(981): Any amino acid
  MOD_RES (999)..(1020): Any amino acid
  MOD_RES (1043)..(1052): Any amino acid
  MOD_RES (1076)..(1102): Any amino acid
  MOD_RES (1162)..(1162): Any amino acid
  MOD_RES (1220)..(1228): Any amino acid
  MOD_RES (1249)..(1249): Any amino acid
  MOD_RES (1352)..(1355): Any amino acid
  MOD_RES (1373)..(1386): Any amino acid
  MOD_RES (1437)..(1443): Any amino acid
  MOD_RES (1461)..(1461): Any amino acid
  MOD_RES (1481)..(1492): Any amino acid
  MOD_RES (1522)..(1524): Any amino acid
  MOD_RES (1572)..(1576): Any amino acid
  MOD_RES (1602)..(1610): Any amino acid
  MOD_RES (1637)..(1640): Any amino acid
  MOD_RES (1667)..(1673): Any amino acid
  MOD_RES (1691)..(1712): Any amino acid
  MOD_RES (1737)..(1746): Any amino acid
  MOD_RES (1765)..(1774): Any amino acid
  MOD_RES (1838)..(1863): Any amino acid
  MOD_RES (1881)..(1884): Any amino acid
  MOD_RES (1901)..(1916): Any amino acid
  MOD_RES (1958)..(2013): Any amino acid
  MOD_RES (2031)..(2032): Any amino acid
  MOD_RES (2050)..(2053): Any amino acid
  MOD_RES (2071)..(2077): Any amino acid
  MOD_RES (2120)..(2122): Any amino acid
  MOD_RES (2140)..(2151): Any amino acid
  MOD_RES (2211)..(2230): Any amino acid
  MOD_RES (2276)..(2341): Any amino acid
  MOD_RES (2366)..(2411): Any amino acid
  MOD_RES (2444)..(2466): Any amino acid
  MOD_RES (2571)..(2604): Any amino acid
  MOD_RES (2626)..(2640): Any amino acid
  MOD_RES (2699)..(2710): Any amino acid
  MOD_RES (2788)..(2817): Any amino acid
  MOD_RES (2837)..(2845): Any amino acid
  MOD_RES (2898)..(2903): Any amino acid
  MOD_RES (2942)..(2963): Any amino acid
  MOD_RES (2981)..(3034): Any amino acid
  MOD_RES (3064)..(3066): Any amino acid
  MOD_RES (3084)..(3101): Any amino acid
  MOD_RES (3123)..(3130): Any amino acid
  MOD_RES (3156)..(3161): Any amino acid
  MOD_RES (3179)..(3183): Any amino acid
  MOD_RES (3201)..(3231): Any amino acid
  MOD_RES (3263)..(3267): Any amino acid
  MOD_RES (3288)..(3293): Any amino acid
  MOD_RES (3335)..(3346): Any amino acid
  MOD_RES (3376)..(3377): Any amino acid
MNNQRKKAGKPSINMLXXVRNRVSTGSQLAKRFSRELLNGQGPMXXXXXXXXXXXXLAIPPTAGILARWGTFKKSGAIKVLRGFKREISNMLSIINRRKKTSFCLMMMLPATLAFHLTSRDGEPRMIVAKNERGKSLLFKTATGINMCTLIXXXLGEMCDDTVTYKCPLIAEVEPEDIDXXXXXXXXXXXXGTCNQAGERRRDKRSVAXXXXVGMGLDTRAQTWMSAEGXWRQVEKVETWAFRHPGFTILALFLAHYIGTSLTQKVVIFVLLMLVTPSMAMRCVGVGNXXXXXXXXXXXXXXXXXXXXGCVTTMAKSKPTLDIELXXXXXXXXXXXXXXCIEGKITNVTTDSRCPTQGEAILPEEQDQNXXXXXXXXXXXXXXXXXXXXXXXXXXCAKFQCLESIEGKVVQHENLKYTVTITVHTGDQHQVGNDTQGVTVEITPQASTVEAVLPEYGTLGXXXXXXXXXXXXXXXXXXXXXXXXXXXXXXFFDLPLPWASGATTETPTWNKKELLVTFKXXXXXXXXXXXXXXXXXXXXXXLTGATEIQTSGGTNIFAGHLKCXXXXXXXXXKGMSYAMCLNAFVLKKEVSXXXHGTILIKVEYKGEDVPCKVPFSTEDGQGKAHSGRLITANPIVTKKDEPINIEAEPPFGESNIIIGIGDKSLKINWYRKGSXXXXXXXXXXXXXXXXXXXXXXXXXXXXXXXXXXXXXXXXXXXXGSAYTALFSGVSWIMKIGIGILLTWIGLNXXXTSMSFSCIVIGVITLYLGAVVQADTGCAVNWKGKELKCGNGIFVTNEVXXXXXXXXXXXXXXXXXXXXXXXXXXXXXXXXXXXXXMENLLWKQVANELNYILWENNIKLTVVVGDTIGILEQGKRALTLQPMELKYSWKTWGKARIVTAEIQNSSFIIDGPNTPECPNVSRAWNVWEXXXXXXXXXXXNIWLKLREMYTQSCDHRLMSAAIKDERAVHAXXXXXXXXXXXXSWKLEKASFIEVKTCTWXXXXXXXXXXXXXXXXXXXXXXAGPISQHNHRPGYYTQTAGPWHXXXXXXXXXXCEGTTVVITESCGTRGSSLRTTTXXXXXXXXXXXXXXXXXXXXXXXXXXXWYGMEIRPINEKEENMVKSLVSAGSGEMDNFTMGILCLAILFEEVLRGKFGKKHMIVGVXFMFVLLLSGQITWRDMARTFIMIGSNASDKMGMGVTHLALIATFKIQPLLALGFFLRXXXXXXXXXLGVGLAMAATLRLPEDIEQMXNGIALGLMTLKLTTQFETYQLWTALVSLTCSNTMFTLTVAWRTATLILAGVSLLPLCQSSSMRKTDWLPMAVAAMGVPSLPLFIFNLKDTPKRKSWPLNEGVXXXXLVSILASSFLRNDVPMAXXXXXXXXXXXXXXITGTSADLIVEKAADITWEEEAEQTGVSHNLMVTVDDDGTMKIKDDETENXXXXXXXTALLIVSGVFPYSIPATXLVWHTWQKQTRRSGVLWDVXXXXXXXXXXXXEGVYRIKQQGILGKTQVGVGIQKEGVFHTXXXVTRGAVLTHNGKRLEPNWANVKKDLISYGGGWRLNTQWKKGEEVQVIXXXXXKNPKNFQTMPGIFQTTMGEIGAIALXXXXXXXXXPIINREGKIVGLYGNGVVTKSGGYVSXXXXTNAEPDGPAPELEEEMFRKRNLTIMDXXXXXXXTRKYLPAIIREAIKRRLXXXXXXXXXXXXXXXXXXXXXXPIRYQTTATKSEHTGKEIVDLMCHXXXXXXXXXXVRVPNYNLVVMDEAHFTDXXXXXXXXXXSTRVGMGETAAIFMTATPPGTAEAFPQSNAPIQDEEKDIPERSWNSGNEWITDFVGKTVWFVPXXXXXXXXXXXXXXXXXXXXXXXXXXFDTEYQKTRLNDWDFVVXXXXSEMGANFRADRVIDPRXXXXXXXXXXXXXXXXLAGPMPVTVASAAQRRGRVGRNPPKENDQYIFMGQPLNNDEXXXXXXXXXXXXXXXXXXXXXXXXXXXXXXXXXXXXXXXXXXXXXXXXXXXXXXXXGDLPVWLAYKVASEGIKXXDRKWCFDGERNNQILEEXXXXEIWTKEGERKKLRPRWLXXXXXXXPLALKEFKEFAAGRKSIAFDLVTEIGRVPTHLAYRTRNALDNXXXLHTSEHGGKAYRHAVEEXXXXXXXXXXXXLMILLTGGVMLFLISGKGVGKTSIGLICVIVSSGMLWMADVPLQWIASAIILEFFMMVLXXXXXXXXXXXXXXXXXXXXIGILTLAAIVTANEMGMLETTKRDLGMSKEPGVASSNSYLDVDLHXXXXXXXXXXXXXXXXXXXXXXXXXXXXXXXXXXXXXXXXXXXXXXXXXXXXXXXXXXXXXXXXXXSQVNPLTLTAAVLLLVTHYAIIGPXXXXXXXXXXXXXXXXXXXXXXXXXXXXXXXXXXXXXXXXXXXXXXQVMLLVLCAAQLLLMRTSWAFCEVLTLATGPIXXXXXXXXXXXXXXXXXXXXXXXFRGSYIAGAGLAFSIMKSVGTGRRGTGSQGETLGEKWKKKLNQLSRKDFDLYKKSGITEVDRIEAKEGLKRGETTHHAVSRGTAKLQWFVERNMVVPEGRVIDLXXXXXXXXXXXXXXXXXXXXXXXXXXXXXXXXXXPMSTYGWNLVKLMTGKDVFYLXXXXXXXXXXXXXXXSPSPTVEEGRTIRVLKMVEPWLRNNQFCIKVLNPYMPAVVEHLERLQRKYGGMLVRNPXXXXXXXXXXXXSNGTGNIVSSVNMVSRLLLNRFTMTYRKPTIERDVDLGAGTRHVNAEPEIPNMDVIGERIRRIKEEHSSTWHYDEENXXXXXXXXXXXXXXXXXXXXXXXXXXXXXXTKPWDVVPTVIQMAMTDTTXXXXXXXXXEKVDTRTPRPMPGTRRVMGITAGWLWRTLGRNKRPRLCTREEFIKKVRTNAAXXXXXXEENQWDSARAAVEDEEFWKLVDKERELHKQGKCGSCVYXXXXXXXXXXXXXXXXXXXXXXWYMWLGARFLEFEALGFXXXXXXXXXXXXXXXXXXXXXXXXXXXXXXXXXXXXXXXXXXXXXXXXXXXXXXDLHNEEKIIQQMDPEHRQLASAIFKLTYQXXXVKVQRPTPKGTVMDIISXXXXXXXXXXXXXXXXXXFTNMEAQLVRQMEGEGVLTKAXXXXXXXXEKKVTQWLETKGVERLRRMAISGDDXXXXXXDDRFANALFALNDMGKVXXXXXQWQPSKGWQDWQQVPFCXXXXXXXXXXXXXXXXXXXXXXXXXXXXXXXSQGAGWSLKETACLGKAYAQMWALMYFHRRDXXXXXNAICSAVPVHWIPTSRTTWSXXXXXXWMTTEDMLAVWNRVWIEENPWMEDKTPVTTWEDVPYLGKREXXXXXXXXXXXXRATWAQNILIAIQQVRSLIGDEEFLDYMPXXKRFRKEEELEGAIW

SEQ ID NO: 265744 - protein, 3391 aa, Dengue virus
  MOD_RES (1)..(27): Any amino acid
  MOD_RES (44)..(74): Any amino acid
  MOD_RES (117)..(160): Any amino acid
  MOD_RES (179)..(253): Any amino acid
  MOD_RES (279)..(352): Any amino acid
  MOD_RES (370)..(395): Any amino acid
  MOD_RES (421)..(431): Any amino acid
  MOD_RES (460)..(493): Any amino acid
  MOD_RES (514)..(546): Any amino acid
  MOD_RES (560)..(572): Any amino acid
  MOD_RES (592)..(596): Any amino acid
  MOD_RES (630)..(630): Any amino acid
  MOD_RES (649)..(651): Any amino acid
  MOD_RES (673)..(723): Any amino acid
  MOD_RES (741)..(753): Any amino acid
  MOD_RES (787)..(848): Any amino acid
  MOD_RES (928)..(938): Any amino acid
  MOD_RES (960)..(1052): Any amino acid
  MOD_RES (1076)..(1103): Any amino acid
  MOD_RES (1120)..(1120): Any amino acid
  MOD_RES (1146)..(1152): Any amino acid
  MOD_RES (1162)..(1162): Any amino acid
  MOD_RES (1199)..(1234): Any amino acid
  MOD_RES (1247)..(1253): Any amino acid
  MOD_RES (1289)..(1291): Any amino acid
  MOD_RES (1349)..(1390): Any amino acid
  MOD_RES (1410)..(1463): Any amino acid
  MOD_RES (1475)..(1550): Any amino acid
  MOD_RES (1569)..(1579): Any amino acid
  MOD_RES (1601)..(1712): Any amino acid
  MOD_RES (1730)..(1747): Any amino acid
  MOD_RES (1764)..(1820): Any amino acid
  MOD_RES (1838)..(1935): Any amino acid
  MOD_RES (1948)..(2102): Any amino acid
  MOD_RES (2119)..(2156): Any amino acid
  MOD_RES (2200)..(2231): Any amino acid
  MOD_RES (2249)..(2255): Any amino acid
  MOD_RES (2275)..(2343): Any amino acid
  MOD_RES (2361)..(2412): Any amino acid
  MOD_RES (2426)..(2426): Any amino acid
  MOD_RES (2441)..(2480): Any amino acid
  MOD_RES (2496)..(2497): Any amino acid
  MOD_RES (2549)..(2605): Any amino acid
  MOD_RES (2623)..(2655): Any amino acid
  MOD_RES (2687)..(2729): Any amino acid
  MOD_RES (2747)..(2763): Any amino acid
  MOD_RES (2787)..(2819): Any amino acid
  MOD_RES (2835)..(2846): Any amino acid
  MOD_RES (2873)..(2888): Any amino acid
  MOD_RES (2898)..(2910): Any amino acid
  MOD_RES (2935)..(3034): Any amino acid
  MOD_RES (3061)..(3101): Any amino acid
  MOD_RES (3123)..(3130): Any amino acid
  MOD_RES (3150)..(3245): Any amino acid
  MOD_RES (3263)..(3270): Any amino acid
  MOD_RES (3285)..(3293): Any amino acid
  MOD_RES (3311)..(3313): Any amino acid
  MOD_RES (3330)..(3347): Any amino acid
  MOD_RES (3364)..(3377): Any amino acid
XXXXXXXXXXXXXXXXXXXXXXXXXXXQLAKRFSKELLNGQGPXXXXXXXXXXXXXXXXXXXXXXXXXXXXXXXSGAIKVLKGFKKEISNMLSIINKRKKTSLCLVMILPATLAFHXXXXXXXXXXXXXXXXXXXXXXXXXXXXXXXXXXXXXXXXXXXXDTVTYKCPLVAEVEPEDIXXXXXXXXXXXXXXXXXXXXXXXXXXXXXXXXXXXXXXXXXXXXXXXXXXXXXXXXXXXXXXXXXXXXXXXXXXXLAHYIGTSLTQKAVIFTLLMLVTPSXXXXXXXXXXXXXXXXXXXXXXXXXXXXXXXXXXXXXXXXXXXXXXXXXXXXXXXXXXXXXXXXXXXXXXXXXXRCPTQGEATLPEEQDQNXXXXXXXXXXXXXXXXXXXXXXXXXXCAKFQCLELIEGKAVQHENLKYTVTXXXXXXXXXXXGNDTQGVTAEITPQASTVEVILPEYGTLXXXXXXXXXXXXXXXXXXXXXXXXXXXXXXXXXXLPLPWTSGATAETPIWNRKEXXXXXXXXXXXXXXXXXXXXXXXXXXXXXXXXXEIQNLGGTSIFAGXXXXXXXXXXXXXKGMSYAMCSGSFVLKKEVSXXXXXTILIKVEYRGEDVPCKIPFSTEDEQGKVHNGRLXTANPVVTKKEEPINIEAEXXXGESNIVIGTGDNALKINWYRKXXXXXXXXXXXXXXXXXXXXXXXXXXXXXXXXXXXXXXXXXXXXXXXXXXXALFGGVSWVMKIGIGILXXXXXXXXXXXXXSFSCIAIGIITLYLGTVVQADMGCVVNWKGKELXXXXXXXXXXXXXXXXXXXXXXXXXXXXXXXXXXXXXXXXXXXXXXXXXXXXXXXXXXXXXXNHILWENNVKLTVVVGDITGVLEQGKRTLPPQPMELKYSWKAWGKAKIVIAETQNFSFIIDGPNTPECPSTSRAWNVWEXXXXXXXXXXXNIWLKLREVHTQTCDHRLMSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCEGTTVVIAENCGTKGPSLRTTTXXXXXXXXXXXXXXXXXXXXXXXXXXXXYGMEIRPVNEKEENMVXSLVSAGSGKADNFTMGALCLAILFEXXXXXXXGKKHMIAGAXLIFVLLLSGQITWRDLTHTLIMIGSNATDRMGMGVTXXXXXXXXXXXXXXXXXXXXXXXXXXXXXXXXXXXXMTTTLQLPADIEXXXXXXXLGLMALKLTTQFETYQLWTALVSLMCANTIFTLTVXXXTATLILAVISLLPMCQSSSMRKSDWLPVAVAAMGAQPLPLFIFSLKDTPKRKSWPLNXXXXXXXXXXXXXXXXXXXXXXXXXXXXXXXXXXXXXXXXXXSADLTVEKVAEVTWEEEAEXXXXXXXXXXXXXXXXXXXXXXXXXXXXXXXXXXXXXXXXXXXXXXXXXXXXXXWHTWQKRTQRSXXXXXXXXXXXXXXXXXXXXXXXXXXXXXXXXXXXXXXXXXXXXXXXXXXXXXXXXXXXXXXXXXXXXXXXXXXXXSYGGGWKLSAQWKKGEEVXXXXXXXXXXXKNFQTTPGIFQTTTGEIGAVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPIRYQTSAIKSEHTGREXXXXXXXXXXXXXXXXXXRVPNYNLIVMDEAHFTXXXXXXXXXXXXXXXXXXXXXXXXXXXXXXXXXXXXXXXXXXXXXXXXXXXXXXXXXGNDWITDFTGKTVWFVPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRNSQKENDQYIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRVPSHLAHKTRNALDXXXXXXXXXXXXXXXXXXXXXXXXXXXXXXXXXXXXXXTGGAMLFLVSGKGIGKTSIGLICVVASSGMLWMAEVPLQWIASXXXXXXXXXXXXXXXXXXXXXXXXXXXXXXXXGILTLAAIVTANEMGLLXXXXXXXGMSKEPGVVSPNSYLDVDLXXXXXXXXXXXXXXXXXXXXXXXXXXXXXXXXXXXXXXXXXXXXXXXXXXXXXXXXXXXXXXXXXXXXXVNPLTLTAVVLLLVTHYXXXXXXXXXXXXXXXXXXXXXXXXXXXXXXXXXXXXXXXXXXXXXXXXXXXXVMLLILCAVQLLLXRTSWALCEVLTLATXXXXXXXXXXXXXXXXXXXXXXXXXXXXXXXXXXXXXXXXVMKSVGTGKRGTGLQXXTLGEKWKRRLNQLSWKEFDLYKKSGITEVDRSEAKEGLKKGEVTHHAVSRGXXXXXXXXXXXXXXXXXXXXXXXXXXXXXXXXXXXXXXXXXXXXXXXXXXXXXXXXXMSTYGWNIIKLMSGKDVXXXXXXXXXXXXXXXXXXXXXXXXXXXXXXXXXKMVEPWLKNNQFCIKILNPYMPTVVEHLERLXXXXXXXXXXXXXXXXXXXXXXXXXXXXXXXXXXXXXXXXXXXNRFTMTYRRPTIERDVDXXXXXXXXXXXXXXXXXDVIGERIKRIKGEHSKTWHYDDEXXXXXXXXXXXXXXXXXXXXXXXXXXXXXXXXXPWDVVPMVIQMAMTDXXXXXXXXXXXXKVDTRTPKPMPGTRRAMEITAGWLWRXXXXXXXXXXXXXXXXTRKVRTNAAXXXXXXXXXXXXXAKAAVEDEEFWILVDRERELHKQGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLHNEEKIMQQMDPEHRLLANAIFKLXXXXXXXXXXXXXXXXXXXXXXXXXXXXXXXXXXXXXXXXXFTNMEVQLIRQMEGEGVLSKTXXXXXXXXEKKITQWLETEGVERLKRMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKAYAQMWTLMYFHRRDXXXXXXXXCSAVPAHWVPTSRTXXXXXXXXXWMTTEDMLSVWNRVWIEXXXWMENKTPITTWENVPYXXXXXXXXXXXXXXXXXXATWAQNILIAIQQVRSXXXXXXXXXXXXXXKRFRKEEETEGAIW

SEQ ID NO: 265745 - protein, 3391 aa, Dengue virus
  MOD_RES (1)..(77): Any amino acid
  MOD_RES (91)..(95): Any amino acid
  MOD_RES (117)..(160): Any amino acid
  MOD_RES (173)..(254): Any amino acid
  MOD_RES (275)..(352): Any amino acid
  MOD_RES (370)..(396): Any amino acid
  MOD_RES (409)..(440): Any amino acid
  MOD_RES (458)..(494): Any amino acid
  MOD_RES (513)..(547): Any amino acid
  MOD_RES (559)..(574): Any amino acid
  MOD_RES (591)..(598): Any amino acid
  MOD_RES (616)..(617): Any amino acid
  MOD_RES (629)..(631): Any amino acid
  MOD_RES (646)..(651): Any amino acid
  MOD_RES (672)..(723): Any amino acid
  MOD_RES (741)..(754): Any amino acid
  MOD_RES (784)..(852): Any amino acid
  MOD_RES (869)..(873): Any amino acid
  MOD_RES (885)..(887): Any amino acid
  MOD_RES (909)..(910): Any amino acid
  MOD_RES (927)..(939): Any amino acid
  MOD_RES (958)..(1054): Any amino acid
  MOD_RES (1075)..(1103): Any amino acid
  MOD_RES (1120)..(1121): Any amino acid
  MOD_RES (1139)..(1152): Any amino acid
  MOD_RES (1162)..(1162): Any amino acid
  MOD_RES (1172)..(1178): Any amino acid
  MOD_RES (1194)..(1266): Any amino acid
  MOD_RES (1287)..(1294): Any amino acid
  MOD_RES (1309)..(1311): Any amino acid
  MOD_RES (1348)..(1392): Any amino acid
  MOD_RES (1410)..(1551): Any amino acid
  MOD_RES (1568)..(1579): Any amino acid
  MOD_RES (1593)..(1713): Any amino acid
  MOD_RES (1729)..(1820): Any amino acid
  MOD_RES (1832)..(2106): Any amino acid
  MOD_RES (2116)..(2161): Any amino acid
  MOD_RES (2200)..(2232): Any amino acid
  MOD_RES (2248)..(2257): Any amino acid
  MOD_RES (2273)..(2348): Any amino acid
  MOD_RES (2359)..(2503): Any amino acid
  MOD_RES (2520)..(2528): Any amino acid
  MOD_RES (2547)..(2609): Any amino acid
  MOD_RES (2622)..(2669): Any amino acid
  MOD_RES (2687)..(2734): Any amino acid
  MOD_RES (2745)..(2766): Any amino acid
  MOD_RES (2787)..(2848): Any amino acid
  MOD_RES (2871)..(2913): Any amino acid
  MOD_RES (2928)..(3040): Any amino acid
  MOD_RES (3061)..(3113): Any amino acid
  MOD_RES (3123)..(3130): Any amino acid
  MOD_RES (3149)..(3293): Any amino acid
  MOD_RES (3303)..(3317): Any amino acid
  MOD_RES (3330)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXIKVLKSFKKEISNXXXXXNRRKRTSLCLMMVLPAALAFHXXXXXXXXXXXXXXXXXXXXXXXXXXXXXXXXXXXXXXXXXXXXDTITYKCPHIAEXXXXXXXXXXXXXXXXXXXXXXXXXXXXXXXXXXXXXXXXXXXXXXXXXXXXXXXXXXXXXXXXXXXXXXXXXXXXXXXXXXAHYVGTSLIQKVVIFTLLMLXXXXXXXXXXXXXXXXXXXXXXXXXXXXXXXXXXXXXXXXXXXXXXXXXXXXXXXXXXXXXXXXXXXXXXXXXXXXXXRCPTQGEAALPEEQDQNXXXXXXXXXXXXXXXXXXXXXXXXXXXAKFQCLEPVEGKXXXXXXXXXXXXXXXXXXXXXXXXXXXXXXXXEITPQASTAEAILPEYGXXXXXXXXXXXXXXXXXXXXXXXXXXXXXXXXXXXXXPLPWTSGVTTETPIWNRKXXXXXXXXXXXXXXXXXXXXXXXXXXXXXXXXXXXIQNSGGTTIFAXXXXXXXXXXXXXXXXMSYAMCLNTFVLRKEVXXXXXXXXLVKVEYKGKDAPCKIPFXXEDGQGKVHNGRXXXANPVVIKKEEPVNIXXXXXXGESNIIIGTGDKALKINWYRXXXXXXXXXXXXXXXXXXXXXXXXXXXXXXXXXXXXXXXXXXXXXXXXXXXXALFGGVSWMMKIGIGVLXXXXXXXXXXXXXXFSCITIGIITLYLGVVVQADMGCVVNWKGXXXXXXXXXXXXXXXXXXXXXXXXXXXXXXXXXXXXXXXXXXXXXXXXXXXXXXXXXXXXXXXXXXXXXWENSIKLTIVVGDVIGXXXXXKRILTPQPMELXXXWKTWGKAKVVTAEIQNFSFIIXXPNTPECPNTSRAWNVWXXXXXXXXXXXXXIWLKLREMYSQLCDHRLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTTVVITEDCGTRGPALRTTXXXXXXXXXXXXXXXXXXXXXXXXXXXXXYGMEIRPVSEKEENMVXXLASAGSGKMDNFTMGVLXXXXXXXXXXXXXXGKKHMIAGIXFIFVLLLSGXXXXXXXAHTLIMIGSNTSDRMXXXXXXXXXXXXXXXXXXXXXXXXXXXXXXXXXXXXXXXXXXXXXXXXXXXXXXXXXXXXXXXXXXXXXXXXXTYQLWTALASLTCSNTILTLXXXXXXXXLILAGVSLLPMCQSXXXRKTDWLPMTVAAMGVSPLPLFIFGLKDALKRRSWPLXXXXXXXXXXXXXXXXXXXXXXXXXXXXXXXXXXXXXXXXXXXXXDLTVEKAANVTWEEEAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGGGWRLSAQWKKGEEXXXXXXXXXXXXKNFQTTPGIFQTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRYQTTVTKSEHTGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNEWITDFTGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHLAYRTRSXXXXXXXXXXXXXXXXXXXXXXXXXXXXXXXXXXXXXXXXXXXXXXLFLISGRGIGKATIGLICVTVSSGMLWMADIPLQWIASXXXXXXXXXXXXXXXXXXXXXXXXXXXXXXXXXILTLAATIAANEMGLXXXXXXXXXXSREPGVVSPNSYLDVXXXXXXXXXXXXXXXXXXXXXXXXXXXXXXXXXXXXXXXXXXXXXXXXXXXXXXXXXXXXXXXXXXXXXXXXXXXXLIAAVLLLVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKKLNQLSWKEFDLYKXXXXXXXXXTEAKEGLKRRETTHHAVSXXXXXXXXXXXXXXXXXXXXXXXXXXXXXXXXXXXXXXXXXXXXXXXXXXXXXXXXXXXXXXXGWNIIKLMSGKDXXXXXXXXXXXXXXXXXXXXXXXXXXXXXXXXXXXXXXXXXXXXXXXXKVLNPYMPNVIEHLERLXXXXXXXXXXXXXXXXXXXXXXXXXXXXXXXXXXXXXXXXXXXXXXXXTHRRPTIERDXXXXXXXXXXXXXXXXXXXXXXGERIERIKDEHSSTWHYDEEXXXXXXXXXXXXXXXXXXXXXXXXXXXXXXXXXXXXXXXXXXXXXXXXXXXXXXXXXXXXXXDTRTPRPMAGTRKAMEITAEWLXXXXXXXXXXXXXXXXXXXXXXXXXXXXXXXXXXXXXXXXXXXAVEDEDFWILVDREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKITQQMDPEHKRLANAIFKLXXXXXXXXXXXXXXXXXXXXXXXXXXXXXXXXXXXXXXXXXXXXXXXXXXXXXEGEGVLSKVXXXXXXXXEKKIAQWLENKGVERLKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRMTTEDMLTXXXXXXXXXXXXXXXKTPITTWEDVPYXXXXXXXXXXXXXXXXXXXXXXXXXXXXXXXXXXXXXXXXXXXXXXXXXXXXXXXXXXXXXX

SEQ ID NO: 265746 - protein, 3391 aa, Dengue virus
  MOD_RES (1)..(95): Any amino acid
  MOD_RES (105)..(106): Any amino acid
  MOD_RES (117)..(163): Any amino acid
  MOD_RES (173)..(261): Any amino acid
  MOD_RES (272)..(442): Any amino acid
  MOD_RES (458)..(495): Any amino acid
  MOD_RES (513)..(574): Any amino acid
  MOD_RES (587)..(604): Any amino acid
  MOD_RES (614)..(634): Any amino acid
  MOD_RES (644)..(653): Any amino acid
  MOD_RES (663)..(858): Any amino acid
  MOD_RES (869)..(887): Any amino acid
  MOD_RES (901)..(910): Any amino acid
  MOD_RES (927)..(940): Any amino acid
  MOD_RES (951)..(1054): Any amino acid
  MOD_RES (1075)..(1110): Any amino acid
  MOD_RES (1120)..(1121): Any amino acid
  MOD_RES (1139)..(1269): Any amino acid
  MOD_RES (1280)..(1299): Any amino acid
  MOD_RES (1309)..(1320): Any amino acid
  MOD_RES (1335)..(1335): Any amino acid
  MOD_RES (1348)..(1392): Any amino acid
  MOD_RES (1409)..(1554): Any amino acid
  MOD_RES (1566)..(2106): Any amino acid
  MOD_RES (2116)..(2180): Any amino acid
  MOD_RES (2195)..(2238): Any amino acid
  MOD_RES (2248)..(2259): Any amino acid
  MOD_RES (2272)..(2348): Any amino acid
  MOD_RES (2359)..(2504): Any amino acid
  MOD_RES (2515)..(2536): Any amino acid
  MOD_RES (2546)..(2767): Any amino acid
  MOD_RES (2781)..(2857): Any amino acid
  MOD_RES (2867)..(2917): Any amino acid
  MOD_RES (2928)..(3042): Any amino acid
  MOD_RES (3060)..(3113): Any amino acid
  MOD_RES (3123)..(3130): Any amino acid
  MOD_RES (3144)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRRKRTSLCXXMMFPATLAFHXXXXXXXXXXXXXXXXXXXXXXXXXXXXXXXXXXXXXXXXXXXXXXXTYKCPFIAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTQKVVIFTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSQASITEVILPEYGXXXXXXXXXXXXXXXXXXXXXXXXXXXXXXXXXXXXXXLPWTSGTTTKTPTWNRKXXXXXXXXXXXXXXXXXXXXXXXXXXXXXXXXXXXXXXXXXXXXXXXXXXXXXXXXXXXXXXMSYAMCLGSFVLXXXXXXXXXXXXXXXXXXKGKDAPCKIXXXXXXXXXXXXXXXXXXXXXVVIKKEEPVXXXXXXXXXXSNIVIGVGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTVVVGDVIGXXXXXXXXXXXXXXXXXXXWKTWGKAKMVTAEXXXXXXXXXXPSTPECPSAARAWNVWXXXXXXXXXXXXXXWLKLREAYTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTTVVISENCGMRGPSLRTTXXXXXXXXXXXXXXXXXXXXXXXXXXXXXXXXXXXXTSEKEENMVXXLVSAGSGKVDNFTMGALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLWAALVSLMCXXXXXXXXXXXXXXXXXXXXISLLPLCQSXXXXXXXXXXXXVAAMGVQPLPLFIFXLKDAPKRRSWPLXXXXXXXXXXXXXXXXXXXXXXXXXXXXXXXXXXXXXXXXXXXXXDLTVEKAPDVTWEEEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWRLSAQWKKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHLAHRTKNXXXXXXXXXXXXXXXXXXXXXXXXXXXXXXXXXXXXXXXXXXXXXXXXXXXXXXXXXXXXXXXXXIASSGMLWIAEIPLXXXXXXXXXXXXXXXXXXXXXXXXXXXXXXXXXXXXXXXXXXXXIIAANEMGMXXXXXXXXXXXXEPGVVPPTSYLDXXXXXXXXXXXXXXXXXXXXXXXXXXXXXXXXXXXXXXXXXXXXXXXXXXXXXXXXXXXXXXXXXXXXXXXXXXXXXLAAAVLLLVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKLNQLSWKEXXXXXXXXXXXXXXXXXXXXXXRGEITRHAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXERIKRIKEEHRSTXXXXXXXXXXXXXXXXXXXXXXXXXXXXXXXXXXXXXXXXXXXXXXXXXXXXXXXXXXXXXXXXXXXXXXXXXXXXXGTRKVMGITXXXXXXXXXXXXXXXXXXXXXXXXXXXXXXXXXXXXXXXXXXXXXXXXXXXENFWKLVDREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTHQMDPEHRRLANAIFKXXXXXXXXXXXXXXXXXXXXXXXXXXXXXXXXXXXXXXXXXXXXXXXXXXXXXXEGEGVLSEAXXXXXXXXEKRIIQWLETKGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265747 - protein, 3391 aa, Dengue virus
  MOD_RES (1162)..(1162): Any amino acid
  MOD_RES (2861)..(2861): Any amino acid
  MOD_RES (3101)..(3101): Any amino acid
  MOD_RES (3123)..(3134): Any amino acid
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVXFTFVLLLSGQITWRDMAHTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRXVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTXFTNMEAQLIRQMEGEGVLSKAXXXXXXXXXXXXTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 265748 - protein, 3391 aa, Dengue virus
  MOD_RES (46)..(55): Any amino acid
  MOD_RES (153)..(153): Any amino acid
  MOD_RES (181)..(190): Any amino acid
  MOD_RES (210)..(211): Any amino acid
  MOD_RES (290)..(307): Any amino acid
  MOD_RES (327)..(338): Any amino acid
  MOD_RES (371)..(394): Any amino acid
  MOD_RES (462)..(489): Any amino acid
  MOD_RES (521)..(540): Any amino acid
  MOD_RES (565)..(571): Any amino acid
  MOD_RES (593)..(593): Any amino acid
  MOD_RES (676)..(717): Any amino acid
  MOD_RES (749)..(749): Any amino acid
  MOD_RES (800)..(834): Any amino acid
  MOD_RES (929)..(937): Any amino acid
  MOD_RES (971)..(980): Any amino acid
  MOD_RES (1000)..(1019): Any amino acid
  MOD_RES (1048)..(1051): Any amino acid
  MOD_RES (1077)..(1101): Any amino acid
  MOD_RES (1162)..(1162): Any amino acid
  MOD_RES (1221)..(1227): Any amino acid
  MOD_RES (1353)..(1354): Any amino acid
  MOD_RES (1374)..(1385): Any amino acid
  MOD_RES (1438)..(1442): Any amino acid
  MOD_RES (1482)..(1491): Any amino acid
  MOD_RES (1523)..(1523): Any amino acid
  MOD_RES (1573)..(1575): Any amino acid
  MOD_RES (1603)..(1609): Any amino acid
  MOD_RES (1638)..(1639): Any amino acid
  MOD_RES (1668)..(1672): Any amino acid
  MOD_RES (1692)..(1711): Any amino acid
  MOD_RES (1738)..(1745): Any amino acid
  MOD_RES (1766)..(1773): Any amino acid
  MOD_RES (1839)..(1862): Any amino acid
  MOD_RES (1882)..(1883): Any amino acid
  MOD_RES (1902)..(1915): Any amino acid
  MOD_RES (1959)..(2012): Any amino acid
  MOD_RES (2051)..(2052): Any amino acid
  MOD_RES (2072)..(2076): Any amino acid
  MOD_RES (2121)..(2121): Any amino acid
  MOD_RES (2141)..(2150): Any amino acid
  MOD_RES (2212)..(2229): Any amino acid
  MOD_RES (2277)..(2340): Any amino acid
  MOD_RES (2367)..(2410): Any amino acid
  MOD_RES (2445)..(2465): Any amino acid
  MOD_RES (2572)..(2603): Any amino acid
  MOD_RES (2627)..(2639): Any amino acid
  MOD_RES (2700)..(2709): Any amino acid
  MOD_RES (2789)..(2816): Any amino acid
  MOD_RES (2838)..(2844): Any amino acid
  MOD_RES (2861)..(2861): Any amino acid
  MOD_RES (2899)..(2902): Any amino acid
  MOD_RES (2943)..(2962): Any amino acid
  MOD_RES (2982)..(3033): Any amino acid
  MOD_RES (3065)..(3065): Any amino acid
  MOD_RES (3085)..(3101): Any amino acid
  MOD_RES (3123)..(3134): Any amino acid
  MOD_RES (3157)..(3160): Any amino acid
  MOD_RES (3180)..(3182): Any amino acid
  MOD_RES (3202)..(3230): Any amino acid
  MOD_RES (3264)..(3266): Any amino acid
  MOD_RES (3289)..(3292): Any amino acid
  MOD_RES (3336)..(3345): Any amino acid
MNNQRKKAGKPSINMLKRVRNRVSTGSQLAKRFSRELLNGQGPMKXXXXXXXXXXFLAIPPTAGILARWGTFKKSGAIKVLRGFKREISNMLSIINRRKKTSFCLMMMLPATLAFHLTSRDGEPRMIVAKNERGKSLLFKTATGINMCTLIAXDLGEMCDDTVTYKCPLIAEVEPEDIDCXXXXXXXXXXYGTCNQAGERRRDKRSVALXXHVGMGLDTRAQTWMSAEGAWRQVEKVETWAFRHPGFTILALFLAHYIGTSLTQKVVIFVLLMLVTPSMAMRCVGVGNRXXXXXXXXXXXXXXXXXXGGCVTTMAKSKPTLDIELQXXXXXXXXXXXXLCIEGKITNVTTDSRCPTQGEAILPEEQDQNYXXXXXXXXXXXXXXXXXXXXXXXXTCAKFQCLESIEGKVVQHENLKYTVTITVHTGDQHQVGNDTQGVTVEITPQASTVEAVLPEYGTLGLXXXXXXXXXXXXXXXXXXXXXXXXXXXXWFFDLPLPWASGATTETPTWNKKELLVTFKNXXXXXXXXXXXXXXXXXXXXALTGATEIQTSGGTNIFAGHLKCRXXXXXXXLKGMSYAMCLNAFVLKKEVSEXQHGTILIKVEYKGEDVPCKVPFSTEDGQGKAHNGRLITANPIVTKKDEPINIEAEPPFGESNIIIGIGDKSLKINWYRKGSSXXXXXXXXXXXXXXXXXXXXXXXXXXXXXXXXXXXXXXXXXXFGSAYTALFSGVSWIMKIGIGILLTWIGLNSXNTSMSFSCIVIGVITLYLGAVVQADTGCAVNWKGKELKCGNGIFVTNEVHXXXXXXXXXXXXXXXXXXXXXXXXXXXXXXXXXXXRMENLLWKQVANELNYILWENNIKLTVVVGDTIGILEQGKRALTLQPMELKYSWKTWGKARIVTAEIQNSSFIIDGPNTPECPNVSRAWNVWEVXXXXXXXXXTNIWLKLREMYTQSCDHRLMSAAIKDERAVHADXXXXXXXXXXGSWKLEKASFIEVKTCTWPXXXXXXXXXXXXXXXXXXXXLAGPISQHNHRPGYYTQTAGPWHLGKLDXXXXYCEGTTVVITESCGIKGPSLRTTTVXXXXXXXXXXXXXXXXXXXXXXXXXCWYGMEIRPINEKEENMVKSLVSAGSGEMDNFTMGILCLAILFEEVLRGKFGKKHMIVGVXFMFALLLSGQITWRDMARTFIMIGSNATDKMGMGVTHLALIATFKIQPLLALGFFLRKXXXXXXXLLGVGLAMAATLRLPEDIEQMANGIALGLMTLKLTTQFETYQLWTALVSLTCSNTMFTLTVAWRTATLILAGVSLLPLCQSSSMRKTDWLPMAVAAMGVPSLPLFIFNLKDTPKRKSWPLNEGVMXXGLVSILASSFLRNDVPMAGXXXXXXXXXXXXVITGTSADLIVEKAADITWEEEAEQTGVSHNLMVTVDDDGTMKIKDDETENIXXXXXKTALLIVSGVFPYSIPATLLVWHTWQKQTRRSGVLWDVPXXXXXXXXXXEEGVYRIKQQGILGKTQVGVGIQKEGVFHTMXHVTRGAVLTHNGKRLEPNWANVKKDLISYGGGWRLNTQWKKGEEVQVIAXXXGKNPKNFQTMPGIFQTTMGEIGAIALDXXXXXXXSPIINREGKIVGLYGNGVVTKSGGYVSGXXQTNAEPDGPTPELEEEMFRKRNLTIMDLXXXXXKTRKYLPAIIREAIKRRLRXXXXXXXXXXXXXXXXXXXXLPIRYQTTATKSEHTGKEIVDLMCHAXXXXXXXXPVRVPNYNLVVMDEAHFTDPXXXXXXXXISTRVGMGETAAIFMTATPPGTAEAFPQSNAPIQDEEKDIPERSWNSGNEWITDFVGKTVWFVPSXXXXXXXXXXXXXXXXXXXXXXXXTFDTEYQKTRLNDWDFVVTXXISEMGANFRADRVIDPRRXXXXXXXXXXXXXXILAGPMPVTVASAAQRRGRVGRNPQKENDQYIFMGQPLNNDEDXXXXXXXXXXXXXXXXXXXXXXXXXXXXXXXXXXXXXXXXXXXXXXXXXXXXXXRGDLPVWLAYKVASEGIKYTDRKWCFDGERNNQILEENXXVEIWTKEGERKKLRPRWLDXXXXXDPLALKEFKEFAAGRKSIAFDLVTEIGRVPTHLAYRTRNALDNLXMLHTSEHGGKAYRHAVEELXXXXXXXXXXGLMILLTGGVMLFLISGKGVGKTSIGLICVIVSSGMLWMADVPLQWIASAIILEFFMMVLLXXXXXXXXXXXXXXXXXXVIGILTLAAIVTANEMGMLETTKRDLGMSKEPGVASSNSYLDVDLHPXXXXXXXXXXXXXXXXXXXXXXXXXXXXXXXXXXXXXXXXXXXXXXXXXXXXXXXXXXXXXXXXYSQVNPLTLTAAVLLLVTHYAIIGPGXXXXXXXXXXXXXXXXXXXXXXXXXXXXXXXXXXXXXXXXXXXXGQVMLLVLCAAQLLLMRTSWAFCEVLTLATGPITXXXXXXXXXXXXXXXXXXXXXIFRGNYLAGAGLAFSIMKSVGTGRRGTGSQGETLGEKWKKKLNQLSRKDFDLYKKSGITEVDRIEAKEGLKRGETTHHAVSRGTAKLQWFVERNMVVPEGRVIDLGXXXXXXXXXXXXXXXXXXXXXXXXXXXXXXXXVPMSTYGWNLIKLMTGKDVFYLPXXXXXXXXXXXXXSSPSPTVEESRTIRVLKMVEPWLRNNQFCIKVLNPYMPAVVEHLERLQRKYGGMLVRNPLXXXXXXXXXXISNGTGNIVSSVNMVSRLLLNRFTMTYRKPTIERDVDLGAGTRHVNAEPEIPNMDVIGERIRRIKEEHSKTWHYDDENPXXXXXXXXXXXXXXXXXXXXXXXXXXXXLTKPWDVVPTVIQMAMTDTTPXXXXXXXKEKVDTRTPRPMPGTRXVMGITAGWLWRTLGRNKRPRLCTREEFIKKVRTNAAMXXXXTEENQWDSARAAVEDEEFWKLVDKERELHKQGKCGSCVYNXXXXXXXXXXXXXXXXXXXXIWYMWLGARFLEFEALGFLXXXXXXXXXXXXXXXXXXXXXXXXXXXXXXXXXXXXXXXXXXXXXXXXXXXXDDLHNEEKIIQQMDPEHRQLASAIFKLTYQNXVVKVQRPTPKGTVMDIISRXXXXXXXXXXXXXXXXXFTNMEAQLVRQMEGEGVLTKAXXXXXXXXXXXXTQWLETKGVERLRRMAISGDDCXXXXIDDRFANALFALNDMGKVRXXXPQWQPSKGWQDWQQVPFCSXXXXXXXXXXXXXXXXXXXXXXXXXXXXXISQGAGWSLKETACLGKAYAQMWALMYFHRRDLXXXSNAICSAVPVHWIPTSRTTWSIXXXXQWMTTEDMLTVWNRVWIEENPWMEDKTPVTTWEDVPYLGKREDXXXXXXXXXXSRATWAQNILIAIQQVRSLIGDEEFLDYMPSMKRFRKEEELEGAIW

SEQ ID NO: 265749 - protein, 3391 aa, Dengue virus
  MOD_RES (1)..(26): Any amino acid
  MOD_RES (45)..(72): Any amino acid
  MOD_RES (118)..(159): Any amino acid
  MOD_RES (180)..(232): Any amino acid
  MOD_RES (243)..(252): Any amino acid
  MOD_RES (280)..(351): Any amino acid
  MOD_RES (371)..(394): Any amino acid
  MOD_RES (422)..(430): Any amino acid
  MOD_RES (461)..(492): Any amino acid
  MOD_RES (515)..(545): Any amino acid
  MOD_RES (561)..(571): Any amino acid
  MOD_RES (593)..(595): Any amino acid
  MOD_RES (650)..(650): Any amino acid
  MOD_RES (674)..(722): Any amino acid
  MOD_RES (742)..(750): Any amino acid
  MOD_RES (788)..(847): Any amino acid
  MOD_RES (929)..(937): Any amino acid
  MOD_RES (961)..(1051): Any amino acid
  MOD_RES (1077)..(1102): Any amino acid
  MOD_RES (1147)..(1151): Any amino acid
  MOD_RES (1162)..(1162): Any amino acid
  MOD_RES (1209)..(1233): Any amino acid
  MOD_RES (1248)..(1252): Any amino acid
  MOD_RES (1290)..(1290): Any amino acid
  MOD_RES (1350)..(1389): Any amino acid
  MOD_RES (1411)..(1418): Any amino acid
  MOD_RES (1429)..(1462): Any amino acid
  MOD_RES (1476)..(1531): Any amino acid
  MOD_RES (1542)..(1549): Any amino acid
  MOD_RES (1571)..(1578): Any amino acid
  MOD_RES (1602)..(1711): Any amino acid
  MOD_RES (1731)..(1746): Any amino acid
  MOD_RES (1765)..(1819): Any amino acid
  MOD_RES (1839)..(1934): Any amino acid
  MOD_RES (1950)..(2101): Any amino acid
  MOD_RES (2120)..(2155): Any amino acid
  MOD_RES (2201)..(2230): Any amino acid
  MOD_RES (2250)..(2252): Any amino acid
  MOD_RES (2276)..(2342): Any amino acid
  MOD_RES (2362)..(2411): Any amino acid
  MOD_RES (2442)..(2479): Any amino acid
  MOD_RES (2550)..(2604): Any amino acid
  MOD_RES (2624)..(2654): Any amino acid
  MOD_RES (2688)..(2728): Any amino acid
  MOD_RES (2748)..(2762): Any amino acid
  MOD_RES (2788)..(2818): Any amino acid
  MOD_RES (2836)..(2845): Any amino acid
  MOD_RES (2861)..(2861): Any amino acid
  MOD_RES (2874)..(2887): Any amino acid
  MOD_RES (2899)..(2909): Any amino acid
  MOD_RES (2936)..(3033): Any amino acid
  MOD_RES (3062)..(3101): Any amino acid
  MOD_RES (3123)..(3134): Any amino acid
  MOD_RES (3151)..(3244): Any amino acid
  MOD_RES (3264)..(3269): Any amino acid
  MOD_RES (3286)..(3292): Any amino acid
  MOD_RES (3312)..(3312): Any amino acid
  MOD_RES (3331)..(3346): Any amino acid
  MOD_RES (3365)..(3376): Any amino acid
XXXXXXXXXXXXXXXXXXXXXXXXXXSQLAKRFSKELLNGQGPMXXXXXXXXXXXXXXXXXXXXXXXXXXXXKKSGAIKVLKSFKKEISNMLSIINRRKKTSLCLVMILPATLAFHLXXXXXXXXXXXXXXXXXXXXXXXXXXXXXXXXXXXXXXXXXXDDTVTYKCPFVAEVEPEDIDXXXXXXXXXXXXXXXXXXXXXXXXXXXXXXXXXXXXXXXXXXXXXXXXXXXXXQVERVETWALXXXXXXXXXXFLAHYIGTSLTQKAVIFTLLMLVTPSMXXXXXXXXXXXXXXXXXXXXXXXXXXXXXXXXXXXXXXXXXXXXXXXXXXXXXXXXXXXXXXXXXXXXXXXXSRCPTQGEATLPEEQDQNYXXXXXXXXXXXXXXXXXXXXXXXXTCAKFQCLELIEGKAVQHENLKYTVTIXXXXXXXXXVGNDTQGVTAEITPQASTVEVILPEYGTLGXXXXXXXXXXXXXXXXXXXXXXXXXXXXXXXXDLPLPWTSGATAETPIWNRKELXXXXXXXXXXXXXXXXXXXXXXXXXXXXXXXTEIQNSGGTSIFSGHXXXXXXXXXXXLKGMSYAMCSNSFVLKKEVSEXXXGTILIKVEYRGEDVPCKIPFSTEDEQGKVHSGRLITANPVVTKKEEPINIEAEPXFGESNIVIGTGDNALKINWYRKGXXXXXXXXXXXXXXXXXXXXXXXXXXXXXXXXXXXXXXXXXXXXXXXXXTALFGGVSWVMKIGIGILLXXXXXXXXXTSMSFSCIAIGIITLYLGAVVQADMGCVVNWKGKELKXXXXXXXXXXXXXXXXXXXXXXXXXXXXXXXXXXXXXXXXXXXXXXXXXXXXXXXXXXXXLNYILWENNIKLTVVVGDITGVLEQGKRILPPQPMELKYSWKTWGKAKIVIAETQNFSFIIDGPNTPECPSTSRAWNVWEVXXXXXXXXXTNIWLKLREVHTQTCDHRLMSAAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYCEGTTVVIAENCGTGGPSLRTTTVXXXXXXXXXXXXXXXXXXXXXXXXXXWYGMEIRPVNEKEENMVKSLVSAGSGKADNFTMGALCLAILFEEXXXXXFGKKHMIAGAXLIFVLLLSGQITWRDLTHTLIMIGSNASDKMGMGVTYLALIATFKVXXXXXXXXXXXXXXXXXXXXXXXXXAMATTLQLPADIEQXXXXXALGLMALKLTTQFETYQLWTALVSLMCANTIFTLTVAXRTATLILAVISLLPVCQSSSMRKSDWLPVAVAAMGAQPLPLFIFSLKDTPKRKSWPLNEXXXXXXXXXXXXXXXXXXXXXXXXXXXXXXXXXXXXXXXXTSADLTVEKVAEVTWEEEAEQXXXXXXXXITVDDDGTMKXXXXXXXXXXXXXXXXXXXXXXXXXXXXXXXXXXVWHTWQKRTQRSGXXXXXXXXXXXXXXXXXXXXXXXXXXXXXXXXXXXXXXXXXXXXXXXXXXXXXXXXAYNGKRLEPNXXXXXXXXISYGGGWKLSAQWQRGEEVQVXXXXXXXXPKNFQTTPGIFQTTTGEIGAVALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPIRYQTTAIKSEHTGREIXXXXXXXXXXXXXXXXVRVPNYNLIVMDEAHFTDXXXXXXXXXXXXXXXXXXXXXXXXXXXXXXXXXXXXXXXXXXXXXXXXXXXXXXXSGNDWITDFTGKTVWFVPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGRNSPKENDQYIFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGRVPSHLAYRTRSALDNXXXXXXXXXXXXXXXXXXXXXXXXXXXXXXXXXXXXLTGGAMLFLISGKGIGKTSIGLICVVASSGMLWMAEVPLQWIASAXXXXXXXXXXXXXXXXXXXXXXXXXXXXXXIGILTLAAIVTANEMGLLEXXXKDLGMSKEPGVVSPNSYLDVDLHXXXXXXXXXXXXXXXXXXXXXXXXXXXXXXXXXXXXXXXXXXXXXXXXXXXXXXXXXXXXXXXXXXXQVNPLTLTAVVLLLVTHYAXXXXXXXXXXXXXXXXXXXXXXXXXXXXXXXXXXXXXXXXXXXXXXXXXXQVMLLILCAVQLLLMRTSWALCEVLTLATGXXXXXXXXXXXXXXXXXXXXXXXXXXXXXXXXXXXXXXSVMKSVGTGKRGTGTQGETLGEKWKRRLNQLSWKEFDLYKKSGITEVDRSEAKEGLKKGETTHHAVSRGTXXXXXXXXXXXXXXXXXXXXXXXXXXXXXXXXXXXXXXXXXXXXXXXXXXXXXXXPMSTYGWNIVKLMTGKDVFXXXXXXXXXXXXXXXXXXXXXXXXXXXXXXXLKMVEPWLKNNQFCIKVLNPYMPTVVEHLERLQXXXXXXXXXXXXXXXXXXXXXXXXXXXXXXXXXXXXXXXXXLNRFTMTYRRPTIERDVDLXXXXXXXXXXXXXXXMDIIGERIKRIKGEHSKTWHYDDENXXXXXXXXXXXXXXXXXXXXXXXXXXXXXXXKPWDVVPMVIQMAMTDTXXXXXXXXXXEKVDTRTPKPMPGTRXAMEITAGWLWRTXXXXXXXXXXXXXXFTRKVRTNAAMXXXXXXXXXXXSAKAAVEDEEFWILVDRERELHKQGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDLHNEEKIMQQMDPEHRLLANAIFKLTXXXXXXXXXXXXXXXXXXXXXXXXXXXXXXXXXXXXXXXXFTNMEVQLIRQMEGEGVLSKTXXXXXXXXXXXXAQWLETEGVERLKRMAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGKAYAQMWTLMYFHRRDLXXXXXXICSAVPAHWVPTSRTTXXXXXXXQWMTTEDMLAVWNRVWIEDXPWMEDKTPITTWENVPYLXXXXXXXXXXXXXXXXRATWAQNILIAIQQVRSLXXXXXXXXXXXXMKRFRKEEETEGAIW

SEQ ID NO: 265750 - protein, 3391 aa, Dengue virus
  MOD_RES (1)..(76): Any amino acid
  MOD_RES (118)..(159): Any amino acid
  MOD_RES (171)..(253): Any amino acid
  MOD_RES (276)..(351): Any amino acid
  MOD_RES (371)..(395): Any amino acid
  MOD_RES (409)..(440): Any amino acid
  MOD_RES (459)..(493): Any amino acid
  MOD_RES (514)..(546): Any amino acid
  MOD_RES (560)..(573): Any amino acid
  MOD_RES (592)..(597): Any amino acid
  MOD_RES (630)..(630): Any amino acid
  MOD_RES (647)..(650): Any amino acid
  MOD_RES (673)..(722): Any amino acid
  MOD_RES (742)..(753): Any amino acid
  MOD_RES (785)..(851): Any amino acid
  MOD_RES (886)..(886): Any amino acid
  MOD_RES (928)..(938): Any amino acid
  MOD_RES (959)..(1053): Any amino acid
  MOD_RES (1076)..(1102): Any amino acid
  MOD_RES (1140)..(1151): Any amino acid
  MOD_RES (1162)..(1162): Any amino acid
  MOD_RES (1198)..(1235): Any amino acid
  MOD_RES (1246)..(1265): Any amino acid
  MOD_RES (1288)..(1293): Any amino acid
  MOD_RES (1310)..(1310): Any amino acid
  MOD_RES (1349)..(1391): Any amino acid
  MOD_RES (1411)..(1550): Any amino acid
  MOD_RES (1569)..(1578): Any amino acid
  MOD_RES (1593)..(1712): Any amino acid
  MOD_RES (1730)..(1819): Any amino acid
  MOD_RES (1833)..(2105): Any amino acid
  MOD_RES (2117)..(2160): Any amino acid
  MOD_RES (2201)..(2231): Any amino acid
  MOD_RES (2249)..(2256): Any amino acid
  MOD_RES (2274)..(2347): Any amino acid
  MOD_RES (2360)..(2502): Any amino acid
  MOD_RES (2521)..(2527): Any amino acid
  MOD_RES (2550)..(2608): Any amino acid
  MOD_RES (2623)..(2668): Any amino acid
  MOD_RES (2688)..(2733): Any amino acid
  MOD_RES (2746)..(2763): Any amino acid
  MOD_RES (2788)..(2847): Any amino acid
  MOD_RES (2861)..(2861): Any amino acid
  MOD_RES (2872)..(2909): Any amino acid
  MOD_RES (2934)..(3037): Any amino acid
  MOD_RES (3062)..(3112): Any amino acid
  MOD_RES (3123)..(3134): Any amino acid
  MOD_RES (3150)..(3292): Any amino acid
  MOD_RES (3312)..(3316): Any amino acid
  MOD_RES (3331)..(3391): Any amino acid
XXXXXXXXXXXXXXXXXXXXXXXXXXXXXXXXXXXXXXXXXXXXXXXXXXXXXXXXXXXXXXXXXXXXXXXXXXXXAIKVLKSFKKEISSMLSIINRRKRTSLCLMMMFPATLAFHLXXXXXXXXXXXXXXXXXXXXXXXXXXXXXXXXXXXXXXXXXXDDTITYKCPLIXXXXXXXXXXXXXXXXXXXXXXXXXXXXXXXXXXXXXXXXXXXXXXXXXXXXXXXXXXXXXXXXXXXXXXXXXXXXXXXXXXXLAHYVGTSLIQKVVIFTLLMLVXXXXXXXXXXXXXXXXXXXXXXXXXXXXXXXXXXXXXXXXXXXXXXXXXXXXXXXXXXXXXXXXXXXXXXXXXXXXSRCPTQGEAALPEEQDQNYXXXXXXXXXXXXXXXXXXXXXXXXXCAKFQCLEPVEGKXXXXXXXXXXXXXXXXXXXXXXXXXXXXXXXXEITPQASIAEAILPEYGTXXXXXXXXXXXXXXXXXXXXXXXXXXXXXXXXXXXLPLPWTSGTTTETPIWNRKEXXXXXXXXXXXXXXXXXXXXXXXXXXXXXXXXXEIQNSGGTSIFSGXXXXXXXXXXXXXXGMSYAMCLGSFVLKKEVSXXXXXXILIKVEYKGKDAPCKIPFSTEDGQGKVHNGRLXTANPVVIKKEEPVNIEXXXXFGESNIIIGTGDKALKINWYRKXXXXXXXXXXXXXXXXXXXXXXXXXXXXXXXXXXXXXXXXXXXXXXXXXXTALFGGVSWMMKIGIGVLLXXXXXXXXXXXXSFSCITIGIITLYLGTVVQADMGCVVNWKGKXXXXXXXXXXXXXXXXXXXXXXXXXXXXXXXXXXXXXXXXXXXXXXXXXXXXXXXXXXXXXXXXXXXLWENSIKLTIVVGDVIGVLEQGKRTLTLQPMELKXSWKAWGKAKVVTAENQNSSFIIDGPNTPECPNTSRAWNVWEXXXXXXXXXXXNIWLKLREMYSQLCDHRLMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGTTVVITEDCGTSGPSLTTTTXXXXXXXXXXXXXXXXXXXXXXXXXXXWYGMEIRPVSEKEENMVKSLASAGSGKMDNFTMGVLCXXXXXXXXXXXXFGKKHMIAGIXFIFVLLLSGQITWRGMAHTLIMIGSNTSDRMGMGVXXXXXXXXXXXXXXXXXXXXXXXXXXXXXXXXXXXXXXTTTLQLPEDIXXXXXXXXXXXXXXXXXXXXETYQLWTALASLMCANTIFTLTXXXXXXTLILAGISLLPLCQSSXMRKTDWLPMTVAAMGVSPLPLFIFGLKDALKRRSWPLNXXXXXXXXXXXXXXXXXXXXXXXXXXXXXXXXXXXXXXXXXXXADLTVEKAPNVTWEEEAEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSYGGGWRLSAQWKKGEEVXXXXXXXXXXPKNFQTTPGIFQTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPIRYQTTVTKSEHTGREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGNEWITDFTGKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPSHLAYRTRSAXXXXXXXXXXXXXXXXXXXXXXXXXXXXXXXXXXXXXXXXXXXXMLFLVSGRGIGKTTIGLICVTVSSGMLWMADIPLQWIASAXXXXXXXXXXXXXXXXXXXXXXXXXXXXXXXGILTLAATIAANEMGLLXXXXXXXXMSREPGVVSPNSYLDVDXXXXXXXXXXXXXXXXXXXXXXXXXXXXXXXXXXXXXXXXXXXXXXXXXXXXXXXXXXXXXXXXXXXXXXXXXXTLIAAVLLLVTHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWKKKLNQLSWKEFDLYKKXXXXXXXRTEAKEGLKRGEITRHAVSRGSXXXXXXXXXXXXXXXXXXXXXXXXXXXXXXXXXXXXXXXXXXXXXXXXXXXXXXXXXXXYGWNIVKLMTGKDVXXXXXXXXXXXXXXXXXXXXXXXXXXXXXXXXXXXXXXXXXXXXXXIKILNPYMPNVIEHLERLQXXXXXXXXXXXXXXXXXXXXXXXXXXXXXXXXXXXXXXXXXXXXXXMTHRRPTIERDVXXXXXXXXXXXXXXXXXXDVIGERIKRIKEEHSSTWHYDEENXXXXXXXXXXXXXXXXXXXXXXXXXXXXXXXXXXXXXXXXXXXXXXXXXXXXXXXXXXXXVDTRTPRPMAGTRXAMGITAEWLWXXXXXXXXXXXXXXXXXXXXXXXXXXXXXXXXXXXXXXSAKAAVEDEDFWILVDRERKLHKLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEEKITHQMDPEHKRLANAIFKLTXXXXXXXXXXXXXXXXXXXXXXXXXXXXXXXXXXXXXXXXXXXXXXXXXXXMEGEGVLSKVXXXXXXXXXXXXTQWLENKGVERLKRMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRMTTEDMLSVWNRVWIEDXXXXXDKTPITTWEDVPYLXXXXXXXXXXXXXXXXXXXXXXXXXXXXXXXXXXXXXXXXXXXXXXXXXXXXXXXXXXXXX

SEQ ID NO: 265751 - protein, 3391 aa, Dengue virus
  MOD_RES (1)..(106): Any amino acid
  MOD_RES (118)..(260): Any amino acid
  MOD_RES (273)..(441): Any amino acid
  MOD_RES (459)..(494): Any amino acid
  MOD_RES (514)..(573): Any amino acid
  MOD_RES (587)..(599): Any amino acid
  MOD_RES (615)..(633): Any amino acid
  MOD_RES (645)..(652): Any amino acid
  MOD_RES (672)..(768): Any amino acid
  MOD_RES (785)..(858): Any amino acid
  MOD_RES (886)..(886): Any amino acid
  MOD_RES (901)..(909): Any amino acid
  MOD_RES (928)..(939): Any amino acid
  MOD_RES (951)..(1053): Any amino acid
  MOD_RES (1076)..(1109): Any amino acid
  MOD_RES (1140)..(1178): Any amino acid
  MOD_RES (1190)..(1268): Any amino acid
  MOD_RES (1280)..(1299): Any amino acid
  MOD_RES (1310)..(1320): Any amino acid
  MOD_RES (1335)..(1335): Any amino acid
  MOD_RES (1349)..(1391): Any amino acid
  MOD_RES (1410)..(1553): Any amino acid
  MOD_RES (1567)..(1718): Any amino acid
  MOD_RES (1729)..(2105): Any amino acid
  MOD_RES (2117)..(2164): Any amino acid
  MOD_RES (2196)..(2237): Any amino acid
  MOD_RES (2249)..(2259): Any amino acid
  MOD_RES (2273)..(2347): Any amino acid
  MOD_RES (2360)..(2503): Any amino acid
  MOD_RES (2516)..(2528): Any amino acid
  MOD_RES (2550)..(2670): Any amino acid
  MOD_RES (2681)..(2766): Any amino acid
  MOD_RES (2782)..(2916): Any amino acid
  MOD_RES (2929)..(3041): Any amino acid
  MOD_RES (3061)..(3112): Any amino acid
  MOD_RES (3123)..(3134): Any amino acid
  MOD_RES (3145)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMVLPAALAFHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLTQKVVIFTLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITSQASTTEVILPEYGTXXXXXXXXXXXXXXXXXXXXXXXXXXXXXXXXXXXXPLPWTSGVTTKTPTWNRKEXXXXXXXXXXXXXXXXXXXXXXXXXXXXXXXXXXXXXXXXXXXXXXXXXXXXXXXXXXXXGMSYAMCLGSFVLXXXXXXXXXXXXXVKVEYKGKDAPCKIPXXXXXXXXXXXXXXXXXXXPVVIKKEEPVNXXXXXXXXESNIVIGVGDKALRINWYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVVQADIGCVINWKGKXXXXXXXXXXXXXXXXXXXXXXXXXXXXXXXXXXXXXXXXXXXXXXXXXXXXXXXXXXXXXXXXXXXXXXXXXXLTVVVGDVLGVLEQGKRTLTPQPTELKXSWKTWGKAKMVTAEXXXXXXXXXGPSTPECPSALRAWNVWEXXXXXXXXXXXXIWLKLRDVYTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGTTVVISENCGTRGSSLRTTTXXXXXXXXXXXXXXXXXXXXXXXXXXXXXXXXXXPTSEKEENMVKSLVSAGSGKVDNFTMGALCXXXXXXXXXXXXXXXXXXXXXXXXXXXXXXXXXXXXXXXAHTLIMVGSNAXXXXXXXXXXXXXXXXXXXXXXXXXXXXXXXXXXXXXXXXXXXXXXXXXXXXXXXXXXXXXXXXXXXXXXXXXXXXXXXQLWAALVSLTCXXXXXXXXXXXXXXXXXXXXVSLLPMCQSSXXXXXXXXXXXVAAMGVQPLPLFIFXLKDAPKRRSWPLNXXXXXXXXXXXXXXXXXXXXXXXXXXXXXXXXXXXXXXXXXXXADLTVEKAANVTWEEEAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGWRLSAQWKKGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVTKSEHTGRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPSHLAHRTKNAXXXXXXXXXXXXXXXXXXXXXXXXXXXXXXXXXXXXXXXXXXXXXXXXISGKGIGKASIGLICVIASSGMLWIAEIPLQXXXXXXXXXXXXXXXXXXXXXXXXXXXXXXXXXXXXXXXXXXAIIAANEMGMLXXXXXXXXXXXEPGVVSPISYLDVXXXXXXXXXXXXXXXXXXXXXXXXXXXXXXXXXXXXXXXXXXXXXXXXXXXXXXXXXXXXXXXXXXXXXXXXXXXTLAAAVLLLVTHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKKKLNQLSRREFXXXXXXXXXXXXXTEAKEGLRRGEVTHHAVSRGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLNPYMPNVIXXXXXXXXXXXXXXXXXXXXXXXXXXXXXXXXXXXXXXXXXXXXXXXXXXXXXXXXXXXXXXXXXXXXXXXXXXXXXXXXXXXXXXGERVKRVKEEHNSTWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDENFWKLVDRERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITQQMDPEHRRLANAIFKLXXXXXXXXXXXXXXXXXXXXXXXXXXXXXXXXXXXXXXXXXXXXXXXXXXXXMEGEGVLSEAXXXXXXXXXXXXIQWLETKGVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265752 - protein, 3391 aa, Dengue virus
  MOD_RES (103)..(106): Any amino acid
  MOD_RES (898)..(898): Any amino acid
  MOD_RES (1162)..(1162): Any amino acid
  MOD_RES (1180)..(1180): Any amino acid
  MOD_RES (2861)..(2861): Any amino acid
  MOD_RES (3101)..(3101): Any amino acid
  MOD_RES (3123)..(3134): Any amino acid
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSXXXXMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAVLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDAPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVXAETQNSSFIIDGPNTPECPSASRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNYRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSAGSGKVDNFTMGVLCLAILFEEVMRGKFGKKHMIAGVXFTFVLLLSGQITWRDMAXTLIMIGSNASDRMGMGVTYLALIATFKIQPFLALGFFLRKLTSRENLLLGVGLAMATTLQLPEDIEQMANGIALGLMALKLITQFETYQLWTALISLTCSNTIFTLTVAWRTATLILAGVSLLPVCQSSSMRKTDWLPMTVAAMGVPPLPLFIFSLKDTLKRRSWPLNEGVMAVGLVSILASSLLRNDVPMAGPLVAGGLLIACYVITGTSADLTVEKAADVTWEEEAEQTGVSHNLMITVDDDGTMRIKDDETENILTVLLKTALLIVSGIFPYSIPATLLVWHTWQKQTQRSGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKDFAAGRKSIALDLVTEIGRVPSHLAHRTRNALDNLVMLHTSEHGGRAYRHAVEELPETMETLLLLGLMILLTGGAMLFLISGKGIGKTSIGLICVIASSGMLWMAEIPLQWIASAIVLEFFMMVLLIPEPEKQRTPQDNQLAYVVIGILTLAAIIAANEMGLLETTKRDLGMSKEPGVVSPTSYLDVDLHPASAWTLYAVATTVITPMLRHTIENSTANVSLAAIANQAVVLMGLDKGWPISKMDLGVPLLALGCYSQVNPLTLTAAVLLLITHYAIIGPGLQAKATREAQKRTAAGIMKNPTVDGIMTIDLDPVIYDSKFEKQLGQVMLLVLCAVQLLLMRTSWALCEALTLATGPITTLWEGSPGKFWNTTIAVSMANIFRGSYLAGAGLAFSIMKSVGTGKRGTGSQGETLGEKWKKKLNQLSRKEFDLYKKSGITEVDRTEAKEGLKRGEITHHAVSRGSAKLQWFVERNMVIPEGRVIDLGCGRGGWSYYCAGLKKVTEVRGYTKGGPGHEEPVPMSTYGWNIVKLMSGKDVFYLPPEKCDTLLCDIGESSPSPTVEESRTIRVLKMVEPWLKNNQFCIKVLNPYMPTVIEHLERLQRKHGGMLVRNPLSRNSTHEMYWISNGTGNIVASVNMVSRLLLNRFTMTHRRPTIEKDVDLGAGTRHVNAEPETPNMDVIGERIKRIKEEHNSTWHYDDENPYKTWAYHGSYEVKATGSASSMINGVVKLLTKPWDVVPMVTQMAMTDTTPFGQQRVFKEKVDTRTPRSMPGTRXVMEITAEWLWRTLGRNKKPRLCTREEFTKKVRTNAAMGAVFTEENQWDSAKAAVEDEDFWKLVDRERELHKLGKCGSCVYNMMGKREKKLGEFGKAKGSRAIWYMWLGARYLEFEALGFLNEDHWFSRENSYSGVEGEGLHKLGYILRDISKIPGGAMYADDTAGWDTRITEDDLHNEEKITQQMDPEHRQLANAIFKLTYQNKVVKVQRPTPTGTVMDIISRKDQRGSGQVGTYGLNTXFTNMEAQLIRQMEGEGVLSKAXXXXXXXXXXXXTQWLETKGVERLKRMAISGDDCVVKPIDDRFANALLALNDMGKVRKDIPQWQPSKGWHDWQQVPFCSHHFHELIMKDGRKLVVPCRPQDELIGRARISQGAGWSLRETACLGKAYAQMWSLMYFHRRDLRLASNAICSAVPVHWVPTSRTTWSIHAHHQWMTTEDMLTVWNRVWIEDNPWMEDKTPVTTWENVPYLGKREDQWCGSLIGLTSRATWAQNIPTAIQQVRSLIGNEEFLDYMPSMKRFRKEEESEGAIW

SEQ ID NO: 265753 - protein, 3391 aa, Dengue virus
  MOD_RES (47)..(54): Any amino acid
  MOD_RES (103)..(106): Any amino acid
  MOD_RES (182)..(186): Any amino acid
  MOD_RES (291)..(306): Any amino acid
  MOD_RES (328)..(337): Any amino acid
  MOD_RES (372)..(393): Any amino acid
  MOD_RES (463)..(488): Any amino acid
  MOD_RES (522)..(539): Any amino acid
  MOD_RES (566)..(570): Any amino acid
  MOD_RES (677)..(716): Any amino acid
  MOD_RES (801)..(833): Any amino acid
  MOD_RES (898)..(898): Any amino acid
  MOD_RES (931)..(936): Any amino acid
  MOD_RES (972)..(979): Any amino acid
  MOD_RES (1001)..(1005): Any amino acid
  MOD_RES (1017)..(1018): Any amino acid
  MOD_RES (1049)..(1050): Any amino acid
  MOD_RES (1078)..(1100): Any amino acid
  MOD_RES (1162)..(1162): Any amino acid
  MOD_RES (1180)..(1180): Any amino acid
  MOD_RES (1222)..(1226): Any amino acid
  MOD_RES (1375)..(1384): Any amino acid
  MOD_RES (1439)..(1441): Any amino acid
  MOD_RES (1483)..(1490): Any amino acid
  MOD_RES (1574)..(1574): Any amino acid
  MOD_RES (1604)..(1608): Any amino acid
  MOD_RES (1669)..(1671): Any amino acid
  MOD_RES (1693)..(1708): Any amino acid
  MOD_RES (1739)..(1744): Any amino acid
  MOD_RES (1767)..(1772): Any amino acid
  MOD_RES (1840)..(1861): Any amino acid
  MOD_RES (1903)..(1914): Any amino acid
  MOD_RES (1960)..(2011): Any amino acid
  MOD_RES (2073)..(2075): Any amino acid
  MOD_RES (2142)..(2149): Any amino acid
  MOD_RES (2213)..(2228): Any amino acid
  MOD_RES (2278)..(2339): Any amino acid
  MOD_RES (2368)..(2409): Any amino acid
  MOD_RES (2446)..(2464): Any amino acid
  MOD_RES (2573)..(2602): Any amino acid
  MOD_RES (2628)..(2638): Any amino acid
  MOD_RES (2701)..(2708): Any amino acid
  MOD_RES (2790)..(2815): Any amino acid
  MOD_RES (2839)..(2843): Any amino acid
  MOD_RES (2861)..(2861): Any amino acid
  MOD_RES (2900)..(2901): Any amino acid
  MOD_RES (2944)..(2961): Any amino acid
  MOD_RES (2983)..(3032): Any amino acid
  MOD_RES (3086)..(3101): Any amino acid
  MOD_RES (3123)..(3134): Any amino acid
  MOD_RES (3158)..(3159): Any amino acid
  MOD_RES (3181)..(3181): Any amino acid
  MOD_RES (3203)..(3229): Any amino acid
  MOD_RES (3265)..(3265): Any amino acid
  MOD_RES (3290)..(3291): Any amino acid
  MOD_RES (3337)..(3344): Any amino acid
MNNQRKKAGKPSINMLKRVRNRVSTGSQLAKRFSRELLNGQGPMKLXXXXXXXXRFLAIPPTAGILARWGTFKKSGAIKVLRGFKREISNMLSIINRRKKTSXXXXMMLPATLAFHLTSRDGEPRMIVAKNERGKSLLFKTATGINMCTLIAMDLGEMCDDTVTYKCPLIAEVEPEDIDCWXXXXXTWVTYGTCNQAGERRRDKRSVALAPHVGMGLDTRAQTWMSAEGAWRQVEKVETWAFRHPGFTILALFLAHYIGTSLTQKVVIFVLLMLVTPSMAMRCVGVGNRDXXXXXXXXXXXXXXXXHGGCVTTMAKSKPTLDIELQKXXXXXXXXXXKLCIEGKITNVTTDSRCPTQGEAILPEEQDQNYVXXXXXXXXXXXXXXXXXXXXXXVTCAKFQCLESIEGKVVQHENLKYTVTITVHTGDQHQVGNDTQGVTVEITPQASTVEAVLPEYGTLGLEXXXXXXXXXXXXXXXXXXXXXXXXXXQWFFDLPLPWASGATTETPTWNKKELLVTFKNAXXXXXXXXXXXXXXXXXXTALTGATEIQTSGGTNIFAGHLKCRLXXXXXELKGMSYAMCLNAFVLKKEVSETQHGTILIKVEYKGEDVPCKVPFSTEDGQGKAHNGRLITANPIVTKKDEPINIEAEPPFGESNIIIGIGDKSLKINWYRKGSSIXXXXXXXXXXXXXXXXXXXXXXXXXXXXXXXXXXXXXXXXIFGSAYTALFSGVSWIMKIGIGILLTWIGLNSKNTSMSFSCIVIGVITLYLGAVVQADTGCAVNWKGKELKCGNGIFVTNEVHTXXXXXXXXXXXXXXXXXXXXXXXXXXXXXXXXXTRMENLLWKQVANELNYILWENNIKLTVVVGDTIGILEQGKRALTLQPMELKYSWKTWGKARIVXAEIQNSSFIIDGPNTPECPNVLRAWNVWEVEDXXXXXXTTNIWLKLREMYTQSCDHRLMSAAIKDERAVHADMXXXXXXXXNGSWKLEKASFIEVKTCTWPKXXXXXTNGVLESDMIIXXSLAGPISQHNHRPGYYTQTAGPWHLGKLDLXXNYCEGTTVVITESCGTRGPALRTTTVSXXXXXXXXXXXXXXXXXXXXXXXGCWYGMEIRPINEKEENMVKSLVSAGSGEMDNFTMGILCLAILFEEVLRGKFGKKHMIVGVXFMFALLLSGQITWRDMTXTFIMIGSNATDKMGMGVTHLALIATFKIQPLLALGFFLRKLXXXXXLLLGVGLAMAATLRLPEDIEQMANGIALGLMTLKLTTQFETYQLWTALVSLTCSNTMFTLTVAWRTATLILAGVSLLPLCQSSSMRKTDWLPMAVAAMGVPSLPLFIFNLKDTPKRKSWPLNEGVMAVGLVSILASSFLRNDVPMAGPXXXXXXXXXXYVITGTSADLIVEKAADITWEEEAEQTGVSHNLMVTVDDDGTMKIKDDETENILXXXLKTALLIVSGVFPYSIPATLLVWHTWQKQTRRSGVLWDVPSXXXXXXXXLEEGVYRIKQQGILGKTQVGVGIQKEGVFHTMWHVTRGAVLTHNGKRLEPNWANVKKDLISYGGGWRLNTQWKKGEEVQVIAVXPGKNPKNFQTMPGIFQTTMGEIGAIALDFXXXXXGSPIINREGKIVGLYGNGVVTKSGGYVSGIAQTNAEPDGPTPELEEEMFRKRNLTIMDLHXXXGKTRKYLPAIIREAIKRRLRTXXXXXXXXXXXXXXXXLKGLPIRYQTTATKSEHTGKEIVDLMCHATXXXXXXSPVRVPNYNLVVMDEAHFTDPAXXXXXXYISTRVGMGETAAIFMTATPPGTAEAFPQSNAPIQDEEKDIPERSWNSGNEWITDFVGKTVWFVPSIXXXXXXXXXXXXXXXXXXXXXXKTFDTEYQKTRLNDWDFVVTTDISEMGANFRADRVIDPRRCXXXXXXXXXXXXVILAGPMPVTVASAAQRRGRVGRNPQKENDQYIFMGQPLNNDEDHXXXXXXXXXXXXXXXXXXXXXXXXXXXXXXXXXXXXXXXXXXXXXXXXXXXXRRGDLPVWLAYKVASEGIKYTDRKWCFDGERNNQILEENMDVEIWTKEGERKKLRPRWLDAXXXSDPLALKEFKEFAAGRKSIAFDLVTEIGRVPTHLAYRTRNALDNLVMLHTSEHGGKAYRHAVEELPXXXXXXXXLGLMILLTGGVMLFLISGKGVGKTSIGLICVIVSSGMLWMADVPLQWIASAIILEFFMMVLLIXXXXXXXXXXXXXXXXVVIGILTLAAIVTANEMGMLETTKRDLGMSKEPGVASSNSYLDVDLHPAXXXXXXXXXXXXXXXXXXXXXXXXXXXXXXXXXXXXXXXXXXXXXXXXXXXXXXXXXXXXXXCYSQVNPLTLTAAVLLLVTHYAIIGPGLXXXXXXXXXXXXXXXXXXXXXXXXXXXXXXXXXXXXXXXXXXLGQVMLLVLCAAQLLLMRTSWAFCEVLTLATGPITTXXXXXXXXXXXXXXXXXXXNIFRGNYLAGAGLAFSIMKSVGTGRRGTGSQGETLGEKWKKKLNQLSRKDFDLYKKSGITEVDRIEAKEGLKRGETTHHAVSRGTAKLQWFVERNMVVPEGRVIDLGCXXXXXXXXXXXXXXXXXXXXXXXXXXXXXXPVPMSTYGWNLVKLMTGKDVFYLPPXXXXXXXXXXXESSPSPIVEEGRTIRVLKMVEPWLRNNQFCIKVLNPYMPAVIEHLERLQRKYGGMLVRNPLSXXXXXXXXWISNGTGNIVSSVNMVSRLLLNRFTMTYRKPTIERDVDLGAGTRHVNAEPEIPNMDVIGERIRRIKEEHSSTWHYDEENPYXXXXXXXXXXXXXXXXXXXXXXXXXXLLTKPWDVVPTVIQMAMTDTTPFXXXXXFKEKVDTRTPRPMPGTRXVMGITAGWLWRTLGRNKRPRLCTREEFIKKVRTNAAMGXXFTEENQWDSARAAVEDEEFWKLVDKERELHKQGKCGSCVYNMXXXXXXXXXXXXXXXXXXAIWYMWLGARFLEFEALGFLNXXXXXXXXXXXXXXXXXXXXXXXXXXXXXXXXXXXXXXXXXXXXXXXXXXEDDLHNEEKIIQQMDPEHRQLASAIFKLTYQNKVVKVQRPTPKGTVMDIISRKXXXXXXXXXXXXXXXXFTNMEAQLVRQMEGEGVLTKAXXXXXXXXXXXXTQWLETKGVERLRRMAISGDDCVXXPIDDRFANALFALNDMGKVRKXIPQWQPSKGWQDWQQVPFCSHXXXXXXXXXXXXXXXXXXXXXXXXXXXRISQGAGWSLKETACLGKAYAQMWALMYFHRRDLRXASNAICSAVPVHWIPTSRTTWSIHXXHQWMTTEDMLTVWNRVWIEENPWMEDKTPVTTWEDVPYLGKREDQXXXXXXXXTSRATWAQNILIAIQQVRSLIGDEEFLDYMPSMKRFRKEEELEGAIW

SEQ ID NO: 265754 - protein, 3391 aa, Dengue virus
  MOD_RES (1)..(25): Any amino acid
  MOD_RES (46)..(71): Any amino acid
  MOD_RES (103)..(106): Any amino acid
  MOD_RES (119)..(134): Any amino acid
  MOD_RES (146)..(158): Any amino acid
  MOD_RES (181)..(231): Any amino acid
  MOD_RES (244)..(248): Any amino acid
  MOD_RES (281)..(350): Any amino acid
  MOD_RES (372)..(393): Any amino acid
  MOD_RES (423)..(427): Any amino acid
  MOD_RES (462)..(491): Any amino acid
  MOD_RES (517)..(544): Any amino acid
  MOD_RES (562)..(570): Any amino acid
  MOD_RES (594)..(594): Any amino acid
  MOD_RES (675)..(721): Any amino acid
  MOD_RES (743)..(748): Any amino acid
  MOD_RES (789)..(846): Any amino acid
  MOD_RES (898)..(898): Any amino acid
  MOD_RES (930)..(936): Any amino acid
  MOD_RES (962)..(1050): Any amino acid
  MOD_RES (1078)..(1101): Any amino acid
  MOD_RES (1148)..(1150): Any amino acid
  MOD_RES (1162)..(1162): Any amino acid
  MOD_RES (1180)..(1180): Any amino acid
  MOD_RES (1214)..(1232): Any amino acid
  MOD_RES (1249)..(1251): Any amino acid
  MOD_RES (1351)..(1388): Any amino acid
  MOD_RES (1412)..(1417): Any amino acid
  MOD_RES (1430)..(1461): Any amino acid
  MOD_RES (1477)..(1496): Any amino acid
  MOD_RES (1515)..(1530): Any amino acid
  MOD_RES (1543)..(1548): Any amino acid
  MOD_RES (1572)..(1577): Any amino acid
  MOD_RES (1603)..(1710): Any amino acid
  MOD_RES (1732)..(1745): Any amino acid
  MOD_RES (1766)..(1818): Any amino acid
  MOD_RES (1840)..(1864): Any amino acid
  MOD_RES (1876)..(1933): Any amino acid
  MOD_RES (1951)..(2085): Any amino acid
  MOD_RES (2097)..(2100): Any amino acid
  MOD_RES (2121)..(2124): Any amino acid
  MOD_RES (2136)..(2154): Any amino acid
  MOD_RES (2203)..(2229): Any amino acid
  MOD_RES (2251)..(2251): Any amino acid
  MOD_RES (2277)..(2341): Any amino acid
  MOD_RES (2363)..(2410): Any amino acid
  MOD_RES (2443)..(2478): Any amino acid
  MOD_RES (2551)..(2603): Any amino acid
  MOD_RES (2625)..(2653): Any amino acid
  MOD_RES (2691)..(2713): Any amino acid
  MOD_RES (2725)..(2727): Any amino acid
  MOD_RES (2749)..(2761): Any amino acid
  MOD_RES (2789)..(2817): Any amino acid
  MOD_RES (2837)..(2844): Any amino acid
  MOD_RES (2861)..(2861): Any amino acid
  MOD_RES (2875)..(2878): Any amino acid
  MOD_RES (2900)..(2908): Any amino acid
  MOD_RES (2937)..(3032): Any amino acid
  MOD_RES (3063)..(3101): Any amino acid
  MOD_RES (3123)..(3134): Any amino acid
  MOD_RES (3152)..(3243): Any amino acid
  MOD_RES (3265)..(3268): Any amino acid
  MOD_RES (3287)..(3291): Any amino acid
  MOD_RES (3332)..(3345): Any amino acid
  MOD_RES (3366)..(3375): Any amino acid
XXXXXXXXXXXXXXXXXXXXXXXXXGSQLAKRFSKELLNGQGPMKXXXXXXXXXXXXXXXXXXXXXXXXXXFKKSGAIKVLKSFKKEISNMLSIINRRKRTSXXXXMILPATLAFHLTXXXXXXXXXXXXXXXXKSIFFKTASGIXXXXXXXXXXXXXCDDTVTYKCPFVAEVEPEDIDCXXXXXXXXXXXXXXXXXXXXXXXXXXXXXXXXXXXXXXXXXXXXXXXXXXXRQVERVETWALRXXXXXILALFLAHYIGTSLTQKAVIFVLLMLVTPSMAXXXXXXXXXXXXXXXXXXXXXXXXXXXXXXXXXXXXXXXXXXXXXXXXXXXXXXXXXXXXXXXXXXXXXXDSRCPTQGEATLPEEQDQNYVXXXXXXXXXXXXXXXXXXXXXXVTCAKFQCLELIEGKAVQHENLKYTVTITXXXXXQPQVGNETQGVTAEITPQASTVEVILPEYGTLGLXXXXXXXXXXXXXXXXXXXXXXXXXXXXXXFDLPLPWTSGATAETPIWNRKELLVXXXXXXXXXXXXXXXXXXXXXXXXXXXXATEIQNLGGTSIFAGHLXXXXXXXXXELKGMSYAMCSGTFVLRKEVSETXHGTILIKVEYRGEDVPCKIPFSTEDEQGKVHSGRLITANPVVTKKEEPINIEAEPPFGESNIVIGTGDNALKINWYRKGSXXXXXXXXXXXXXXXXXXXXXXXXXXXXXXXXXXXXXXXXXXXXXXXYTALFGGVSWVMKIGIGILLTXXXXXXKNTSMSFSCIAIGIITLYLGAVVQADMGCVVNWKGKELKCXXXXXXXXXXXXXXXXXXXXXXXXXXXXXXXXXXXXXXXXXXXXXXXXXXXXXXXXXXELNYILWENNIKLTIVVGDVTGVLEQGKRILTPQPMDLKYSWKTWGKAKVVXAETQNFSFIIDGPNTPECPSTSRAWNVWEVEXXXXXXXSTNIWLKLREVHTQTCDHRLMSAAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNYCEGTTVVIAENCGTGGPSLRTTTVSXXXXXXXXXXXXXXXXXXXXXXXXCWYGMEIRPVNEKEENMVKSLVSAGSGKADNFTMGALCLAILFEEVXXXKFGKKHMIAGAXLIFMLLLSGQITWRDLAXTLIMIGSNASDKMGMGVTYLALIATFKVQPFLAXXXXXXXXXXXXXXXXXXXLAMATTLQLPADIEQMXXXIALGLMALKLITQFETYQLWTALVSLMCANTIFTLTVAWRTATLILAVISLLPVCQSSSMRKSDWLPVAVAAMGAQPLPLFIFSLKDTPKRKSWPLNEGXXXXXXXXXXXXXXXXXXXXXXXXXXXXXXXXXXXXXXGTSADLTVEKVAEVTWEEEAEQTXXXXXXMITVDDDGTMKIXXXXXXXXXXXXXXXXXXXXXXXXXXXXXXXXLVWHTWQKRTQRSGVXXXXXXXXXXXXXXXXXXXXRINQQGIFGKTQVGVGIQXXXXXXXXXXXXXXXXLAYNGKRLEPNWXXXXXXLISYGGGWKLSAQWQRGEEVQVIXXXXXXNPKNFQTTPGIFQTITGEIGAIALDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGLPIRYQTTAIKSEHTGREIVXXXXXXXXXXXXXXPVRVPNYNLIVMDEAHFTDPXXXXXXXXXXXXXXXXXXXXXXXXXXXXXXXXXXXXXXXXXXXXXXXXXXXXXNSGNDWITDFTGKTVWFVPSIXXXXXXXXXXXXXXXXXXXXXXXXXNTEYQKTKLNDXXXXXXXXXXXXXXXXXXXXXXXXXXXXXXXXXXXXXXXXXXXXXXXXXXXXXXXXXXRVGRNPPKENDQYIFTGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFAAGRKSIAFXXXXEIGRVPSHLPHRTRNALDNLXXXXTSEDGGRAYRHXXXXXXXXXXXXXXXXXXXLLTGGAMLFLISGKGIGKTSIGLICVVASSGMLWMAEVPLQWIASAIIXXXXXXXXXXXXXXXXXXXXXXXXXXXVIGILTLAAIVTANEMGLLETXKKDLGMSKEPGVVSPNSYLDVDLHPXXXXXXXXXXXXXXXXXXXXXXXXXXXXXXXXXXXXXXXXXXXXXXXXXXXXXXXXXXXXXXXXXSQVNPLTLTAVVLLLVTHYAIXXXXXXXXXXXXXXXXXXXXXXXXXXXXXXXXXXXXXXXXXXXXXXXXGQVMLLILCAVQLLLMRTSWALCEVLTLATGPXXXXXXXXXXXXXXXXXXXXXXXXXXXXXXXXXXXXFSVMKSVGTGKRGTGTQGETLGEKWKRRLNQLSRREFDLYKKSGITEVDRSEAKEGLKKGETTHHAVSRGTAXXXXXXXXXXXXXXXXXXXXXXXXXXXXXXXXXXXXXXXXXXXXXXXXXXXXXVPMSTYGWNIIKLMSGKDVFYXXXXXXXXXXXXXXXXXXXXXXXXXXXXXVLKMVEPWLKNNQFCIKVLNPYMPTVVEHLERLQRKHXXXXXXXXXXXXXXXXXXXXXXXSGNIVASVNMVXXXLLNRFTMTYRRPTIERDVDLGXXXXXXXXXXXXXNMDVIGERIKRIKGEHSKTWHYDDENPXXXXXXXXXXXXXXXXXXXXXXXXXXXXXTKPWDVVPMVIQMAMTDTTXXXXXXXXKEKVDTRTPKPMPGTRXAMEITAGWLWRTLXXXXRPRLCTREEFTRKVRTNAAMGXXXXXXXXXDSAKAAVEDEEFWILVDRERELHKQGKCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDDLHNEEKIMQQMDPEHRLLANAIFKLTYXXXXXXXXXXXXXXXXXXXXXXXXXXXXXXXXXXXXXXXFTNMEVQLVRQMEGEGVLSKTXXXXXXXXXXXXIQWLETEGVERLKRMAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCLGKAYAQMWTLMYFHRRDLRXXXXAICSAVPAHWVPTSRTTWXXXXXHQWMTTEDMLAVWNRVWIEDNPWMEDKTPITTWENVPYLGXXXXXXXXXXXXXXSRATWAQNILIAIQQVRSLIXXXXXXXXXXSMKRFRKEEETEGAIW

SEQ ID NO: 265755 - protein, 3391 aa, Dengue virus
  MOD_RES (1)..(72): Any amino acid
  MOD_RES (101)..(106): Any amino acid
  MOD_RES (119)..(158): Any amino acid
  MOD_RES (171)..(252): Any amino acid
  MOD_RES (281)..(350): Any amino acid
  MOD_RES (372)..(394): Any amino acid
  MOD_RES (409)..(433): Any amino acid
  MOD_RES (460)..(492): Any amino acid
  MOD_RES (515)..(544): Any amino acid
  MOD_RES (561)..(572): Any amino acid
  MOD_RES (593)..(596): Any amino acid
  MOD_RES (648)..(649): Any amino acid
  MOD_RES (674)..(721): Any amino acid
  MOD_RES (743)..(751): Any amino acid
  MOD_RES (786)..(849): Any amino acid
  MOD_RES (898)..(898): Any amino acid
  MOD_RES (929)..(936): Any amino acid
  MOD_RES (962)..(1052): Any amino acid
  MOD_RES (1077)..(1101): Any amino acid
  MOD_RES (1148)..(1150): Any amino acid
  MOD_RES (1162)..(1162): Any amino acid
  MOD_RES (1180)..(1180): Any amino acid
  MOD_RES (1200)..(1234): Any amino acid
  MOD_RES (1247)..(1264): Any amino acid
  MOD_RES (1289)..(1292): Any amino acid
  MOD_RES (1350)..(1390): Any amino acid
  MOD_RES (1412)..(1549): Any amino acid
  MOD_RES (1571)..(1577): Any amino acid
  MOD_RES (1593)..(1711): Any amino acid
  MOD_RES (1731)..(1818): Any amino acid
  MOD_RES (1834)..(1938): Any amino acid
  MOD_RES (1950)..(2104): Any amino acid
  MOD_RES (2118)..(2157): Any amino acid
  MOD_RES (2202)..(2230): Any amino acid
  MOD_RES (2250)..(2255): Any amino acid
  MOD_RES (2275)..(2346): Any amino acid
  MOD_RES (2361)..(2501): Any amino acid
  MOD_RES (2522)..(2526): Any amino acid
  MOD_RES (2551)..(2607): Any amino acid
  MOD_RES (2624)..(2667): Any amino acid
  MOD_RES (2689)..(2732): Any amino acid
  MOD_RES (2747)..(2762): Any amino acid
  MOD_RES (2789)..(2846): Any amino acid
  MOD_RES (2861)..(2861): Any amino acid
  MOD_RES (2873)..(2908): Any amino acid
  MOD_RES (2936)..(3036): Any amino acid
  MOD_RES (3063)..(3106): Any amino acid
  MOD_RES (3123)..(3134): Any amino acid
  MOD_RES (3151)..(3291): Any amino acid
  MOD_RES (3313)..(3315): Any amino acid
  MOD_RES (3332)..(3354): Any amino acid
  MOD_RES (3366)..(3391): Any amino acid
XXXXXXXXXXXXXXXXXXXXXXXXXXXXXXXXXXXXXXXXXXXXXXXXXXXXXXXXXXXXXXXXXXXXXXXXKKSGAIKVLKSFKKEISNMLSIINQRKKXXXXXXMMFPATLAFHLTXXXXXXXXXXXXXXXXXXXXXXXXXXXXXXXXXXXXXXXXCDDTITYKCPLIXXXXXXXXXXXXXXXXXXXXXXXXXXXXXXXXXXXXXXXXXXXXXXXXXXXXXXXXXXXXXXXXXXXXXXXXXXXXXXXXXXFLAHYVGTSLTQKVVIFTLLMLVTPSMTXXXXXXXXXXXXXXXXXXXXXXXXXXXXXXXXXXXXXXXXXXXXXXXXXXXXXXXXXXXXXXXXXXXXXXDSRCPTQGEAALPEEQDQNYVXXXXXXXXXXXXXXXXXXXXXXXTCAKFQCLEPVEGKXXXXXXXXXXXXXXXXXXXXXXXXXDTQGVTAEITPQASIAEAILPEYGTLXXXXXXXXXXXXXXXXXXXXXXXXXXXXXXXXXDLPLPWTSGVTTETPIWNRKELXXXXXXXXXXXXXXXXXXXXXXXXXXXXXXATEIQNSGGTTIFAGHXXXXXXXXXXXXKGMSYAMCLNTFVLRKEVSEXXXXTILIKVEYKGKDAPCKIPFSTEDGQGKVHNGRLITANPVVIKKEEPVNIEAXXPFGESNIIIGTGDKALKINWYRKGXXXXXXXXXXXXXXXXXXXXXXXXXXXXXXXXXXXXXXXXXXXXXXXXYTALFGGVSWMMKIGIGVLLTXXXXXXXXXSMSFSCITIGIITLYLGTVVQADMGCVVNWKGKEXXXXXXXXXXXXXXXXXXXXXXXXXXXXXXXXXXXXXXXXXXXXXXXXXXXXXXXXXXXXXXXXHILWENNIKLTVVVGDVIGVLEQGKRTLTLQPMELKYSWKAWGKAKIVXAEKQNSSFIIDGPNTPECPNTSRAWNVWEVXXXXXXXXTTNIWLKLREMYSQLCDHRLMSAAIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCEGTTVVITEDCGTRGPALRTTTVXXXXXXXXXXXXXXXXXXXXXXXXXCWYGMEIRPVSEKEENMVKSLASAGSGKMDNFTMGVLCLVILFEEVXXXKFGKKHMIAGIXFTFVLLLSGQIKWRDMAXTLIMIGSNTSDRMGMGVTYXXXXXXXXXXXXXXXXXXXXXXXXXXXXXXXXXXXMTTTLQLPEDIEXXXXXXXXXXXXXXXXXXFETYQLWTALASLMCANTIFTLTVXXXXATLILAGISLLPLCQSSSMRKTDWLPMTVAAMGVQPLPLFIFGLKDALKRRSWPLNEXXXXXXXXXXXXXXXXXXXXXXXXXXXXXXXXXXXXXXXXXSADLTVEKAANVTWEEEAEQTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISYGGGWRLSAQWQRGEEVQVXXXXXXXNPKNFQTTPGIFQTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPIRYQTTATRSEHTGREIXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSGNEWITDFTGKTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSQKENDQYIFTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPSHLAHRTKNALXXXXXXXXXXXXXXXXXXXXXXXXXXXXXXXXXXXXXXXXGGAMLFLVSGRGIGKTTIGLICVTVSSGMLWMADIPLQWIASAIXXXXXXXXXXXXXXXXXXXXXXXXXXXXXIGILTLAATIAANEMGLLEXXXXXXGMSREPGVVSPNSYLDVDLXXXXXXXXXXXXXXXXXXXXXXXXXXXXXXXXXXXXXXXXXXXXXXXXXXXXXXXXXXXXXXXXXXXXXXXXLTLIAAVLLLVTHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKWKKKLNQLSRREFDLYKKSXXXXXDRTEAKEGLKRREVTHHAVSRGSAXXXXXXXXXXXXXXXXXXXXXXXXXXXXXXXXXXXXXXXXXXXXXXXXXXXXXXXXXTYGWNIIKLMSGKDVFXXXXXXXXXXXXXXXXXXXXXXXXXXXXXXXXXXXXXXXXXXXXCIKILNPYMPNVIEHLERLQRXXXXXXXXXXXXXXXXXXXXXXXXXXXXXXXXXXXXXXXXXXXXTMTHRRPTIERDVDXXXXXXXXXXXXXXXXMDVIGERLRRIKEEHSSTWHYDEENPXXXXXXXXXXXXXXXXXXXXXXXXXXXXXXXXXXXXXXXXXXXXXXXXXXXXXXXXXXKVDTRTPRPMAGTRXAMEITAEWLWRXXXXXXXXXXXXXXXXXXXXXXXXXXXXXXXXXXXXDNAKAAVEDEDFWKLVERERELHKLGKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHNEEKITHQMDPEHRRLANAIFKLTYXXXXXXXXXXXXXXXXXXXXXXXXXXXXXXXXXXXXXXXXXXXXAQLIRQMEGEGVLSKVXXXXXXXXXXXXAQWLENKGVERLKRMAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHQRMTTEDMLSVWNRVWIEDNXXXEDKTPITTWEDVPYLGXXXXXXXXXXXXXXXXXXXXXXXSTAIQQVRSLIXXXXXXXXXXXXXXXXXXXXXXXXXX

SEQ ID NO: 265756 - protein, 3391 aa, Dengue virus
  MOD_RES (1)..(79): Any amino acid
  MOD_RES (101)..(106): Any amino acid
  MOD_RES (119)..(255): Any amino acid
  MOD_RES (274)..(440): Any amino acid
  MOD_RES (460)..(493): Any amino acid
  MOD_RES (515)..(547): Any amino acid
  MOD_RES (559)..(572): Any amino acid
  MOD_RES (587)..(598): Any amino acid
  MOD_RES (616)..(632): Any amino acid
  MOD_RES (646)..(651): Any amino acid
  MOD_RES (672)..(767): Any amino acid
  MOD_RES (786)..(855): Any amino acid
  MOD_RES (898)..(908): Any amino acid
  MOD_RES (929)..(938): Any amino acid
  MOD_RES (951)..(1052): Any amino acid
  MOD_RES (1077)..(1108): Any amino acid
  MOD_RES (1141)..(1181): Any amino acid
  MOD_RES (1193)..(1267): Any amino acid
  MOD_RES (1280)..(1299): Any amino acid
  MOD_RES (1311)..(1320): Any amino acid
  MOD_RES (1335)..(1335): Any amino acid
  MOD_RES (1350)..(1390): Any amino acid
  MOD_RES (1411)..(1552): Any amino acid
  MOD_RES (1568)..(1717): Any amino acid
  MOD_RES (1730)..(2104): Any amino acid
  MOD_RES (2118)..(2163): Any amino acid
  MOD_RES (2197)..(2236): Any amino acid
  MOD_RES (2250)..(2259): Any amino acid
  MOD_RES (2274)..(2346): Any amino acid
  MOD_RES (2361)..(2502): Any amino acid
  MOD_RES (2517)..(2527): Any amino acid
  MOD_RES (2551)..(2669): Any amino acid
  MOD_RES (2682)..(2764): Any amino acid
  MOD_RES (2786)..(2861): Any amino acid
  MOD_RES (2873)..(2908): Any amino acid
  MOD_RES (2929)..(3040): Any amino acid
  MOD_RES (3062)..(3111): Any amino acid
  MOD_RES (3123)..(3134): Any amino acid
  MOD_RES (3146)..(3315): Any amino acid
  MOD_RES (3328)..(3391): Any amino acid
XXXXXXXXXXXXXXXXXXXXXXXXXXXXXXXXXXXXXXXXXXXXXXXXXXXXXXXXXXXXXXXXXXXXXXXXXXXXXXXVLRGFKKEISSMLSIINRRKKXXXXXXMVLPAALAFHLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHYISTSLIQKVVIFILLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEITSQASTTEVILPEYGTLXXXXXXXXXXXXXXXXXXXXXXXXXXXXXXXXXXLPLPWTSGTTTKTPTWNRKELXXXXXXXXXXXXXXXXXXXXXXXXXXXXXXXXXIQNSGGTSIFSXXXXXXXXXXXXXXKGMSYAMCLGSFVLXXXXXXXXXXXXLVKVEYKGKDAPCKIPFXXXXXXXXXXXXXXXXXNPVVIKKEEPVNIXXXXXXGESNIVIGVGEKALKINWYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVVVQADIGCVINWKGKEXXXXXXXXXXXXXXXXXXXXXXXXXXXXXXXXXXXXXXXXXXXXXXXXXXXXXXXXXXXXXXXXXXXXXXNVKLTVVVGDILGVLEQGKRTLPPQPMELKYSWKTWGKAKMVXXXXXXXXXXXDGPSTPECPSAARAWNVWEVXXXXXXXXXXNIWLKLREAYTQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCEGTTVVISENCGTRGSSLRTTTVXXXXXXXXXXXXXXXXXXXXXXXXXXXXXXXXRPTSEKEENMVKSLVSAGSGKVDNFTMGALCLXXXXXXXXXXXXXXXXXXXXXXXXXXXXXXXXXXXXXXXXXLIMIGSNTSDRXXXXXXXXXXXXXXXXXXXXXXXXXXXXXXXXXXXXXXXXXXXXXXXXXXXXXXXXXXXXXXXXXXXXXXXXXXXYQLWAALVSLMCXXXXXXXXXXXXXXXXXXXXVSLLPMCQSSSXXXXXXXXXXVAAMGVSPLPLFIFXLKDAPKRRSWPLNEXXXXXXXXXXXXXXXXXXXXXXXXXXXXXXXXXXXXXXXXXSADLTVEKAPDVTWEEEAEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGGWRLSAQWKKGEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSATKSEHTGREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPSHLAYRTRSALXXXXXXXXXXXXXXXXXXXXXXXXXXXXXXXXXXXXXXXXXXXXXXLISGKGIGKASIGLICVIASSGMLWIAEIPLQWXXXXXXXXXXXXXXXXXXXXXXXXXXXXXXXXXXXXXXXXAAIIAANEMGMLEXXXXXXXXXXEPGVVSPISYLDVDXXXXXXXXXXXXXXXXXXXXXXXXXXXXXXXXXXXXXXXXXXXXXXXXXXXXXXXXXXXXXXXXXXXXXXXXXLTLAAAVLLLVTHYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWKKKLNQLSRREFDXXXXXXXXXXXRTEAKEGLKRGEITRHAVSRGSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVLNPYMPNVIEXXXXXXXXXXXXXXXXXXXXXXXXXXXXXXXXXXXXXXXXXXXXXXXXXXXXXXXXXXXXXXXXXXXXXXXXXXXXXXXXXXXVIGERVKKIKDEHNSTWHYDDXXXXXXXXXXXXXXXXXXXXXXXXXXXXXXXXXXXXXXXXXXXXXXXXXXXXXXXXXXXXXXXXXXXXXXXXXXXXVMGITAEWLWKXXXXXXXXXXXXXXXXXXXXXXXXXXXXXXXXXXXXDNAKAAVEDENFWKLVDRERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKITQQMNPEHKQLANAIFKLTXXXXXXXXXXXXXXXXXXXXXXXXXXXXXXXXXXXXXXXXXXXXXXXXXXQMEGEGVLSEAXXXXXXXXXXXXTQWLENKGVERXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNKTPVTTWENVXXXXXXXXXXXXXXXXXXXXXXXXXXXXXXXXXXXXXXXXXXXXXXXXXXXXXXXXXXXXXXXX

SEQ ID NO: 265757 - protein, 3388 aa, Dengue virus
  MOD_RES (1)..(1): Any amino acid
XMNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTMSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 265758 - protein, 3388 aa, Dengue virus
  MOD_RES (1)..(1): Any amino acid
  MOD_RES (229)..(229): Any amino acid
  MOD_RES (384)..(385): Any amino acid
  MOD_RES (766)..(766): Any amino acid
  MOD_RES (849)..(857): Any amino acid
  MOD_RES (892)..(892): Any amino acid
  MOD_RES (918)..(919): Any amino acid
  MOD_RES (954)..(981): Any amino acid
  MOD_RES (997)..(1012): Any amino acid
  MOD_RES (1079)..(1106): Any amino acid
  MOD_RES (1175)..(1176): Any amino acid
  MOD_RES (1229)..(1231): Any amino acid
  MOD_RES (1308)..(1311): Any amino acid
  MOD_RES (1333)..(1336): Any amino acid
  MOD_RES (1352)..(1392): Any amino acid
  MOD_RES (1442)..(1453): Any amino acid
  MOD_RES (1525)..(1529): Any amino acid
  MOD_RES (1545)..(1558): Any amino acid
  MOD_RES (1583)..(1586): Any amino acid
  MOD_RES (1602)..(1607): Any amino acid
  MOD_RES (1625)..(1638): Any amino acid
  MOD_RES (1654)..(1717): Any amino acid
  MOD_RES (1732)..(1735): Any amino acid
  MOD_RES (1751)..(1759): Any amino acid
  MOD_RES (1775)..(1788): Any amino acid
  MOD_RES (1805)..(1848): Any amino acid
  MOD_RES (1864)..(1901): Any amino acid
  MOD_RES (1918)..(1932): Any amino acid
  MOD_RES (1963)..(1983): Any amino acid
  MOD_RES (1999)..(2005): Any amino acid
  MOD_RES (2021)..(2025): Any amino acid
  MOD_RES (2041)..(2061): Any amino acid
  MOD_RES (2077)..(2097): Any amino acid
  MOD_RES (2121)..(2121): Any amino acid
  MOD_RES (2140)..(2143): Any amino acid
  MOD_RES (2201)..(2205): Any amino acid
  MOD_RES (2221)..(2225): Any amino acid
  MOD_RES (2271)..(2279): Any amino acid
  MOD_RES (2292)..(2303): Any amino acid
  MOD_RES (2314)..(2319): Any amino acid
  MOD_RES (2335)..(2340): Any amino acid
  MOD_RES (2363)..(2410): Any amino acid
  MOD_RES (2450)..(2475): Any amino acid
  MOD_RES (2500)..(2503): Any amino acid
  MOD_RES (2573)..(2581): Any amino acid
  MOD_RES (2599)..(2615): Any amino acid
  MOD_RES (2631)..(2680): Any amino acid
  MOD_RES (2702)..(2704): Any amino acid
  MOD_RES (2752)..(2756): Any amino acid
  MOD_RES (2792)..(2797): Any amino acid
  MOD_RES (2813)..(2814): Any amino acid
  MOD_RES (2831)..(2848): Any amino acid
  MOD_RES (2892)..(2907): Any amino acid
  MOD_RES (2936)..(2979): Any amino acid
  MOD_RES (2995)..(3001): Any amino acid
  MOD_RES (3026)..(3028): Any amino acid
  MOD_RES (3059)..(3066): Any amino acid
  MOD_RES (3082)..(3088): Any amino acid
  MOD_RES (3104)..(3111): Any amino acid
  MOD_RES (3145)..(3156): Any amino acid
  MOD_RES (3172)..(3198): Any amino acid
  MOD_RES (3212)..(3230): Any amino acid
  MOD_RES (3246)..(3269): Any amino acid
  MOD_RES (3285)..(3306): Any amino acid
  MOD_RES (3333)..(3345): Any amino acid
XMNQRKKVANTPFNMLKRERNRVSTVQGLVKRFSSGMLQGRGPLKLFMALVAFLRFLTIPPTAGILKRWGQLKKNKAIKILTGFRKEIGRMLNILNRRKRSTMMLLCLIPTAMAFSLTTRNGEPHMIVSRQEKGKSLLFKTEDGVNMCTLMAMDLGELCEDTITYKCPLLIQNEPEDIDCWCNLTSAWVMYGTCTQNGEHRREKRSVALVPHVGMGLETRTETWMSSEXAWKHAQRIETWILRHPGFTIMAAFMAYTIGTTHIQRTVFFILLTAVAPSYTMRCIGISNRDFVEGVSGGSWVDIVLEHGSCVTTMAKNKPTLDFELIKTEAKQPATLRTYCIEALLTNTTTESRCPTQGEPSLNEEQDKRYVCKRSMVDRGWGNXXGLFGKGGVVTCAKFLCKKNMEGKVVQPENLEYTIVITPHSGEEHAVGNDTSNHGVTAMITPRTPIVEAELTGYGTLTMECSPRTGLDFNEMILMKMETKAWLVHRQWFLDLPLPWTTGADTSEVHWNHKETLVTFKNPHAKKQDVVVLGSQEGAMHSALTGATEIQMSSGNLLFTGHLKCRLRMDKLQLKGMSYSMCSGKFKVVKEIAETQHGTIVVKVKYEGTGAPCKIPFEIRDVNKKKVVGRIISATPFAESTNSAVNIEAEPPFGDSYIVIGVGDGQLKLNWFKKGSSIGKMFETTMRGAKRMAILGDTAWDFGSVGGLLTSIGKALHQVFGAIYGAAFGGVSWMVRILIGLIITWIGMNSRNTSMAMSCIAVGGIXLFLGFTVHADMGCVVSWSGKELKCGSGIFVIDNVHTWTEQYQFQPESPARVASAILNAHKDGVCGVRSTTRLENIMWKQITNXXXXXXXXXGHDLTVVAGDVKGVLSKGKRALTPPANDLKYSWKXWGKAKIFTPETKNSTFLVDGPDTSEXXNERRAWNSFEVEDYGFGMFTTSIWMKFREGSSELXXXXXXXXXXXXXXXXXXXXXXXXXXXXNQTWQIERASLIEVKXXXXXXXXXXXXXXXXESQMLIPRAYAGPFSHHNYRQGYATQTAGPWHLGKLEMDFGECPGTTVTIQENCGHRGSSLRTTTAXXXXXXXXXXXXXXXXXXXXXXXXXXXXGMEIRPLNEREENMVKSQVAAGQSSSETFFMGLLCLTLFMEECLRRKVTRKHMILVVVITFCAIILGGXXWMDLLRAIIMLGDTMSGRIGGQIHLAIMIVFKMSPGYVLGIFLRRLTSRETAXXXIGMAMTTVFSIPHDLMEFIDGIALGLILLKIVTHFDDTQLGTLALSLTFIRSTTPLIMAWRTIMAVFFAVTLIPLCXXXXLQKQSHWVEITAITLGAQALPXXXXTLMKGASKRSWPLNEXXXXXXXXXXXXXXXXXXXXXXXXXXXXXXXXXXXXXXXXXSADLSLEKAASVQWDEMADITGSSPIVEVKQDEDGSFSIRDIEETNMITXXXXXXXXXXXXLYPLAIPITMALWYIWQVRTQRSGALWDVPSPAATKKATLTEGVYRIMQRGLLGKTQVGVGIHIEGVFHTMXXXXXGSVICHESGRLEPSWXXXXXXXXXXXXXXRLGDKWDREEDVQVLAVEPGKNPKXXXXKPGLFKTITGEIGAVXXXXXXGSSGSPIINKKGKVIGLXXXXXXXXXXXXXXAITQAERTGEPDYEVXXXXXXXXXXXXXXXXXXXXXXXXXXXXXXXXXXXXXXXXXXXXXXXXXXXXXXXXXXXXXXXXQTPAVKSDHTGREIXXXXCHATFTTKLLSSTRVXXXXXXXXXEAHFTDPCSVAARGYXXXXXXXXXXXXXXMTATPPGSIDPFPQSNXXXXXXXXXXXXXXXXXXXXXXXXXXXXXXXXXXXXXXXXXXXXCLRKSGKRVIQLSRKXXXXXXXXXXXXXXXXXXXXXXXXXXXXXXXXXXXXXXRCLKPVILPDGPERVIXXXXXXXXXXXXXXXRGRIGRNLTQEDDQYVFSGDPLRNDEDHAHXXXXXXXXXXXXXXXXXXXXXFGPEREKNQAIDGEFXXXXXXXKTFVELMKRGDLPVWXXXXXASAGISYEDREWCFTXXXXXXXXXXXXXXXXXXXXXEKKKLRPKWLDARVYXXXXXXXXXXXXXXXXXXXXXDILTEIATLPTYLSSKAKLALDNXVMLHTTEKGGKAYQHALNXXXXSLETLMLIALLGAMTAGTFLFFMQGKGMGKLSMGLIAIAMASGLLWIAELQPQWIAAXXXXXFFLMVLLVPEPEKQRXXXXXQLIYVILAILTIIGLVAANEMGLIEKTKTDFGFYQAKAETTILDVXXXXXXXXXLYAVVTTILTPMXXXXXXXXXXXXSLTAIANQAAXXXXXXKGWPLHRVDLGVPLLXXXXXXQVNPTTLTASLVMLSVHYAIIGXXXXXXXXXXXXXXXXXXXXXXXXXXXXXXXXXXXXXXXXXXXXXXXXVMLLVLCVGQLFLMRTTWALCEVLTLATGPIMTLWEGNPXXXXXXXXXXXXXXXXXXXXXXXXXXAFSLIKNVQTPRRGTGITGETLGEXXXXQLNSLDRREFEEYKRSGIIEVDRTEAKSALRDGSKTKYAVSRGTSKIRWIVERGMIKPKGKIVDLGCGRXXXXXXXXXLKNVTEVRGFTKGGPGHXXXXXXXXXXXXXXXXXSGVDVFYRPTEQVDTXXXXXXXXXXXXXXXXXXXXXXXXXXXXXXXXXXXXXXXXXXXXXXXXXXELEKLQRRHGGSLIRCPLSRNXXXEMYWVSGVSGNIVSSVNTISKMLLNRFTTRHRKPTYEKDADLGAGTRXXXXXPEKPDMTVIGRRLQRLREEHKETWHYDHENPYRTWXXXXXXEASSTGSASSMINGVXXLLTKPWDVVPMVTQLAXXXXXXXXXXXXXXXXXXTRTPQPKPGTRMIMTTTANWLWALLGKKKSPRLCTKEEFISKVXXXXXXXXXXXXXXXXTSASEAVSDSRFWELVDKERALHQEGRCXXXXXXXXXXXXXXXXXXXXXXXXXXXXXXXXXXXXXXXXXXXXLNEDHWFSRENSWSGXXXXXXXRLGYILEDIDKKDGDLIYADDTAGXXXRITEDDLLNEELVTEQMAPHHKTLAKAIFKXXXXXXXXKVLRPTPKGAVMDIIXXXXXXXSGQVGTYSLNTFTNMXXXXXXXXEAEGVITRDDMHNPKGLKERVEKWLKECGVDRLXXXXXXXXXXXXKPLDERFSTSLLFLNXXXXXXXXXXXXXXXXXXXXXXXXXXXSHHFHKILMKDGRXXXXXXXXXXXXXXXXXXXQGAGWSLKETACLGKXXXXXXXXXXXXXXXXXXXXXXXXSAVPVEWVPTSRTTWXXXXXXXXXXXXXXXXXXXXXXIEDNPNMTDKTPIHSWEDVPYLGKREXXXXXXXXXXXXXATWAKNIQTAIAQVRNLIGKEEYVDYMPAMKRYSAPFESEGVL

SEQ ID NO: 265759 - protein, 3388 aa, Dengue virus
  MOD_RES (1)..(1): Any amino acid
  MOD_RES (17)..(27): Any amino acid
  MOD_RES (43)..(67): Any amino acid
  MOD_RES (90)..(91): Any amino acid
  MOD_RES (137)..(139): Any amino acid
  MOD_RES (153)..(158): Any amino acid
  MOD_RES (179)..(179): Any amino acid
  MOD_RES (205)..(250): Any amino acid
  MOD_RES (307)..(321): Any amino acid
  MOD_RES (334)..(336): Any amino acid
  MOD_RES (352)..(367): Any amino acid
  MOD_RES (383)..(392): Any amino acid
  MOD_RES (408)..(427): Any amino acid
  MOD_RES (470)..(472): Any amino acid
  MOD_RES (491)..(493): Any amino acid
  MOD_RES (521)..(537): Any amino acid
  MOD_RES (553)..(563): Any amino acid
  MOD_RES (579)..(582): Any amino acid
  MOD_RES (672)..(674): Any amino acid
  MOD_RES (690)..(701): Any amino acid
  MOD_RES (727)..(727): Any amino acid
  MOD_RES (762)..(769): Any amino acid
  MOD_RES (812)..(819): Any amino acid
  MOD_RES (834)..(860): Any amino acid
  MOD_RES (891)..(895): Any amino acid
  MOD_RES (912)..(920): Any amino acid
  MOD_RES (935)..(1013): Any amino acid
  MOD_RES (1048)..(1054): Any amino acid
  MOD_RES (1073)..(1108): Any amino acid
  MOD_RES (1154)..(1156): Any amino acid
  MOD_RES (1173)..(1185): Any amino acid
  MOD_RES (1207)..(1213): Any amino acid
  MOD_RES (1225)..(1232): Any amino acid
  MOD_RES (1306)..(1317): Any amino acid
  MOD_RES (1332)..(1395): Any amino acid
  MOD_RES (1408)..(1417): Any amino acid
  MOD_RES (1426)..(1456): Any amino acid
  MOD_RES (1476)..(1480): Any amino acid
  MOD_RES (1500)..(1509): Any amino acid
  MOD_RES (1525)..(1788): Any amino acid
  MOD_RES (1804)..(1902): Any amino acid
  MOD_RES (1917)..(1933): Any amino acid
  MOD_RES (1948)..(2100): Any amino acid
  MOD_RES (2116)..(2124): Any amino acid
  MOD_RES (2137)..(2168): Any amino acid
  MOD_RES (2198)..(2228): Any amino acid
  MOD_RES (2247)..(2253): Any amino acid
  MOD_RES (2271)..(2347): Any amino acid
  MOD_RES (2360)..(2414): Any amino acid
  MOD_RES (2426)..(2433): Any amino acid
  MOD_RES (2449)..(2475): Any amino acid
  MOD_RES (2491)..(2531): Any amino acid
  MOD_RES (2547)..(2558): Any amino acid
  MOD_RES (2567)..(2681): Any amino acid
  MOD_RES (2700)..(2722): Any amino acid
  MOD_RES (2738)..(2815): Any amino acid
  MOD_RES (2830)..(2851): Any amino acid
  MOD_RES (2886)..(3004): Any amino acid
  MOD_RES (3020)..(3043): Any amino acid
  MOD_RES (3058)..(3115): Any amino acid
  MOD_RES (3142)..(3156): Any amino acid
  MOD_RES (3172)..(3311): Any amino acid
  MOD_RES (3327)..(3349): Any amino acid
  MOD_RES (3361)..(3366): Any amino acid
XNNQRKKARNTPFNMLXXXXXXXXXXXQLVKRFSLGMLQGRGXXXXXXXXXXXXXXXXXXXXXXXXXRWGTLKKNKAIRVLRGFRKEIGXXLNILNRRRRSTVTLLCLIPTVMAFHLTTRNGEPLMIVGKHERGRPXXXKTTEGTNKCTLIAXXXXXXCEDTVTYKCPLLRQNEPEDIXCWCNSTSTWVTYGTCTTTGEHRREKXXXXXXXXXXXXXXXXXXXXXXXXXXXXXXXXXXXXXXXXXXXXXXAGILAYMVGQTRFQRALIFILLTAVAPSMGMRCIGVGNRDFVEGVSGGTWVDLVLEXXXXXXXXXXXXXXXDFELIKTEAKQPXXXRKYCIEAKLTNTTTEXXXXXXXXXXXXXXXXRQFICRHDMVDRGWGXXXXXXXXXXIVTCAMFTCKKNMEGXXXXXXXXXXXXXXXXXXXXTHAVGNDISNHGVTTTITPQSSSTEVELPDYGEVSLDCEPRSXXXFNEMILMEMKNKAWLVHRXXXLDLPLPWAAGADTLGSNWIQKETLVTFXXXXXXXXXXXXXXXXXGAMHTALTGATEIQMXXXXXXXXXXXKCKIRMERLRIKGMSXXXXTGKFSIDREMAETQHGTTVIRVQYEGAGSPCKIPFEIMDLNKEHVVGRVISSTPFAENKDSPVNIEAEPPFGDSYIIIGVEPGQLKLNWXXXGSSIGQMLESTYRGAXXXXXXXXXXXXFGSLGGVFTSLGKAVHQIFGSVYTTXFSGVSWTVKILIGVIITWIGTNSRNTPMAMTCIAXXXXXXXXGFTVHADTGCVASWNGKELKCGSGIFVADNVHTWTEQHKFQPXXXXXXXXAILIAHKDGVCGVRXXXXXXXXXXXXXXXXXXXXXXXXXXXLTVVAGDVKGVLVKGKRALTPPVNDLKYSWXXXXXAKIFTPEARNSTFLVDXXXXXXXXXERRAWNFLEVEDYGXXXXXXXXXXXXXXXXXXXXXXXXXXXXXXXXXXXXXXXXXXXXXXXXXXXXXXXXXXXXXXXXXXXXXXXXXXXXXXXSQMLIPKSYAGPISQHNYRQGYATQTMGPWHLGKXXXXXXXCPGTTVAIQDDCGHRGSSXXXXXXXXXXXXXXXXXXXXXXXXXXXXXXXXXXXXEIRPLSEKEENMVKSQVSAGPGPSETFSMGLLCLTLFIEECLRRKXXXKHMILVVVTTLCAIILXXXXXXXXXXXXXMLGDTMLSRMGGQVHLAIMAVXXXXXXXVLGVFLRRLTSXXXXXXXXGMAMTTVFSIPHDLMEFIDGLSLGLILLKMVTHFDNAQLGTLALSLTFIKSTMPLTMAWRTIMAVLFAVTLIPXXXXXXXXXXXXWVEITALTLGAQALXXXXXXXXXXXXXXXXXXXXXXXXXXXXXXXXXXXXXXXXXXXXXXXXXXXXXXXXXXXXXXXXLSLERAANVQWDXXXXXXXXXXIIEVKQDDXXXXXXXXXXXXXXXXXXXXXXXXXXXXXXXLAIPVTMALWYMWQVRTQRXXXXXDVPSPAATQKATLTEGVYRXXXXXXXXXXQVGVGIHVEGVFHTMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMTATPPGTTDPFPQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCLKPVISTDGPERVXXXXXXXXXXXXXXXXXGRIGRNPTQEDDQYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTEIATLPAYLSSKAKXXXXXXXXXHTTERGGKAYQHXXXXXXXXXXXXXXXXXXXXXXXXXXXXXXXXKGIGKLSMGLITIAVASGLFWVAELQPQWXXXXXXXXXXXXXXXXXXXXXXXXXXXXXXXYVILTILTIIALVAANEMXXXXXXXTDFGFYQEKPETTILDVXXXXXXXXXXXXXXXXXXXXXXXXXXXXXXXXXXXXXXXXXXXXXXXXXXXXXXXXXXXXXXXXXXXXXXXXXXXXXIASLVMLFVHYAXXXXXXXXXXXXXXXXXXXXXXXXXXXXXXXXXXXXXXXXXXXXXXXXXXXXXXXVLCAGQLFLMRXXXXXXXXLTLATGPVLTLWEGNXXXXXXXXXXXXXXXXXXXXXXXXXXXAFSLIKNAQAPRRGTXXXXXXXXXXXXXXXXXXXXXXXXXXXXXXXXXXXXXXXXXALKDGSKIKYAVSRGXXXXXXXXXXXXVKPKGKVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEKLQRKHGGSLIRCPLSXXXXXXXXXXXXXXXXXXXXXXXVSKMLLNRFTTKHRKXXXXXXXXXXXXXXXXXXXXXXXXXXXXXXXXXXXXXXXXXXXXXXXXXXXXXXXXXXXXXXXXXXXXXXXXXXXXXXLTKPWDMIPMVTQLXXXXXXXXXXXXXXXXXXXXXXPQPKPGTRVVMTTTANWLWTLLGRKKSPRLCTKEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYILEDIDRKDGDLMYXXXXXXXXXXXXXXXXXXXXXXXXQMAPHHRILAKAIFXXXXXXXXXXXXXXXXXXXXXXXXXXXXXXXXXXXXXXXXXXXXXXXXXXXXXXXXXXVITQDDMHNPKGLKERVENWLRECGVXXXXXXXXXXXXXXXKPLDERFATSLLFLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNMTDKTPVHSWEDVPXXXXXXXXXXXXXXXXXXXXXXXKNIHTAIAQVRXXXXXXEYVDYMPVMKRYSALSESEGVL

SEQ ID NO: 265760 - protein, 3388 aa, Dengue virus
  MOD_RES (1)..(5): Any amino acid
  MOD_RES (15)..(27): Any amino acid
  MOD_RES (43)..(71): Any amino acid
  MOD_RES (87)..(91): Any amino acid
  MOD_RES (120)..(163): Any amino acid
  MOD_RES (174)..(259): Any amino acid
  MOD_RES (274)..(434): Any amino acid
  MOD_RES (459)..(472): Any amino acid
  MOD_RES (490)..(494): Any amino acid
  MOD_RES (515)..(607): Any amino acid
  MOD_RES (617)..(618): Any amino acid
  MOD_RES (648)..(655): Any amino acid
  MOD_RES (667)..(734): Any amino acid
  MOD_RES (743)..(769): Any amino acid
  MOD_RES (805)..(861): Any amino acid
  MOD_RES (888)..(895): Any amino acid
  MOD_RES (910)..(920): Any amino acid
  MOD_RES (935)..(1018): Any amino acid
  MOD_RES (1029)..(1032): Any amino acid
  MOD_RES (1047)..(1056): Any amino acid
  MOD_RES (1072)..(1118): Any amino acid
  MOD_RES (1139)..(1157): Any amino acid
  MOD_RES (1173)..(1187): Any amino acid
  MOD_RES (1207)..(1232): Any amino acid
  MOD_RES (1247)..(1257): Any amino acid
  MOD_RES (1273)..(1275): Any amino acid
  MOD_RES (1294)..(1460): Any amino acid
  MOD_RES (1469)..(1481): Any amino acid
  MOD_RES (1497)..(1789): Any amino acid
  MOD_RES (1804)..(2175): Any amino acid
  MOD_RES (2196)..(2231): Any amino acid
  MOD_RES (2244)..(2253): Any amino acid
  MOD_RES (2269)..(2347): Any amino acid
  MOD_RES (2356)..(2434): Any amino acid
  MOD_RES (2449)..(2477): Any amino acid
  MOD_RES (2491)..(2531): Any amino acid
  MOD_RES (2542)..(2684): Any amino acid
  MOD_RES (2697)..(2852): Any amino acid
  MOD_RES (2867)..(2871): Any amino acid
  MOD_RES (2886)..(3368): Any amino acid
XXXXXKKVVRPSFNXXXXXXXXXXXXXGLTKRFSIGLFSGKGXXXXXXXXXXXXXXXXXXXXXXXXXXXXXIKKTKAINVLRGFRKXXXXXLNILNRRKRTAGMIIMLIPTIMAFHLSTXXXXXXXXXXXXXXXXXXXXXXXXXXXXXXXXXXXXXXXXXXXXTYECPLLVNTXXXXXXXXXXXXXXXXXXXXXXXXXXXXXXXXXXXXXXXXXXXXXXXXXXXXXXXXXXXXXXXXXXXXXXXXXXXXXXXXXXXXXXQTGIQRTIFFVLMMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPKHGKEAKITPRSPSAEVKLPDYXXXXXXXXXXXXXXFNEMVLLQMEKKTWLVHXXXXXDLPLPWLPGADTQGSNWIQKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGDGSPCKIPXXIRDVEKRRVLGRLITVNPFVEYTNSVTNIXXXXXXXXSYIMIGVGNSAXXXXXXXXXXXXXXXXXXXXXXXXXXXXXXXXXXXXXXXXXXXXXXXXXXXXXXXXXXXXXXXXXXXXIRILIGLLXXXXXXXXXXXXXXXXXXXXXXXXXXXGFTVRADMGCAVSWNGRELKCGSGIFVTDNVHTWTXXXXXXXXXXXXXXXXXXXXXXXXXXXXXXXXXXXXXXXXXXXXXXXXXXXXXXXXXTIVAGDAKGVLTKGKRALAPPVNDLKXXXXXXXXAKIFTPEVRNSTFLXXXXXXXXXXXERRAWNFFEVEDYGXXXXXXXXXXXXXXXXXXXXXXXXXXXXXXXXXXXXXXXXXXXXXXXXXXXXXXXXXXXXXXXXXXXXXXXXXXXXXXXXXXXXPKAYAGPISQXXXXQGYATQIAGPWHLGXXXXXXXXXXGTTVTIQEDCGHRGSXXXXXXXXXXXXXXXXXXXXXXXXXXXXXXXXXXXXXXXXXXXXXXXNMVKSQATAGQGTSETFFMGXXXXXXXXXXXXXXXXXXXHMILVVAATLCAIILXXXXXXXXXXXXXXXGDTMFGRIGGQTHLAIMIVXXXXXXXXXXXXXXXXXXXXXXXXXXGMAMTTTFSIPHDLXXXXXXXXXXXILLKMVTHFDSTQVGXXXLSLTFIRSTIPLTMAWRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTMALWYMXXXXXXXXXXXXXVPSPATAQKATLTEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTATPPGSTDPFPQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGLIAIAVASGLLWVAELQPXXXXXXXXXXXXXXXXXXXXXXXXXXXXXXXXXXXXLTLLTIISLIAAXXXXXXXXXXADFGFYQVKAETTILXXXXXXXXXXXXXXXXXXXXXXXXXXXXXXXXXXXXXXXXXXXXXXXXXXXXXXXXXXXXXXXXXXXXXXXXXXXXXXXTASLAMLLXXXXXXXXXXXXXXXXXXXXXXXXXXXXXXXXXXXXXXXXXXXXXXXXXXXXXXXXXXXXXXXXXXXXXXXXXXXXXXXTLSTGPALTLWEGGXXXXXXXXXXXXXXXXXXXXXXXXXXXXXSLIKNTQTPRRGTXXXXXXXXXXXXXXXXXXXXXXXXXXXXXXXXXXXXXXXXXALKDGSKIKYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQRKYGGSLVRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQPKLGTQMIMTTTAXXXXXLLGKKKTPRLCTREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMDYMPAMRRYSAHFESEGVL

SEQ ID NO: 265761 - protein, 3388 aa, Dengue virus
  MOD_RES (1)..(74): Any amino acid
  MOD_RES (83)..(93): Any amino acid
  MOD_RES (107)..(110): Any amino acid
  MOD_RES (120)..(435): Any amino acid
  MOD_RES (456)..(474): Any amino acid
  MOD_RES (483)..(499): Any amino acid
  MOD_RES (509)..(620): Any amino acid
  MOD_RES (648)..(656): Any amino acid
  MOD_RES (667)..(734): Any amino acid
  MOD_RES (743)..(769): Any amino acid
  MOD_RES (792)..(872): Any amino acid
  MOD_RES (888)..(897): Any amino acid
  MOD_RES (910)..(1057): Any amino acid
  MOD_RES (1071)..(1118): Any amino acid
  MOD_RES (1138)..(1157): Any amino acid
  MOD_RES (1173)..(1193): Any amino acid
  MOD_RES (1203)..(1262): Any amino acid
  MOD_RES (1273)..(1277): Any amino acid
  MOD_RES (1286)..(2257): Any amino acid
  MOD_RES (2269)..(2533): Any amino acid
  MOD_RES (2542)..(2686): Any amino acid
  MOD_RES (2696)..(2853): Any amino acid
  MOD_RES (2864)..(2876): Any amino acid
  MOD_RES (2886)..(3373): Any amino acid
XXXXXXXXXXXXXXXXXXXXXXXXXXXXXXXXXXXXXXXXXXXXXXXXXXXXXXXXXXXXXXXXXXXXXXXXXXSKAINVLRXXXXXXXXXXXILNGRRRTAGMIIXXXXTVMAFHLTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKHGKTIKITPRSPSAEVKLXXXXXXXXXXXXXXXXXXXEMILMRMKXXXXXXXXXXXXXXXXXWTAGADTLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDMNKEKVIGRIISSIPIATEKDSPVNIXXXXXXXXXYIIIGVGDSAXXXXXXXXXXXXXXXXXXXXXXXXXXXXXXXXXXXXXXXXXXXXXXXXXXXXXXXXXXXXXXXXXXXXMKILIGVIXXXXXXXXXXXXXXXXXXXXXXXXXXXGFTVQADVGCVVSWTGKELKCGXXXXXXXXXXXXXXXXXXXXXXXXXXXXXXXXXXXXXXXXXXXXXXXXXXXXXXXXXXXXXXXXXXXXXXXXXXXXXXXXXTKGKRTLAPPASDLKXXXXXXXXXXIFAPEARNNTFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTTVTVREDCDHRGXXXXXXXXXXXXXXXXXXXXXXXXXXXXXXXXXXXXXXXXXXXXXXXXNMVRSQVTAGQGTPETFSMXXXXXXXXXXXXXXXXXXXXHMILVVVTTFCAIILXXXXXXXXXXXXXXXXXXXXXRVGGQTHLAXXXXXXXXXXXXXXXXXXXXXXXXXXXXXXXXXXXXXXXXXXXXXXXXXXXXXXXXXXXXVVHFDNAQLGXXXXXLTFIKTTMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFYQVKTEITILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRDGSKTKHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRKYGGSLVRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPKPGTQMIMTXXXXXXXXXXXXXKNPRLCTKEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVMKRYSAPSENEGVL

SEQ ID NO: 265762 - protein, 3388 aa, Dengue virus
  MOD_RES (1)..(1): Any amino acid
  MOD_RES (631)..(637): Any amino acid
  MOD_RES (1285)..(1285): Any amino acid
XMNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRXXXXXXXAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCVVSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGQGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTXSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 265763 - protein, 3388 aa, Dengue virus
  MOD_RES (1)..(1): Any amino acid
  MOD_RES (631)..(637): Any amino acid
  MOD_RES (850)..(856): Any amino acid
  MOD_RES (955)..(980): Any amino acid
  MOD_RES (998)..(1011): Any amino acid
  MOD_RES (1080)..(1105): Any amino acid
  MOD_RES (1230)..(1230): Any amino acid
  MOD_RES (1285)..(1285): Any amino acid
  MOD_RES (1309)..(1310): Any amino acid
  MOD_RES (1334)..(1335): Any amino acid
  MOD_RES (1353)..(1391): Any amino acid
  MOD_RES (1443)..(1452): Any amino acid
  MOD_RES (1526)..(1528): Any amino acid
  MOD_RES (1546)..(1557): Any amino acid
  MOD_RES (1584)..(1585): Any amino acid
  MOD_RES (1603)..(1606): Any amino acid
  MOD_RES (1626)..(1637): Any amino acid
  MOD_RES (1655)..(1716): Any amino acid
  MOD_RES (1733)..(1734): Any amino acid
  MOD_RES (1752)..(1758): Any amino acid
  MOD_RES (1776)..(1787): Any amino acid
  MOD_RES (1806)..(1847): Any amino acid
  MOD_RES (1865)..(1900): Any amino acid
  MOD_RES (1919)..(1931): Any amino acid
  MOD_RES (1964)..(1982): Any amino acid
  MOD_RES (2000)..(2004): Any amino acid
  MOD_RES (2022)..(2024): Any amino acid
  MOD_RES (2042)..(2060): Any amino acid
  MOD_RES (2078)..(2096): Any amino acid
  MOD_RES (2141)..(2142): Any amino acid
  MOD_RES (2202)..(2204): Any amino acid
  MOD_RES (2222)..(2224): Any amino acid
  MOD_RES (2272)..(2278): Any amino acid
  MOD_RES (2293)..(2302): Any amino acid
  MOD_RES (2315)..(2318): Any amino acid
  MOD_RES (2336)..(2339): Any amino acid
  MOD_RES (2364)..(2409): Any amino acid
  MOD_RES (2451)..(2474): Any amino acid
  MOD_RES (2501)..(2502): Any amino acid
  MOD_RES (2574)..(2580): Any amino acid
  MOD_RES (2600)..(2614): Any amino acid
  MOD_RES (2632)..(2679): Any amino acid
  MOD_RES (2703)..(2703): Any amino acid
  MOD_RES (2753)..(2755): Any amino acid
  MOD_RES (2793)..(2796): Any amino acid
  MOD_RES (2832)..(2847): Any amino acid
  MOD_RES (2893)..(2906): Any amino acid
  MOD_RES (2937)..(2978): Any amino acid
  MOD_RES (2996)..(3000): Any amino acid
  MOD_RES (3027)..(3027): Any amino acid
  MOD_RES (3060)..(3065): Any amino acid
  MOD_RES (3083)..(3087): Any amino acid
  MOD_RES (3105)..(3110): Any amino acid
  MOD_RES (3146)..(3155): Any amino acid
  MOD_RES (3173)..(3197): Any amino acid
  MOD_RES (3213)..(3229): Any amino acid
  MOD_RES (3247)..(3268): Any amino acid
  MOD_RES (3286)..(3305): Any amino acid
  MOD_RES (3334)..(3344): Any amino acid
XMNQRKKVANTPFNMLKRERNRVSTVQGLVKRFSSGMLQGRGPLKLFMALVAFLRFLTIPPTAGILKRWGQLKKNKAIKILTGFRKEIGRMLNILNRRKRSTMTLLCLIPTAMAFSLTTRNGEPHMIVSRQEKGKSLLFKTEDGVNMCTLMAMDLGELCEDTVTYKCPLLIQNEPEDIDCWCNLTSAWVMYGTCTQNGEHRREKRSVALVPHVGMGLETRTETWMSSEGAWKHAQRIETWILRHPGFTIMAGIMAYTVGTTGIQRTVFFILLTAVAPSYGMRCIGISNRDFVEGVSGGSWVDIVLEHGSCVTTMAKNKPTLDFELIKTEAKQPATLRTYCIEALLTNTTTESRCPTQGEPSLNEEQDKQFICKHSMVDRGWGNGCGLFGKGGVVTCAKFLCKKNMEGKVVQPENLEYTIVITPHSGETHAVGNDTSNHGVTAMITPRTPSVEVELTDYGTLSMECSPRTGLDFNEMILMRMKTKAWLVHRQWFLDLPLPWTTGADTSEVHWNHKETLVTFKNPHAKKQDVVVLGSQEGAMHSALTGATEIQMSSGNLLFTGHLKCRLRMDKLQLKGMSYSMCSGKFSIDREIAETQHGTIVVKVKYEGTGAPCKIPIEIRDVNKKKVVGRXXXXXXXAESTNSAVNIEAEPPFGDSYIVIGVGDGQLKLNWFKKGSSIGQMFETTMRGAKRMAILGDTAWDFGSVGGLLTSLGKAVHQIFGAIYGAMFGGVSWMVRILIGLIITWIGMNSRNTSMAMSCIAVGGITLFLGFTVHADMGCVASWSGKELKCGSGIFVIDNVHTWTEQYQFQPESPARVASAILNAHKEGVCGIRSTTRLENIMWKQITNEXXXXXXXGGHDLTVVAGDVKGVLSKGKRALTPPANDLKYSWKTWGKAKIFTPETKNSTFLVDGPDTSECPNERRAWNSFEVEDYGFGMFTTSIWMKFREGSSELCXXXXXXXXXXXXXXXXXXXXXXXXXXKNQTWQIERASLIEVKTXXXXXXXXXXXXXXLESQMLIPRAYAGPFSHHNYRQGYATQTAGPWHLGKLEMDFGECPGTTVTIQENCGHRGSSLRTTTASXXXXXXXXXXXXXXXXXXXXXXXXXXYGMEIRPLNEREENMVKSQVAAGQSSSETFFMGLLCLTLFMEECLRRKVTRKHMILVVVITFCAIILGGLTWMDLLRAIIMLGDTMSGRIGGQIHLAIMIVFKMSPGYVLGIFLRRLTSRETALXVIGMAMTTVFSIPHDLMEFIDGLSLGLILLKIVTHFDDAQVGTLALSLTFIKSTXPLIMAWRTIMAVFFAVTLIPLCRXXCLQKQSHWVEITAITLGAQALPVXXMTLMKGASKRSWPLNEGXXXXXXXXXXXXXXXXXXXXXXXXXXXXXXXXXXXXXXXSSADLSLEKAASVQWDEMADITGSSPIVEVKQDEDGSFSIRDIEETNMITLXXXXXXXXXXGLYPLAIPITMALWYIWQVRTQRSGALWDVPSPAATKKATLTEGVYRIMQRGLLGRTQVGVGIHIEGVFHTMWXXXRGSVICHESGRLEPSWAXXXXXXXXXXXXWRLGDKWDREEDVQVLAVEPGKNPKHXXTKPGLFKTITGEIGAVTXXXXPGTSGSPIINKKGKVIGLYXXXXXXXXXXXXSAITQAERTGEPDYEVDXXXXXXXXXXXXXXXXXXXXXXXXXXXXXXXXXXXXXXXXXXXXXXXXXXXXXXXXXXXXXXYQTPAVKSDHTGREIVXXMCHATFTTKLLSSTRVPXXXXXXXDEAHFTDPCSVAARGYIXXXXXXXXXXXXFMTATPPGSIDPFPQSNSXXXXXXXXXXXXXXXXXXXXXXXXXXXXXXXXXXXXXXXXXXNCLRKSGKRVIQLSRKTXXXXXXXXXXXXXXXXXXXXXXXXXXXXXXXXXXXXRRCLKPVILPDGPERVILXXXXXXXXXXXXXRRGRIGRNLTQEDDQYVFSGDPLRNDEDHAHWXXXXXXXXXXXXXXXXXXXLFGPEREKNQAIDGEFRXXXXXRKTFVELMKRGDLPVWLXXXVASAGISYEDREWCFTGXXXXXXXXXXXXXXXXXXXGEKKKLRPKWLDARVYAXXXXXXXXXXXXXXXXXXXLDILTEIATLPTYLSSKAKLALDNIVMLHTTEKGGKAYQHALNEXXESLETLMLIALLGAMTAGTFLFFMQGKGMGKLSMGLIAIAMASGLLWIAELQPQWIAASXXXEFFLMVLLVPEPEKQRTXXXNQLIYVILAILTIIGLVAANEMGLIEKTKTDFGFYQAKAETTILDVDXXXXXXXTLYAVVTTILTPMLXXXXXXXXXXLSLTAIANQAAVXXXXGKGWPLHRVDLGVPLLAXXXXSQVNPTTLTASLVMLSVHYAIIGPXXXXXXXXXXXXXXXXXXXXXXXXXXXXXXXXXXXXXXXXXXXXXXQVMLLVLCVGQLLLMRTTWALCEVLTLATGPIMTLWEGNPGXXXXXXXXXXXXXXXXXXXXXXXXLAFSLIKNVQAPRRGTGITGETLGEKXXRQLNSLDRREFEEYKRSGIIEVDRTEAKSALRDGSKTKYAVSRGTSKIRWIVERGMIKPKGKVIDLGCGRGXXXXXXXTLKNVTEVRGFTKGGPGHEXXXXXXXXXXXXXXXHSGVDVFYRPTEQVDTLXXXXXXXXXXXXXXXXXXXXXXXXXXXXXXXXXXXXXXXXXXXXXXXXEELEKLQRRHGGSLIRCPLSRNSXHEMYWVSGVSGNIVSSVNTISKMLLNRFTTKHRKPTYEKDADLGAGTRSXXXEPENPDMTIIGRRLQRLREEHKETWHYDHENPYRTWAXXXXYEASSTGSASSMINGVVKLLTKPWDVVPMVTQLAMXXXXXXXXXXXXXXXXDTRTPQPKPGTRMIMTTTANWLWALLGKKKSPRLCTKEEFISKVRXXXXXXXXXXXXXXWTSASEAVSDSRFWELVDKERALHQEGRCEXXXXXXXXXXXXXXXXXXXXXXXXXXXXXXXXXXXXXXXXXXFLNEDHWFSRENSWSGVXXXXXHRLGYILEDIDKKDGDLIYADDTAGWXTRITEDDLLNEELVTEQMAPHHKTLAKAIFKLXXXXXXVKVLRPTPKGAVMDIISXXXXXGSGQVGTYSLNTFTNMEXXXXXXMEAEGVITRDDMHNPKGLKERVEKWLKECGVDRLKXXXXXXXXXXVKPLDERFSTSLLFLNDXXXXXXXXXXXXXXXXXXXXXXXXXCSHHFHRIFMKDGRSXXXXXXXXXXXXXXXXXSQGAGWSLKETACLGKAXXXXXXXXXXXXXXXXXXXXXXCSAVPVEWLPTSRTTWSXXXXXXXXXXXXXXXXXXXXWIEDNPNMTDKTPIHSWEDVPYLGKREDXXXXXXXXXXXRATWAKNIQTAIAQVRNLIGKEEYVDYMPAMKRYSAPFESEGVL

SEQ ID NO: 265764 - protein, 3388 aa, Dengue virus
  MOD_RES (1)..(1): Any amino acid
  MOD_RES (18)..(26): Any amino acid
  MOD_RES (44)..(66): Any amino acid
  MOD_RES (138)..(138): Any amino acid
  MOD_RES (154)..(157): Any amino acid
  MOD_RES (206)..(249): Any amino acid
  MOD_RES (308)..(320): Any amino acid
  MOD_RES (335)..(335): Any amino acid
  MOD_RES (353)..(366): Any amino acid
  MOD_RES (384)..(391): Any amino acid
  MOD_RES (409)..(426): Any amino acid
  MOD_RES (471)..(471): Any amino acid
  MOD_RES (492)..(492): Any amino acid
  MOD_RES (522)..(536): Any amino acid
  MOD_RES (554)..(562): Any amino acid
  MOD_RES (580)..(581): Any amino acid
  MOD_RES (631)..(637): Any amino acid
  MOD_RES (673)..(673): Any amino acid
  MOD_RES (691)..(700): Any amino acid
  MOD_RES (763)..(768): Any amino acid
  MOD_RES (813)..(818): Any amino acid
  MOD_RES (835)..(859): Any amino acid
  MOD_RES (892)..(894): Any amino acid
  MOD_RES (913)..(919): Any amino acid
  MOD_RES (936)..(1012): Any amino acid
  MOD_RES (1049)..(1053): Any amino acid
  MOD_RES (1074)..(1107): Any amino acid
  MOD_RES (1155)..(1155): Any amino acid
  MOD_RES (1174)..(1184): Any amino acid
  MOD_RES (1208)..(1212): Any amino acid
  MOD_RES (1226)..(1231): Any amino acid
  MOD_RES (1285)..(1285): Any amino acid
  MOD_RES (1307)..(1316): Any amino acid
  MOD_RES (1333)..(1394): Any amino acid
  MOD_RES (1409)..(1410): Any amino acid
  MOD_RES (1427)..(1455): Any amino acid
  MOD_RES (1477)..(1479): Any amino acid
  MOD_RES (1501)..(1508): Any amino acid
  MOD_RES (1526)..(1608): Any amino acid
  MOD_RES (1618)..(1787): Any amino acid
  MOD_RES (1805)..(1901): Any amino acid
  MOD_RES (1918)..(1932): Any amino acid
  MOD_RES (1949)..(2099): Any amino acid
  MOD_RES (2117)..(2123): Any amino acid
  MOD_RES (2138)..(2167): Any amino acid
  MOD_RES (2199)..(2227): Any amino acid
  MOD_RES (2248)..(2252): Any amino acid
  MOD_RES (2272)..(2346): Any amino acid
  MOD_RES (2361)..(2413): Any amino acid
  MOD_RES (2431)..(2432): Any amino acid
  MOD_RES (2450)..(2474): Any amino acid
  MOD_RES (2494)..(2530): Any amino acid
  MOD_RES (2548)..(2557): Any amino acid
  MOD_RES (2568)..(2680): Any amino acid
  MOD_RES (2701)..(2721): Any amino acid
  MOD_RES (2739)..(2814): Any amino acid
  MOD_RES (2831)..(2850): Any amino acid
  MOD_RES (2887)..(3003): Any amino acid
  MOD_RES (3021)..(3042): Any amino acid
  MOD_RES (3059)..(3114): Any amino acid
  MOD_RES (3143)..(3155): Any amino acid
  MOD_RES (3173)..(3310): Any amino acid
  MOD_RES (3328)..(3348): Any amino acid
  MOD_RES (3362)..(3365): Any amino acid
XNNQRKKARNTPFNMLKXXXXXXXXXQQLVKRFSIGLFSGKGPXXXXXXXXXXXXXXXXXXXXXXXKRWGTLKKNKAIRVLRGFRKEIGRMLNILNGRRRSTVTLLCLIPTVMAFHLTTRNGEPLMIVARHERGRPLXFKTTEGINRCTLIAMXXXXMCEDTITYKCPLLRQNEPEDIDCWCNSTSTWVTYGTCTTTGEHRREKRXXXXXXXXXXXXXXXXXXXXXXXXXXXXXXXXXXXXXXXXXXXXLAAFLAYMIGQTHFQRALIFILLTAVAPSMTMRCIGVGNRDFVEGVSGGVWVDLVLEHXXXXXXXXXXXXXLDFELIKTEAKQPAXLRKYCIEAKLTNTTTESXXXXXXXXXXXXXXDQRYVCRRDMVDRGWGNXXXXXXXXGIVTCAMFTCKKNMEGKXXXXXXXXXXXXXXXXXXDEHAVGNDTSNHGVTTKITPQSSITEAELPGYGEVTMECSPRTGXDFNEMILMEMENKAWLVHRQXFLDLPLPWAPGADTQGSNWIQKETLVTFKXXXXXXXXXXXXXXXEGAMHTALTGATEIQMSXXXXXXXXXLKCKIRMEKLRIKGISYXXCTGKFKVVKEIAETQHGTAVIRVQYEGDGSPCKIPFEIMDLEKRHVLGRXXXXXXXAENKDSPVNIEAEPPFGDSYIMIGVEPGQLKLNWFXKGSSIGKMLESTYRGAKXXXXXXXXXXDFGSLGGVFTSIGKALHQVFGAIYGAAFSGVSWTIKILIGVIITWIGTNSRNTPMAMTCIAVXXXXXXLGFTVHADTGCAVSWNGKELKCGSGIFVTDNVHTWTEQHKFQPEXXXXXXSAILIAHKEGVCGIRSXXXXXXXXXXXXXXXXXXXXXXXXXDLTVVAGDVKGVLTKGKRALTPPVNDLKYSWKXXXKAKIFAPEARNSTFLVDGXXXXXXXNERRAWNFLEVEDYGFXXXXXXXXXXXXXXXXXXXXXXXXXXXXXXXXXXXXXXXXXXXXXXXXXXXXXXXXXXXXXXXXXXXXXXXXXXXXXESQMLIPKSYAGPISQHNYRQGYATQTMGPWHLGKLXXXXXECPGTTVAIQEDCGHRGSSLXXXXXXXXXXXXXXXXXXXXXXXXXXXXXXXXXXMEIRPLSEKEENMVKSQVSAGPGPSETFSMGLLCLTLFIEECLRRKVXRKHMILVVVTTLCAIILGXXXXXXXXXXXIMLGDTMLSRMGGQVHLAIMAVFXXXXXYVLGVFLRRLTSRXXXXXXIGMAMTTVFSIPHDLMEFIDGLSLGLILLKMVTHFDSTQVGTLALALTFIKSTXPLTMAWRTIMAVLFAVTLIPLXXXXXXXXXXHWVEITALTLGAQALPXXXXXXXXXXXXXXXXXXXXXXXXXXXXXXXXXXXXXXXXXXXXXXXXXXXXXXXXXXXXXXDLSLERAANVQWDEXXAITGSSPIIEVKQDDDXXXXXXXXXXXXXXXXXXXXXXXXXXXXXPLAIPVTMTLWYMWQVRTQRSXXXWDVPSPAATQKATLTEGVYRIXXXXXXXXTQVGVGVHVEGVFHTMWXXXXXXXXXXXXXXXXXXXXXXXXXXXXXXXXXXXXXXXXXXXXXXXXXXXXXXXXXXXXXXXXXXXXXXXXXXXXXXXXXXXSSGSPIINRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFMTATPPGTTDPFPQSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRCLKPVISTDGPERVIXXXXXXXXXXXXXXXRGRIGRNPTQEDDQYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTEIATLPAYLSSKAKLXXXXXXXLHTTERGGKAYQHAXXXXXXXXXXXXXXXXXXXXXXXXXXXXXXGKGIGKLSMGLITIAVASGLFWVAELQPQWIXXXXXXXXXXXXXXXXXXXXXXXXXXXXXIYVILTILTIIALVAANEMGXXXXXKTDFGFYQEKPETTILDVDXXXXXXXXXXXXXXXXXXXXXXXXXXXXXXXXXXXXXXXXXXXXXXXXXXXXXXXXXXXXXXXXXXXXXXXXXXXLIASLAMLLVHYAIXXXXXXXXXXXXXXXXXXXXXXXXXXXXXXXXXXXXXXXXXXXXXXXXXXXXXLVLCAGQLFLMRTTWAFXXVLTLATGPVLTLWEGNPXXXXXXXXXXXXXXXXXXXXXXXXXLAFSLIKNAQTPRRGTGITXXXXXXXXXXXXXXXXXXXXXXXXXXXXXXXXXXXXXSALKDGSKIKYAVSRGTXXXXXXXXXXMVKPKGKVIDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXELEKLQRKHGGSLIRCPLSRXXXXXXXXXXXXXXXXXXXXXTVSKMLLNRFTTKHRKPXXXXXXXXXXXXXXXXXXXXXXXXXXXXXXXXXXXXXXXXXXXXXXXXXXXXXXXXXXXXXXXXXXXXXXXXXXXXLLTKPWDMIPMVTQLAXXXXXXXXXXXXXXXXXXXXTPQPKPGTRVVMTTTANWLWTLLGRKKTPRLCTREEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGYILEDIDRKDGDLMYAXXXXXXXXXXXXXXXXXXXXXXEQMAPHHRILAKAIFKXXXXXXXXXXXXXXXXXXXXXXXXXXXXXXXXXXXXXXXXXXXXXXXXXXXXXXXXGVITQDDMQNPKGLKERVENWLRECGVDXXXXXXXXXXXXXVKPLDERFATSLLFLNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPNMTDKTPVHSWEDVPYXXXXXXXXXXXXXXXXXXXXXAKNIHTAIAQVRNXXXXEEYVDYMPVMRRYSALSESEGVL

SEQ ID NO: 265765 - protein, 3388 aa, Dengue virus
  MOD_RES (1)..(5): Any amino acid
  MOD_RES (16)..(26): Any amino acid
  MOD_RES (44)..(70): Any amino acid
  MOD_RES (88)..(90): Any amino acid
  MOD_RES (121)..(162): Any amino acid
  MOD_RES (175)..(257): Any amino acid
  MOD_RES (275)..(367): Any amino acid
  MOD_RES (377)..(433): Any amino acid
  MOD_RES (460)..(471): Any amino acid
  MOD_RES (491)..(493): Any amino acid
  MOD_RES (516)..(606): Any amino acid
  MOD_RES (631)..(637): Any amino acid
  MOD_RES (649)..(654): Any amino acid
  MOD_RES (668)..(734): Any amino acid
  MOD_RES (744)..(768): Any amino acid
  MOD_RES (806)..(860): Any amino acid
  MOD_RES (889)..(894): Any amino acid
  MOD_RES (910)..(919): Any amino acid
  MOD_RES (936)..(1017): Any amino acid
  MOD_RES (1030)..(1031): Any amino acid
  MOD_RES (1048)..(1055): Any amino acid
  MOD_RES (1073)..(1113): Any amino acid
  MOD_RES (1140)..(1156): Any amino acid
  MOD_RES (1174)..(1186): Any amino acid
  MOD_RES (1208)..(1231): Any amino acid
  MOD_RES (1248)..(1256): Any amino acid
  MOD_RES (1274)..(1274): Any amino acid
  MOD_RES (1285)..(1285): Any amino acid
  MOD_RES (1295)..(1459): Any amino acid
  MOD_RES (1473)..(1480): Any amino acid
  MOD_RES (1498)..(1788): Any amino acid
  MOD_RES (1805)..(2104): Any amino acid
  MOD_RES (2114)..(2174): Any amino acid
  MOD_RES (2197)..(2230): Any amino acid
  MOD_RES (2245)..(2252): Any amino acid
  MOD_RES (2270)..(2346): Any amino acid
  MOD_RES (2357)..(2433): Any amino acid
  MOD_RES (2450)..(2476): Any amino acid
  MOD_RES (2492)..(2530): Any amino acid
  MOD_RES (2543)..(2683): Any amino acid
  MOD_RES (2698)..(2851): Any amino acid
  MOD_RES (2868)..(2871): Any amino acid
  MOD_RES (2887)..(3128): Any amino acid
  MOD_RES (3138)..(3367): Any amino acid
XXXXXNRVVRPPFNMXXXXXXXXXXXQGLTKRFSLGMLQGRGPXXXXXXXXXXXXXXXXXXXXXXXXXXXQIKKSKAINVLRGFRKEXXXMLNILNRRKRTAGMIIMLIPTIMAFHLSTRXXXXXXXXXXXXXXXXXXXXXXXXXXXXXXXXXXXXXXXXXXVTYECPLLVNTEXXXXXXXXXXXXXXXXXXXXXXXXXXXXXXXXXXXXXXXXXXXXXXXXXXXXXXXXXXXXXXXXXXXXXXXXXXXXXXXXXXXIGQTRIQRTIFFVLMMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQQYICRRNVXXXXXXXXXXXXXXXXXXXXXXXXXXXXXXXXXXXXXXXXXXXXXXXXXXXXXXXXXDIPKHGVEITITPRSPSAEVKLPDYGXXXXXXXXXXXXDFNEMVLLQMEKKTWLVHKXXXLDLPLPWLAGADTLEVHWNHKEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEGAGAPCKIPIEIRDVNKEKVIGRXXXXXXXVTEKDSPVNIEXXXXXXDSYIIIGVEPGQLXXXXXXXXXXXXXXXXXXXXXXXXXXXXXXXXXXXXXXXXXXXXXXXXXXXXXXXXXXXXXXXXXXXVRILIGLLVXXXXXXXXXXXXXXXXXXXXXXXXXLGFTVQADMGCAVSWNGRELKCGSGIFVADNVHTWTEXXXXXXXXXXXXXXXXXXXXXXXXXXXXXXXXXXXXXXXXXXXXXXXXXXXXXXXLTIVAGDAKGVLVKGKRALAPPVNDLKYXXXXXXKAKIFTPETKNSTFLXXXXXXXXXXNERRAWNFFEVEDYGFXXXXXXXXXXXXXXXXXXXXXXXXXXXXXXXXXXXXXXXXXXXXXXXXXXXXXXXXXXXXXXXXXXXXXXXXXXXXXXXXXXIPKAYAGPISQHXXRQGYATQIAGPWHLGKXXXXXXXXPGTTVTIQDDCDHRGPSXXXXXXXXXXXXXXXXXXXXXXXXXXXXXXXXXXXXXXXXXNEKEENMVKSQATAGQGTPETFSMGLXXXXXXXXXXXXXXXXXKHMILVVATTFCAIILGXXXXXXXXXXXXXLGDTMSSRVGGQTHLAIMIVFXXXXXXXXXXXXXXXXXXXXXXXXIGMAMTTTFSIPHDLMXXXXXXXXXLILLKMVTQFDDTQVGTXALSLTFIKTTXPLTMAWRTIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVTMALWYMWQVKXXXXXXXXDVPSPATAQKATLTEGVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMTATPPGSTDPFPQSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLPTYLSSKXXXXXXXXXXXXXXXXXXXXXXXXXXXXXXXXXXXXXXXXXXXXXXXXXXXXXXXXXXXXXSVGLITIAVASGLLWVAELQPQXXXXXXXXXXXXXXXXXXXXXXXXXXXXXXXXXXILALLAIIGLIAANXXXXXXXXKADFGFYQVKAETTILDXXXXXXXXXXXXXXXXXXXXXXXXXXXXXXXXXXXXXXXXXXXXXXXXXXXXXXXXXXXXXXXXXXXXXXXXXXXXXLTASLVMLFVXXXXXXXXXXXXXXXXXXXXXXXXXXXXXXXXXXXXXXXXXXXXXXXXXXXXXXXXXXXXXXXXXXXXXXXXXXXXXLTLSTGPTLTLWEGNPXXXXXXXXXXXXXXXXXXXXXXXXXXXFSLIKNTQTPRRGTGXXXXXXXXXXXXXXXXXXXXXXXXXXXXXXXXXXXXXXXSALKDGSKIKYAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLQRKYGGNLIRCPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPQPKPGTQMIMTTTANXXXXLLGKKKSPRLCTKEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRERVEKWLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYADYMPVMKRYSAHFESEGVL

SEQ ID NO: 265766 - protein, 3388 aa, Dengue virus
  MOD_RES (1)..(73): Any amino acid
  MOD_RES (84)..(92): Any amino acid
  MOD_RES (108)..(109): Any amino acid
  MOD_RES (121)..(261): Any amino acid
  MOD_RES (271)..(434): Any amino acid
  MOD_RES (457)..(473): Any amino acid
  MOD_RES (483)..(498): Any amino acid
  MOD_RES (510)..(619): Any amino acid
  MOD_RES (631)..(637): Any amino acid
  MOD_RES (649)..(655): Any amino acid
  MOD_RES (668)..(734): Any amino acid
  MOD_RES (744)..(768): Any amino acid
  MOD_RES (780)..(781): Any amino acid
  MOD_RES (793)..(864): Any amino acid
  MOD_RES (889)..(900): Any amino acid
  MOD_RES (910)..(1019): Any amino acid
  MOD_RES (1029)..(1056): Any amino acid
  MOD_RES (1072)..(1117): Any amino acid
  MOD_RES (1139)..(1156): Any amino acid
  MOD_RES (1174)..(1193): Any amino acid
  MOD_RES (1204)..(1262): Any amino acid
  MOD_RES (1274)..(2256): Any amino acid
  MOD_RES (2270)..(2532): Any amino acid
  MOD_RES (2543)..(2685): Any amino acid
  MOD_RES (2697)..(2852): Any amino acid
  MOD_RES (2865)..(2875): Any amino acid
  MOD_RES (2887)..(3372): Any amino acid
XXXXXXXXXXXXXXXXXXXXXXXXXXXXXXXXXXXXXXXXXXXXXXXXXXXXXXXXXXXXXXXXXXXXXXXXXKTKAIKILTGXXXXXXXXXNILNRRRRTAGMIIMXXPTVMAFHLTTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGIQRAVFFVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGKHGKTATITPRSPSAEVKLPXXXXXXXXXXXXXXXXXNEMILMKMEXXXXXXXXXXXXXXXXPWTAGADTLEVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRDVNKERVVGRXXXXXXXAEYTNSVTNIEXXXXXXXSYIIIGVGDSALXXXXXXXXXXXXXXXXXXXXXXXXXXXXXXXXXXXXXXXXXXXXXXXXXXXXXXXXXXXXXXXXXXXMKILIGVIIXXXXXXXXXXXXXXXXXXXXXXXXXLGFTVRADMGCXXSWTGKELKCGSXXXXXXXXXXXXXXXXXXXXXXXXXXXXXXXXXXXXXXXXXXXXXXXXXXXXXXXXXXXXXXXXXXXXXXXXTGDVKGVLTKGKRTLAPPASDLKYXXXXXXXXXXXXPEARNNTFLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKAYAGPISQXXXXXXXXXXXXXXXXXXXXXXXXXXXXGTTVTVREDCDHRGPXXXXXXXXXXXXXXXXXXXXXXXXXXXXXXXXXXXXXXXXXXXXXXENMVRSQVTAGQGTSETFFMGXXXXXXXXXXXXXXXXXXKHMILVVVATLCAIILGXXXXXXXXXXXXXXXXXXXXRIGGQVHLAIXXXXXXXXXXXXXXXXXXXXXXXXXXXXXXXXXXXXXXXXXXXXXXXXXXXXXXXXXXXVVHFDNAQLGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFYQEKPETTILDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLRDGSKTKHAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQRKYGGNLIRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQPKLGTRVVMTTXXXXXXXXXXXKKKPRLCTREEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPVMKRYSAPLESEGVL

SEQ ID NO: 265767 - protein, 3388 aa, Dengue virus
  MOD_RES (1)..(1): Any amino acid
  MOD_RES (631)..(637): Any amino acid
  MOD_RES (780)..(781): Any amino acid
  MOD_RES (1129)..(1129): Any amino acid
  MOD_RES (1285)..(1285): Any amino acid
XMNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRXXXXXXXAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADMGCXXSWSGRELKCGSGIFVVDNVHTWTEQYKFQPESPARLASAILNAHKDGVCGIRSTTRLENVMWKQITNELNYVLWEGGHDLTVVAGDVKGVLTKGKRALTPPVSDLKYSWKTWGKAKIFTPEARNSTFLIDGPDTSECPNERRAWNSLEVEDYGFGMFTTNIWMKFREGSSEVCDHRLMSAAIKDQKAVHADMGYWIESSKNQTWQIEKASLIEVKTCLWPKTHTLWSNGVLESQMLIPKSYAGPFSQHNYRQGYATQTVGPWHLGKLEIDFGECPGTTVTIQEDCDHRGPSLRTTTASGKLVTQWCCRSCTMPPLRFLGEDGCWYGMEIRPLSEKEENMVKSQVTAGXGTSETFSMGLLCLTLFVEECLRRRVTRKHMILAVVITLCAIILGGLTWMDLLRALIMLGDTMSGRIGGQTHLAIMAVFKMSPGYVLGVFLRKLTSRETALMVIGMAMTTTLSIPHDLMELIDGISLGLILLKIVTQFDNTQVGTLALSLTFIRSTXSLVMAWRTIMAVLFVVTLIPLCRTSCLQKQSHWVEITALILGAQALPVYLMTLMKGASRRSWPLNEGIMAVGLVSLLGSALLKNDVPLAGPMVAGGLLLAAYVMSGSSADLSLEKAANVQWDEMADITGSSPIIEVKQDEDGSFSIRDVEETNMITLLVKLALITVSGLYPLAIPVTMTLWYMWQVKTQRSGALWDVPSPAATQKAALSEGVYRIMQRGLFGKTQVGVGIHMEGVFHTMWHVTRGSVICHETGRLEPSWADVRNDMISYGGGWRLGDKWDKEEDVQVLAIEPGKNPKHVQTKPGLFKTLTGEIGAVTLDFKPGTSGSPIINRKGKVIGLYGNGVVTKSGDYVSAITQAERIGEPDYEVDEDIFRKKRLTIMDLHPGAGKTKRILPSIVREALKRRLRTLILAPTRVVAAEMEEALRGLPIRYQTPAVKSEHTGREIVDLMCHATFTTRLLSSTRVPNYNLIVMDEAHFTDPSSVAARGYISTRVEMGEAAAIFMTATPPGATDPFPQSNSPIEDIEREIPERSWNTGFDWITDYQGKTVWFVPSIKAGNDIANCLRKSGKKVIQLSRKTFDTEYPKTKLTDWDFVVTTDISEMGANFRAGRVIDPRRCLKPVILTDGPERVILAGPIPVTPASAAQRRGRIGRNPAQEDDQYVFSGDPLKNDEDHAHWTEAKMLLDNIYTPEGIIPTLFGPEREKTQAIDGEFRLRGEQRKTFVELMRRGDLPVWLSYKVASAGISYKDREWCFTGERNNQILEENMEVEIWTREGEKKKLRPRWLDARVYADPMALKDFKEFASGRKSITLDILTEIASLPTYLSSRAKLALDNIVMLHTTERGGRAYQHALNELPESLETLMLVALLGAMTAGIFLFFMQGKGIGKLSMGLITIAVASGLLWVAEIQPQWIAASIILEFFLMVLLIPEPEKQRTPQDNQLIYVILTILTIIGLIAANEMGLIEKTKTDFGFYQVKTETTILDVDLRPASAWTLYAVATTILTPMLRHTIENTSANLSLAAIANQAAVLMGLGKGWPLHRMDLGVPLLAMGCYSQVNPTTLTASLVMLLVHYAIIGPGLQAKATREAQKRTAAGIMKNPTVDGITVIDLEPISYDPKFEKQLGQVMLLVLCAGQLLLMRTTWAFCEVLTLATGPILTLWEGNPGRFWNTTIAVSTANIFRGSYLAGAGLAFSLIKNAQTPRRGTGTTGETLGEKWKRQLNSLDRKEFEEYKRSGILEVDRTEAKSALKDGSKIKHAVSRGSSKIRWIVERGMVKPKGKVVDLGCGRGGWSYYMATLKNVTEVKGYTKGGPGHEEPIPMATYGWNLVKLHSGVDVFYKPTEQVDTLLCDIGESSSNPTIEEGRTLRVLKMVEPWLSSKPEFCIKVLNPYMPTVIEELEKLQRKHGGNLVRCPLSRNSTHEMYWVSGASGNIVSSVNTTSKMLLNRFTTRHRKPTYEKDVDLGAGTRSVSTETEKPDMTIIGRRLQRLQEEHKETWHYDQENPYRTWAYHGSYEAPSTGSASSMVNGVVKLLTKPWDVIPMVTQLAMTDTTPFGQQRVFKEKVDTRTPQPKPGTRMVMTTTANWLWALLGKKKNPRLCTREEFISKVRSNAAIGAVFQEEQGWTSASEAVNDSRFWELVDKERALHQEGKCESCVYNMMGKREKKLGEFGRAKGSRAIWYMWLGARFLEFEALGFLNEDHWFGRENSWSGVEGEGLHRLGYILEEIDKKDGDLMYADDTAGWDTRITEDDLQNEELITEQMAPHHKILAKAIFKLTYQNKVVKVLRPTPRGAVMDIISRKDQRGSGQVGTYGLNTFTNMEVQLIRQMEAEGVITQDDMQNPKGLKERVEKWLRECGVDRLKRMAISGDDCVVKPLDERFGTSLLFLNDMGKVRKDIPQWEPSKGWKNWQEVPFCSHHFHKIFMKDGRSLVVPCRNQDELIGRARISQGAGWSLRETACLGKAYAQMWSLMYFHRRDLRLASMAICSAVPTEWFPTSRTTWSIHAHHQWMTTEDMLKVWNRVWIEDNPNMIDKTPVHSWEDIPYLGKREDLWCGSLIGLSSRATWAKNIHTAITQVRNLIGKEEYVDYMPVMKRYSAPSESEGVL

SEQ ID NO: 265768 - protein, 3388 aa, Dengue virus
  MOD_RES (1)..(1): Any amino acid
  MOD_RES (631)..(637): Any amino acid
  MOD_RES (780)..(781): Any amino acid
  MOD_RES (851)..(855): Any amino acid
  MOD_RES (956)..(979): Any amino acid
  MOD_RES (999)..(1010): Any amino acid
  MOD_RES (1081)..(1104): Any amino acid
  MOD_RES (1129)..(1129): Any amino acid
  MOD_RES (1285)..(1285): Any amino acid
  MOD_RES (1354)..(1390): Any amino acid
  MOD_RES (1444)..(1451): Any amino acid
  MOD_RES (1527)..(1527): Any amino acid
  MOD_RES (1547)..(1556): Any amino acid
  MOD_RES (1604)..(1605): Any amino acid
  MOD_RES (1627)..(1636): Any amino acid
  MOD_RES (1656)..(1714): Any amino acid
  MOD_RES (1753)..(1757): Any amino acid
  MOD_RES (1777)..(1786): Any amino acid
  MOD_RES (1807)..(1846): Any amino acid
  MOD_RES (1866)..(1899): Any amino acid
  MOD_RES (1920)..(1930): Any amino acid
  MOD_RES (1965)..(1981): Any amino acid
  MOD_RES (2001)..(2003): Any amino acid
  MOD_RES (2023)..(2023): Any amino acid
  MOD_RES (2043)..(2059): Any amino acid
  MOD_RES (2079)..(2095): Any amino acid
  MOD_RES (2203)..(2203): Any amino acid
  MOD_RES (2223)..(2223): Any amino acid
  MOD_RES (2273)..(2277): Any amino acid
  MOD_RES (2294)..(2301): Any amino acid
  MOD_RES (2316)..(2317): Any amino acid
  MOD_RES (2337)..(2338): Any amino acid
  MOD_RES (2365)..(2408): Any amino acid
  MOD_RES (2452)..(2473): Any amino acid
  MOD_RES (2575)..(2579): Any amino acid
  MOD_RES (2601)..(2613): Any amino acid
  MOD_RES (2633)..(2678): Any amino acid
  MOD_RES (2754)..(2754): Any amino acid
  MOD_RES (2794)..(2795): Any amino acid
  MOD_RES (2833)..(2846): Any amino acid
  MOD_RES (2894)..(2905): Any amino acid
  MOD_RES (2938)..(2977): Any amino acid
  MOD_RES (2997)..(2999): Any amino acid
  MOD_RES (3061)..(3064): Any amino acid
  MOD_RES (3084)..(3086): Any amino acid
  MOD_RES (3106)..(3109): Any amino acid
  MOD_RES (3147)..(3154): Any amino acid
  MOD_RES (3174)..(3196): Any amino acid
  MOD_RES (3214)..(3228): Any amino acid
  MOD_RES (3248)..(3267): Any amino acid
  MOD_RES (3287)..(3304): Any amino acid
  MOD_RES (3335)..(3343): Any amino acid
XMNQRKKVANTPFNMLKRERNRVSTPQGLVKRFSSGMLQGRGPLKLFMALVAFLRFLTIPPTAGILKRWGQLKKNKAIKILTGFRKEIGRMLNILNRRKRSTMTLLCLIPTAMAFSLTTRNGEPHMIVSRQEKGKSLLFKTEDGVNMCTLMAMDLGELCEDTVTYKCPLLIQNEPEDIDCWCNLTSAWVMYGTCTQNGEHRREKRSVALVPHVGMGLETRTETWMSSEGAWKHAQRIETWILRHPGFTILAGIMAYTIGTTGIQRTVFFILLTAVAPSMGMRCIGISNRDFVEGVSGGSWVDIVLEHGSCVTTMAKGKPTLDFELIKTEAKQPALLRTYCIEALLTNTTTESRCPTQGEPSLNEEQDQRYICKHSMVDRGWGNGCGLFGKGGVVTCAKFLCKKNMEGKVVQPENLEYTIVITPHSGEEHAVGNDTSNHGVTAMITPRTPIVEAELTDYGELSMECSPRTGIDFNEMILMEMENKAWLVHRQWFLDLPLPWTTGADTSEVHWNHKETLVTFKNPHAKKQDVVVLGSQEGAMHSALTGATEIQMSSGNLLFTGHLKCRLRMDKLQLKGMSYSMCTGKFKIDKEIAETQHGTTVVKVKYEGTGSPCKIPIEIRDVNKKKVVGRXXXXXXXAENTNSAVNIEAEPPFGDSYIVIGVGDGQLKLNWFKKGSSIGQMFETTMRGAKRMAILGDTAWDFGSVGGLLTSLGKAVHQVFGAIYGTMFGGVSWMVRILIGLIITWIGTNSRNTSMAMSCIAVGGITLFLGFTVHADMGCXXSWSGKELKCGSGIFVIDNVHTWTEQYKFQPESPARVASAILIAHKDGVCGIRSTTRLENIMWKQITNELXXXXXEGGHDLTVVAGDVKGVLSKGKRALTPPANDLKYSWKTWGKAKIFTPETKNSTFLVDGPDTSECPNERRAWNSFEVEDYGFGMFTTSIWMKFREGSSELCDXXXXXXXXXXXXXXXXXXXXXXXXSKNQTWQIERASLIEVKTCXXXXXXXXXXXXVLESQMLIPRAYAGPFSHHNYRQGYATQTAGPWHLGKLEMDFGECPGTTVTIQENCGHRGSSLRTTTASGXXXXXXXXXXXXXXXXXXXXXXXXWYGMEIRPLNEREENMVKSQVAAGXSSPETFSMGLLCLTLFMEECLRRRVTRKHMILVVVITFCAIILGGLTWMDLLRAIIMLGDTMSGRIGGQIHLAIMIVFKMSPGYVLGIFLRRLTSRETALMVIGMAMTTVFSIPHDLMEFIDGISLGLILLKIVTHFDDAQVGTLALSLTFIKSTXPLIMAWRTIMAVFFAVTLIPLCRTSCLQKQSHWVEITAITLGAQALPVYLMTLMKGASKRSWPLNEGIXXXXXXXXXXXXXXXXXXXXXXXXXXXXXXXXXXXXXGSSADLSLEKAASVQWDEMADITGSSPIVEVKQDEDGSFSIRDIEETNMITLLXXXXXXXXSGLYPLAIPITMALWYIWQVRTQRSGALWDVPSPAATKKATLTEGVYRIMQRGLLGKTQVGVGIHIEGVFHTMWHXTRGSVICHESGRLEPSWADXXXXXXXXXXGWRLGDKWDREEDVQVLAVEPGKNPKHVQTKPGLFKTITGEIGAVTLXXKPGTSGSPIINKKGKVIGLYGXXXXXXXXXXVSAITQAERTGEPDYEVDEXXXXXXXXXXXXXXXXXXXXXXXXXXXXXXXXXXXXXXXXXXXXXXXXXXXXXXXXXXXIRYQTPAVKAEHTGREIVDLMCHATFTTKLLSSTRVPNXXXXXMDEAHFTDPCSVAARGYISXXXXXXXXXXIFMTATPPGSIDPFPQSNSPXXXXXXXXXXXXXXXXXXXXXXXXXXXXXXXXXXXXXXXXANCLRKSGKRVIQLSRKTFXXXXXXXXXXXXXXXXXXXXXXXXXXXXXXXXXXPRRCLKPVILPDGPERVILAXXXXXXXXXXXQRRGRIGRNLTQEDDQYVFSGDPLRNDEDHAHWTXXXXXXXXXXXXXXXXXTLFGPEREKNQAIDGEFRLXXXQRKTFVELMKRGDLPVWLSXKVASAGISYEDREWCFTGEXXXXXXXXXXXXXXXXXEGEKKKLRPKWLDARVYADXXXXXXXXXXXXXXXXXTLDILTEIATLPTYLSSKAKLALDNIVMLHTTEKGGKAYQHALNELPESLETLMLIALLGAMTAGTFLFFMQGKGIGKLSMGLIAIAMASGLLWIAELQPQWIAASIXLEFFLMVLLVPEPEKQRTPXDNQLIYVILAILTIIGLVAANEMGLIEKTKTDFGFYQAKPETTILDVDLXXXXXWTLYAVVTTILTPMLRXXXXXXXXNLSLAAIANHAAVLXXLGKGWPLHRVDLGVPLLAMXXYSQVNPTTLTASLVMLSVHYAIIGPGXXXXXXXXXXXXXXXXXXXXXXXXXXXXXXXXXXXXXXXXXXXXGQVMLLVLCVGQLLLMRTTWALCEVLTLATGPIMTLWEGNPGRXXXXXXXXXXXXXXXXXXXXXXGLAFSLIKNVQTPRRGTGITGETLGEKWKRQLNSLDRREFEEYKRSGIIEVDRTEAKSALRDGSKTKYAVSRGTSKIRWIVERGMIKPKGKIVDLGCGRGGXXXXXATLKNVTEVRGFTKGGPGHEEXXXXXXXXXXXXXLHSGVDVFYRPTEQVDTLLXXXXXXXXXXXXXXXXXXXXXXXXXXXXXXXXXXXXXXXXXXXXXXIEELEKLQRRHGGSLIRCPLSRNSTHEMYWVSGVSGNIVSSVNTISKMLLNRFTTRHRKPTYEKDADLGAGTRSVXTEPEKPDMTIIGRRLQRLREEHKETWHYDHENPYRTWAYXXSYEAPSTGSASSMINGVVKLLTKPWDVVPMVTQLAMTXXXXXXXXXXXXXXVDTRTPQPKPGTRMIMTTTANWLWALLGKKKSPRLCTKEEFISKVRSXXXXXXXXXXXXGWTSASEAVSDSRFWKLVDKERTLHQEGKCESXXXXXXXXXXXXXXXXXXXXXXXXXXXXXXXXXXXXXXXXGFLNEDHWFSRENSWSGVEXXXLHRLGYILEDIDKKDGDLIYADDTAGWDTRITEDDLLNEELITEQMAPHHKTLAKAIFKLTXXXXVVKVLRPTPKGAVMDIISRXXXRGSGQVGTYSLNTFTNMEVXXXXQMEAEGVITQDDMHNPKGLKERVEKWLKECGVDRLKRXXXXXXXXVVKPLDERFSTSLLFLNDMXXXXXXXXXXXXXXXXXXXXXXXFCSHHFHRIFMKDGRSLXXXXXXXXXXXXXXXISQGAGWSLKETACLGKAYXXXXXXXXXXXXXXXXXXXXICSAVPTEWLPTSRTTWSIXXXXXXXXXXXXXXXXXXVWIEDNPNMTDKTPIHSWEDVPYLGKREDLXXXXXXXXXSRATWAKNIQTAIAQVRNLIGKEEYVDYMPAMKRYSAPFESEGVL

SEQ ID NO: 265769 - protein, 3388 aa, Dengue virus
  MOD_RES (1)..(1): Any amino acid
  MOD_RES (19)..(25): Any amino acid
  MOD_RES (45)..(65): Any amino acid
  MOD_RES (155)..(156): Any amino acid
  MOD_RES (207)..(248): Any amino acid
  MOD_RES (309)..(316): Any amino acid
  MOD_RES (354)..(365): Any amino acid
  MOD_RES (385)..(390): Any amino acid
  MOD_RES (410)..(425): Any amino acid
  MOD_RES (523)..(535): Any amino acid
  MOD_RES (555)..(561): Any amino acid
  MOD_RES (631)..(637): Any amino acid
  MOD_RES (692)..(699): Any amino acid
  MOD_RES (764)..(767): Any amino acid
  MOD_RES (780)..(781): Any amino acid
  MOD_RES (836)..(858): Any amino acid
  MOD_RES (893)..(893): Any amino acid
  MOD_RES (914)..(918): Any amino acid
  MOD_RES (937)..(1011): Any amino acid
  MOD_RES (1050)..(1052): Any amino acid
  MOD_RES (1075)..(1106): Any amino acid
  MOD_RES (1129)..(1129): Any amino acid
  MOD_RES (1175)..(1183): Any amino acid
  MOD_RES (1209)..(1211): Any amino acid
  MOD_RES (1227)..(1230): Any amino acid
  MOD_RES (1285)..(1285): Any amino acid
  MOD_RES (1308)..(1315): Any amino acid
  MOD_RES (1334)..(1393): Any amino acid
  MOD_RES (1428)..(1454): Any amino acid
  MOD_RES (1478)..(1478): Any amino acid
  MOD_RES (1502)..(1505): Any amino acid
  MOD_RES (1527)..(1565): Any amino acid
  MOD_RES (1576)..(1607): Any amino acid
  MOD_RES (1619)..(1786): Any amino acid
  MOD_RES (1806)..(1900): Any amino acid
  MOD_RES (1919)..(1931): Any amino acid
  MOD_RES (1950)..(2098): Any amino acid
  MOD_RES (2118)..(2122): Any amino acid
  MOD_RES (2139)..(2166): Any amino acid
  MOD_RES (2200)..(2226): Any amino acid
  MOD_RES (2249)..(2251): Any amino acid
  MOD_RES (2273)..(2345): Any amino acid
  MOD_RES (2362)..(2412): Any amino acid
  MOD_RES (2451)..(2473): Any amino acid
  MOD_RES (2495)..(2529): Any amino acid
  MOD_RES (2549)..(2556): Any amino acid
  MOD_RES (2569)..(2679): Any amino acid
  MOD_RES (2702)..(2720): Any amino acid
  MOD_RES (2740)..(2799): Any amino acid
  MOD_RES (2810)..(2813): Any amino acid
  MOD_RES (2832)..(2849): Any amino acid
  MOD_RES (2888)..(3002): Any amino acid
  MOD_RES (3022)..(3040): Any amino acid
  MOD_RES (3060)..(3113): Any amino acid
  MOD_RES (3144)..(3154): Any amino acid
  MOD_RES (3174)..(3309): Any amino acid
  MOD_RES (3329)..(3347): Any amino acid
  MOD_RES (3363)..(3364): Any amino acid
XNNQRKKARNTPFNMLKRXXXXXXXVQQLVKRFSLGMLQGRGPLXXXXXXXXXXXXXXXXXXXXXLKRWGQIKKNKAIRVLRGFRKEIGRMLNILNGRRRSTVTLLCLIPTVMAFHLTTRDGEPLMIVGKHERGRPLLFKTTEGINRCTLIAMDXXEMCEDTVTYECPLLRQNEPEDIDCWCNSTSTWVTYGTCTTTGEHRREKRSXXXXXXXXXXXXXXXXXXXXXXXXXXXXXXXXXXXXXXXXXXLMAAFLAYMVGQTHFQRALIFILLTAVAPSYTMRCIGISNRDFVEGVSGGVWVDLVLEHGXXXXXXXXNKPTLDFELIKTEAKQPATLRKYCIEAKLTNTTTESRXXXXXXXXXXXXQDKQFVCRRDMVDRGWGNGXXXXXXGGIVTCAMFTCKKNMEGKVXXXXXXXXXXXXXXXXGDTHAVGNDTSNHGVTTKITPRSSSTEVELPGYGTVTMECSPRTGIDFNEMILMKMKTKTWLVHKQWFLDLPLPWAPGADTQGSNWIQKETLVTFKNXXXXXXXXXXXXXQEGAMHTALTGATEIQMSSXXXXXXXHLKCKIRMERLRIKGMSYTMCSGKFSVVREMAETQHGTIVIRVQYEGDGAPCKIPFEIRDVNKEKVIGRXXXXXXXAESKDSPVNIEAEPPFGDSYIMIGVEPGQLKLNWFRKGSSIGKMLESTYRGAKRXXXXXXXXWDFGSLGGVFTSIGKALHQIFGSVYTAAFSGVSWTIKILIGVIITWIGMNSRNTPMAMTCIAVGXXXXFLGFTVHADTGCXXSWNGKELKCGSGIFVTDNVHTWTEQHQFQPESPARLASAILNAHKDGVCGVRSTXXXXXXXXXXXXXXXXXXXXXXXHDLTVVAGDAKGVLVKGKRALTPPVNDLKYSWKTXGKARIFTPEARNSTFLVDGPXXXXXPNERRAWNFLEVEDYGFGXXXXXXXXXXXXXXXXXXXXXXXXXXXXXXXXXXXXXXXXXXXXXXXXXXXXXXXXXXXXXXXXXXXXXXXXXXXLESQMLIPKSYAGPISQHNYRQGYATQTMGPWHLGKLEXXXGECPGTTVAIQDDCGHRGSSLRXXXXXXXXXXXXXXXXXXXXXXXXXXXXXXXXGMEIRPLSEKEENMVKSQVSAGXGPSETFSMGLLCLTLFIEECLRRKVTRKHMILVVVTTLCAIILGGXXXXXXXXXIIMLGDTMLSRMGGQVHLAIMAVFKXXXGYVLGVFLRRLTSREXXXXVIGMAMTTVLSIPHDLMEFIDGISLGLILLKMVTHFDNTQVGTLALSLTFIKTTXPLTMAWRTIMAVLFAVTLIPLCXXXXXXXXSHWVEITALTLGAQALPVXXXXXXXXXXXXXXXXXXXXXXXXXXXXXXXXXXXXXXXXXXXXXXXXXXXXXXXXXXXXADLSLERAANVQWDEMAAITGSSPIIEVKQDDDGXXXXXXXXXXXXXXXXXXXXXXXXXXXYPLAIPVTMTLWYMWQVRTQRSGXLWDVPSPAATQKATLTEGVYRIMXXXXLGKTQVGVGVHTEGVFHTMWHXXXXXXXXXXXXXXXXXXXXXXXXXXXXXXXXXXXXXXXKEEDVQVLAVXXXXXXXXXXXXXXXXXXXXXXXXXXXXXXXXGSSGSPIINRKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFMTATPPGTTDPFPQSNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRRCLKPVISTDGPERVILXXXXXXXXXXXXXRRGRIGRNPTQEDDQYVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILTEIATLPAYLSSKAKLAXXXXXMLHTTERGGKAYQHALXXXXXXXXXXXXXXXXXXXXXXXXXXXXQGKGIGKLSMGLITIAVASGLFWVAELQPQWIAXXXXXXXXXXXXXXXXXXXXXXXXXXXLIYVILTILTIIALVAANEMGLXXXTKADFGFYQEKTEITILDVDLXXXXXXXXXXXXXXXXXXXXXXXXXXXXXXXXXXXXXXXXXXXXXXXXXXXXXXXXXXXXXXXXXXXXXXXXXTLIASLVMLFVHYAIIXXXXXXXXXXXXXXXXXXXXXXXXXXXXXXXXXXXXXXXXXXXXXXXXXXXLLVLCAGQLFLMRTTWAFCEVLTLATGPVLTLWEGNPGXXXXXXXXXXXXXXXXXXXXXXXGLAFSLIKNTQTPRRGTGITGXXXXXXXXXXXXXXXXXXXXXXXXXXXXXXXXXXXKSALKDGSKIKYAVSRGTSXXXXXXXXGMVKPKGKVIDLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEELEKLQRKHGGSLIRCPLSRNXXXXXXXXXXXXXXXXXXXNTVSKMLLNRFTTKHRKPTXXXXXXXXXXXXXXXXXXXXXXXXXXXXXXXXXXXXXXXXXXXXXXXXXXXXXXXXXXXXSSTGSASSMVXXXXKLLTKPWDMIPMVTQLAMXXXXXXXXXXXXXXXXXXRTPQPKPGTRVVMTTTANWLWTLLGRKKSPRLCTKEEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGYILEDIDRKDGDLMYADXXXXXXXXXXXXXXXXXXXITEQMAPHHRILAKAIFKLXXXXXXXXXXXXXXXXXXXXXXXXXXXXXXXXXXXXXXXXXXXXXXXXXXXXXXEGVITRDDMQNPKGLKERVENWLRECGVDRXXXXXXXXXXXVVKPLDERFATSLLFLNDMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPNMTDKTPVHSWEDVPYLXXXXXXXXXXXXXXXXXXXWAKNIHTAIAQVRNLXXKEEYVDYMPVMRRYSALSESEGVL

SEQ ID NO: 265770 - protein, 3388 aa, Dengue virus
  MOD_RES (1)..(5): Any amino acid
  MOD_RES (17)..(25): Any amino acid
  MOD_RES (45)..(69): Any amino acid
  MOD_RES (89)..(89): Any amino acid
  MOD_RES (122)..(161): Any amino acid
  MOD_RES (176)..(256): Any amino acid
  MOD_RES (276)..(366): Any amino acid
  MOD_RES (378)..(432): Any amino acid
  MOD_RES (461)..(470): Any amino acid
  MOD_RES (492)..(492): Any amino acid
  MOD_RES (517)..(599): Any amino acid
  MOD_RES (631)..(637): Any amino acid
  MOD_RES (650)..(653): Any amino acid
  MOD_RES (669)..(734): Any amino acid
  MOD_RES (745)..(767): Any amino acid
  MOD_RES (780)..(781): Any amino acid
  MOD_RES (807)..(822): Any amino acid
  MOD_RES (833)..(859): Any amino acid
  MOD_RES (890)..(893): Any amino acid
  MOD_RES (904)..(918): Any amino acid
  MOD_RES (937)..(1016): Any amino acid
  MOD_RES (1049)..(1054): Any amino acid
  MOD_RES (1074)..(1112): Any amino acid
  MOD_RES (1129)..(1129): Any amino acid
  MOD_RES (1141)..(1155): Any amino acid
  MOD_RES (1175)..(1185): Any amino acid
  MOD_RES (1209)..(1230): Any amino acid
  MOD_RES (1249)..(1252): Any amino acid
  MOD_RES (1285)..(1285): Any amino acid
  MOD_RES (1296)..(1458): Any amino acid
  MOD_RES (1474)..(1479): Any amino acid
  MOD_RES (1499)..(1507): Any amino acid
  MOD_RES (1518)..(1787): Any amino acid
  MOD_RES (1806)..(2103): Any amino acid
  MOD_RES (2115)..(2170): Any amino acid
  MOD_RES (2198)..(2229): Any amino acid
  MOD_RES (2246)..(2251): Any amino acid
  MOD_RES (2271)..(2345): Any amino acid
  MOD_RES (2358)..(2432): Any amino acid
  MOD_RES (2451)..(2475): Any amino acid
  MOD_RES (2493)..(2529): Any amino acid
  MOD_RES (2544)..(2682): Any amino acid
  MOD_RES (2699)..(2850): Any amino acid
  MOD_RES (2869)..(2871): Any amino acid
  MOD_RES (2888)..(3008): Any amino acid
  MOD_RES (3019)..(3127): Any amino acid
  MOD_RES (3139)..(3366): Any amino acid
XXXXXNRVVRPPFNMLXXXXXXXXXPQGLTKRFSIGLFSGKGPLXXXXXXXXXXXXXXXXXXXXXXXXXGTLKKSKAINVLRGFRKEIXRMLNILNRRRRTAGMIICLIPTIMAFHLSTRDXXXXXXXXXXXXXXXXXXXXXXXXXXXXXXXXXXXXXXXXTITYKCPLLRQNEPXXXXXXXXXXXXXXXXXXXXXXXXXXXXXXXXXXXXXXXXXXXXXXXXXXXXXXXXXXXXXXXXXXXXXXXXXXXXXXXXXMIGQTGIQRTIFFVLMMLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDQQYICRRNVVXXXXXXXXXXXXXXXXXXXXXXXXXXXXXXXXXXXXXXXXXXXXXXXXXXXXXXXNDIGKHGKTATITPQSPSVEVQLPDYGEXXXXXXXXXXLDFNEMILMRMENKAWLVHRQXFLDLPLPWLAGADTLEVHWNHKERXXXXXXXXXXXXXXXXXXXXXXXXXXXXXXXXXXXXXXXXXXXXXXXXXXXXXXXXXXXXXXXXXXXXXXXXXXXXXXXXXXXTVIKVKYEGAGAPCKIPIEIMDLEKRHVLGRXXXXXXXVTYTNSVTNIELXXXXGDSYIIIGVEPGQLKXXXXXXXXXXXXXXXXXXXXXXXXXXXXXXXXXXXXXXXXXXXXXXXXXXXXXXXXXXXXXXXXXXVRILIGLLVLXXXXXXXXXXXXXXXXXXXXXXXFLGFTVQADTGCXXSWNGRELKCGSGIFVADNVHTWTEQXXXXXXXXXXXXXXXXNAHKDGVCGVXXXXXXXXXXXXXXXXXXXXXXXXXXXDLTIVAGDVRGVLTKGKRALAPPVNDLKYSXXXXGKAKIFTPEVXXXXXXXXXXXXXXXPNERRAWNFFEVEDYGFGXXXXXXXXXXXXXXXXXXXXXXXXXXXXXXXXXXXXXXXXXXXXXXXXXXXXXXXXXXXXXXXXXXXXXXXXXXXXXXXXLIPKAYAGPISQHNYRQGYATQIAGPWHLGKLXXXXXXCPGTTVTIQEDCGHRGSSLXXXXXXXXXXXXXXXXXXXXXXXXXXXXXXXXXXXXXXXLNEKEENMVKSQATAGXGTPETFSMGLLXXXXXXXXXXXXXXXRKHMILVVATTFCAIILGGXXXXXXXXXXXMLGDTMFGRVGGQTHLAIMIVFKXXXXXXXXXXXXXXXXXXXXXXVIGMAMTTTFSIPHDLMEXXXXIALGLILLKTVVHFDNAQLGTLALALTFIKSTXPLTMAWRTIMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIPVTMALWYMWQVKTXXXXXXWDVPSPATAQKATLTEGVYXXXXXXXXXKTQVGVGIHTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFMTATPPGSTDPFPQSNSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXASLPAYLSSRAXXXXXXXXXXXXXXXXXXXXXXXXXXXXXXXXXXXXXXXXXXXXXXXXXXXXXXXXMGKLSVGLITIAVASGLLWVAELQPQWXXXXXXXXXXXXXXXXXXXXXXXXXXXXXXXXVILAILAIIGLIAANEXXXXXXTKTDFGFYQEKPETTILDVXXXXXXXXXXXXXXXXXXXXXXXXXXXXXXXXXXXXXXXXXXXXXXXXXXXXXXXXXXXXXXXXXXXXXXXXXXXTLTASLVMLFVHXXXXXXXXXXXXXXXXXXXXXXXXXXXXXXXXXXXXXXXXXXXXXXXXXXXXXXXXXXXXXXXXXXXXXXXXXXXVLTLSTGPALTLWEGGPGXXXXXXXXXXXXXXXXXXXXXXXXXAFSLIKNAQAPRRGTGTXXXXXXXXXXXXXXXXXXXXXXXXXXXXXXXXXXXXXKSALKDGSKIKYAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEKLQRKYGGNLIRCPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPQPKPGTQMIMTTTANWXXXLLGKKKTPRLCTREEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDIDKKDGDLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKEKVEKWLKEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYADYMPVMKRYSAHFESEGVL

SEQ ID NO: 265771 - protein, 3388 aa, Dengue virus
  MOD_RES (1)..(72): Any amino acid
  MOD_RES (85)..(91): Any amino acid
  MOD_RES (122)..(257): Any amino acid
  MOD_RES (272)..(433): Any amino acid
  MOD_RES (458)..(472): Any amino acid
  MOD_RES (483)..(497): Any amino acid
  MOD_RES (511)..(618): Any amino acid
  MOD_RES (631)..(637): Any amino acid
  MOD_RES (650)..(654): Any amino acid
  MOD_RES (669)..(734): Any amino acid
  MOD_RES (745)..(767): Any amino acid
  MOD_RES (780)..(781): Any amino acid
  MOD_RES (794)..(863): Any amino acid
  MOD_RES (890)..(1018): Any amino acid
  MOD_RES (1030)..(1055): Any amino acid
  MOD_RES (1073)..(1116): Any amino acid
  MOD_RES (1129)..(1129): Any amino acid
  MOD_RES (1140)..(1155): Any amino acid
  MOD_RES (1175)..(1193): Any amino acid
  MOD_RES (1205)..(1262): Any amino acid
  MOD_RES (1275)..(2253): Any amino acid
  MOD_RES (2271)..(2531): Any amino acid
  MOD_RES (2544)..(2684): Any amino acid
  MOD_RES (2698)..(2851): Any amino acid
  MOD_RES (2866)..(2875): Any amino acid
  MOD_RES (2888)..(3371): Any amino acid
XXXXXXXXXXXXXXXXXXXXXXXXXXXXXXXXXXXXXXXXXXXXXXXXXXXXXXXXXXXXXXXXXXXXXXXXKKTKAIKILTGFXXXXXXXLNILNRRKRSTVTLLMLIPTVMAFHLTTRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGQTGIQRAVFFVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTPNHGVEIKITPRSPSAEVKLPDXXXXXXXXXXXXXXXFNEMVLLQMEXXXXXXXXXXXXXXXLPWTAGADTLEVHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIKDVNKERVVGRXXXXXXXAEEKDSPVNIEAXXXXXDSYIIIGVGDSALTXXXXXXXXXXXXXXXXXXXXXXXXXXXXXXXXXXXXXXXXXXXXXXXXXXXXXXXXXXXXXXXXXXMKILIGVIITXXXXXXXXXXXXXXXXXXXXXXXFLGFTVRADMGCXXSWTGKELKCGSGXXXXXXXXXXXXXXXXXXXXXXXXXXXXXXXXXXXXXXXXXXXXXXXXXXXXXXXXXXXXXXXXXXXXXXVTGDVKGVLTKGKRTLAPPASDLKYSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPKAYAGPISQHXXXXXXXXXXXXXXXXXXXXXXXXXXPGTTVTVREDCDHRGPSXXXXXXXXXXXXXXXXXXXXXXXXXXXXXXXXXXXXXXXXXXXXEENMVRSQVTAGXGPSETFSMGLXXXXXXXXXXXXXXXXRKHMILVVVATLCAIILGGXXXXXXXXXXXXXXXXXXXRIGGQVHLAIMXXXXXXXXXXXXXXXXXXXXXXXXXXXXXXXXXXXXXXXXXXXXXXXXXXXXXXXXXXVTHFDSTQVGTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDFGFYQVKAETTILDVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXALRDGSKTKHAVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQRKYGGNLIRCPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPQPKLGTRVVMTTTXXXXXXXXXXKKNPRLCTKEEFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMPAMKRYSAPSENEGVL

SEQ ID NO: 265772 - protein, 3388 aa, Dengue virus; identical to SEQ ID NO: 265767
  MOD_RES (1)..(1): Any amino acid
  MOD_RES (631)..(637): Any amino acid
  MOD_RES (780)..(781): Any amino acid
  MOD_RES (1129)..(1129): Any amino acid
  MOD_RES (1285)..(1285): Any amino acid

SEQ ID NO: 265773 - protein, 3388 aa, Dengue virus
  MOD_RES (1)..(1): Any amino acid
  MOD_RES (631)..(637): Any amino acid
  MOD_RES (780)..(781): Any amino acid
  MOD_RES (852)..(852): Any amino acid
  MOD_RES (964)..(966): Any amino acid
  MOD_RES (978)..(978): Any amino acid
  MOD_RES (1000)..(1009): Any amino acid
  MOD_RES (1082)..(1103): Any amino acid
  MOD_RES (1129)..(1129): Any amino acid
  MOD_RES (1285)..(1285): Any amino acid
  MOD_RES (1355)..(1389): Any amino acid
  MOD_RES (1445)..(1450): Any amino acid
  MOD_RES (1548)..(1555): Any amino acid
  MOD_RES (1628)..(1635): Any amino acid
  MOD_RES (1657)..(1713): Any amino acid
  MOD_RES (1754)..(1756): Any amino acid
  MOD_RES (1778)..(1785): Any amino acid
  MOD_RES (1808)..(1845): Any amino acid
  MOD_RES (1867)..(1898): Any amino acid
  MOD_RES (1921)..(1929): Any amino acid
  MOD_RES (1966)..(1980): Any amino acid
  MOD_RES (2002)..(2002): Any amino acid
  MOD_RES (2044)..(2058): Any amino acid
  MOD_RES (2080)..(2094): Any amino acid
  MOD_RES (2274)..(2276): Any amino acid
  MOD_RES (2295)..(2300): Any amino acid
  MOD_RES (2366)..(2407): Any amino acid
  MOD_RES (2453)..(2472): Any amino acid
  MOD_RES (2576)..(2578): Any amino acid
  MOD_RES (2602)..(2612): Any amino acid
  MOD_RES (2634)..(2677): Any amino acid
  MOD_RES (2834)..(2845): Any amino acid
  MOD_RES (2895)..(2904): Any amino acid
  MOD_RES (2939)..(2976): Any amino acid
  MOD_RES (2998)..(2998): Any amino acid
  MOD_RES (3062)..(3063): Any amino acid
  MOD_RES (3085)..(3085): Any amino acid
  MOD_RES (3107)..(3108): Any amino acid
  MOD_RES (3148)..(3153): Any amino acid
  MOD_RES (3175)..(3195): Any amino acid
  MOD_RES (3215)..(3227): Any amino acid
  MOD_RES (3249)..(3266): Any amino acid
  MOD_RES (3288)..(3303): Any amino acid
  MOD_RES (3336)..(3342): Any amino acid
XMNQRKKVANTPFNMLKRERNRVSTPQGLVKRFSSGMLQGRGPLKLFMALVAFLRFLTIPPTAGILKRWGQLKKNKAIKILTGFRKEIGRMLNILNRRKRSTMTLLCLIPTAMAFSLTTRNGEPHMIVSRQEKGKSLLFKTEDGVNMCTLMAMDLGELCEDTVTYKCPLLIQNEPEDIDCWCNLTSAWVMYGTCTQNGEHRREKRSVALVPHVGMGLETRTETWMSSEGAWKHAQRIETWILRHPGFTILAGFLAYMIGQTGIQRTVFFILLTLVAPSYGMRCIGISNRDFVEGVSGGSWVDIVLEHGSCVTTMAQGKPTLDFELIKTEAKQPALLRTYCIEALLTNTTTESRCPTQGEPSLNEEQDKRYVCKHSMVDRGWGNGCGLFGKGGVVTCAKFLCKKNMEGKVVQPENLEYTIVITPHNGDEHAVGNDTSNHGVTAMITPRTSSTEVELPGYGEVSMECSPRTGLDFNEMILMEMKNKAWLVHRQWFLDLPLPWTTGADTSEVHWNHKETLVTFKNPHAKKQDVVVLGSQEGAMHSALTGATEIQMSSGNLLFTGHLKCRLRMDKLQLKGMSYTMCTGKFKIVKEIAETQHGTTVVKVKYEGTGAPCKVPIEIRDVNKKKVVGRXXXXXXXAENTNSAVNIEAEPPFGDSYIVIGVGDGQLKLNWFRKGSSIGQMFETTMRGAKRMAILGDTAWDFGSVGGLLTSIGKAVHQVFGAIYTTMFGGVSWMVRILIGLIITWIGTNSRNTSMAMSCIAVGGITLFLGFTVHADMGCXXSWSGKELKCGSGIFVIDNVHTWTEQYQFQPESPARVASAILNAHKEGVCGIRSTTRLENIMWKQITNELNXALWEGGHDLTVVAGDVKGVLSKGKRALTPPANDLKYSWKTWGKAKIFTPETKNSTFLVDGPDTSECPNERRAWNSFEVEDYGFGMFTTSIWMKLREGSSELCDHRLMSAAIXXXKAVHADMGYWLXSSKNQTWQIERASLIEVKTCLXXXXXXXXXXGVLESQMLIPRAYAGPFSHHNYRQGYATQTAGPWHLGKLEMDFGECPGTTVTIQENCGHRGSSLRTTTASGKXXXXXXXXXXXXXXXXXXXXXXCWYGMEIRPLNEREENMVKSQVAAGXSSPETFSMGLLCLTLFMEECLRRRVTRKHMILVVVITFCAIILGGLTWMDLLRAIIMLGDTMSGRIGGQIHLAIMIVFKMSPGYVLGIFLRRLTSRETALMVIGMAMTTVFSIPHDLMEFIDGISLGLILLKIVTHFDDTQLGTLALSLTFIKSTXPLVMAWRTIMAVFFAVTLIPLCRTSCLQKQSHWVEITAITLGAQALPVYLMTLMKGASKRSWPLNEGIMXXXXXXXXXXXXXXXXXXXXXXXXXXXXXXXXXXXSGSSADLSLEKAASVQWDEMADITGSSPIVEVKQDEDGSFSIRDIEETNMITLLVXXXXXXVSGLYPLAIPITMALWYIWQVRTQRSGALWDVPSPAATKKATLTEGVYRIMQRGLLGKTQVGVGIHIEGVFHTMWHVTRGSVICHESGRLEPSWADVXXXXXXXXGGWRLGDKWDREEDVQVLAVEPGKNPKHVQTKPGLFKTITGEIGAVTLDFKPGTSGSPIINKKGKVIGLYGNXXXXXXXXYVSAITQAERTGEPDYEVDEDXXXXXXXXXXXXXXXXXXXXXXXXXXXXXXXXXXXXXXXXXXXXXXXXXXXXXXXXXPIRYQTPAVKSDHTGREIVDLMCHATFTTKLLSSTRVPNYXXXVMDEAHFTDPCSVAARGYISTXXXXXXXXAIFMTATPPGSIDPFPQSNSPIXXXXXXXXXXXXXXXXXXXXXXXXXXXXXXXXXXXXXXIANCLRKSGKRVIQLSRKTFDXXXXXXXXXXXXXXXXXXXXXXXXXXXXXXXXDPRRCLKPVILPDGPERVILAGXXXXXXXXXAQRRGRIGRNLTQEDDQYVFSGDPLRNDEDHAHWTEXXXXXXXXXXXXXXXPTLFGPEREKNQAIDGEFRLRXEQRKTFVELMKRGDLPVWLSYKVASAGISYEDREWCFTGERXXXXXXXXXXXXXXXREGEKKKLRPKWLDARVYADPXXXXXXXXXXXXXXXITLDILTEIATLPTYLSSKAKLALDNIVMLHTTEKGGKAYQHALNELPESLETLMLVALLGAMTAGTFLFFMQGKGIGKLSMGLIAIAMASGLLWIAELQPQWIAASIILEFFLMVLLVPEPEKQRTPQDNQLIYVILAILTIIGLVAANEMGLIEKTKTDFGFYQAKTEITILDVDLRXXXAWTLYAVVTTILTPMLRHXXXXXXANLSLTAIANQAAVLMGLGKGWPLHRVDLGVPLLAMGCYSQVNPTTLTASLVMLSVHYAIIGPGLXXXXXXXXXXXXXXXXXXXXXXXXXXXXXXXXXXXXXXXXXXLGQVMLLVLCVGQLLLMRTTWALCEVLTLATGPIMTLWEGNPGRFXXXXXXXXXXXXXXXXXXXXAGLAFSLIKNVQTPRRGTGITGETLGEKWKRQLNSLDRREFEEYKRSGIIEVDRTEAKSALRDGSKTKYAVSRGTSKIRWIVERGMIKPKGKVIDLGCGRGGWXXXMATLKNVTEVRGFTKGGPGHEEPXXXXXXXXXXXKLHSGVDVFYRPTEQVDTLLCXXXXXXXXXXXXXXXXXXXXXXXXXXXXXXXXXXXXXXXXXXXXVIEELEKLQRRHGGSLIRCPLSRNSTHEMYWVSGVSGNIVSSVNTISKMLLNRFTTRHRKPTYEKDADLGAGTRSVSTEPEKPDMTIIGRRLQRLREEHKETWHYDHENPYRTWAYHGSYEASSTGSTSSMVNGVVKLLTKPWDVVPMVTQLAMTDXXXXXXXXXXXXKVDTRTPQPKPGTRMIMTTTANWLWALLGKKKSPRLCTKEEFISKVRSNXXXXXXXXXXQGWTSASEAVSDSRFWELVDKERALHQEGRCESCXXXXXXXXXXXXXXXXXXXXXXXXXXXXXXXXXXXXXXLGFLNEDHWFSRENSWSGVEGXGLHRLGYILEDIDKKDGDLIYADDTAGWDTRITEDDLLNEELITEQMAPHHKTLAKAIFKLTYXXKVVKVLRPTPKGAVMDIISRKXQRGSGQVGTYSLNTFTNMEVQXXRQMEAEGVITQDDMHNPKGLKERVEKWLKECGVDRLKRMXXXXXXCVVKPLDERFSTSLLFLNDMGXXXXXXXXXXXXXXXXXXXXXPFCSHHFHRIFMKDGRSLVXXXXXXXXXXXXXRISQGAGWSLKETACLGKAYAXXXXXXXXXXXXXXXXXXAICSAVPTEWLPTSRTTWSIHXXXXXXXXXXXXXXXXRVWIEDNPNMTDKTPIHSWEDVPYLGKREDLWXXXXXXXTSRATWAKNIQTAIAQVRNLIGKEEYVDYMPAMKRYSAPFESEGVL

SEQ ID NO: 265774 - protein, 3388 aa, Dengue virus
  MOD_RES (1)..(1): Any amino acid
  MOD_RES (20)..(24): Any amino acid
  MOD_RES (46)..(64): Any amino acid
  MOD_RES (208)..(247): Any amino acid
  MOD_RES (310)..(315): Any amino acid
  MOD_RES (355)..(364): Any amino acid
  MOD_RES (386)..(389): Any amino acid
  MOD_RES (411)..(424): Any amino acid
  MOD_RES (524)..(534): Any amino acid
  MOD_RES (556)..(560): Any amino acid
  MOD_RES (631)..(637): Any amino acid
  MOD_RES (693)..(698): Any amino acid
  MOD_RES (765)..(766): Any amino acid
  MOD_RES (780)..(781): Any amino acid
  MOD_RES (837)..(857): Any amino acid
  MOD_RES (915)..(917): Any amino acid
  MOD_RES (938)..(1010): Any amino acid
  MOD_RES (1051)..(1051): Any amino acid
  MOD_RES (1076)..(1105): Any amino acid
  MOD_RES (1129)..(1129): Any amino acid
  MOD_RES (1176)..(1182): Any amino acid
  MOD_RES (1210)..(1210): Any amino acid
  MOD_RES (1228)..(1229): Any amino acid
  MOD_RES (1285)..(1285): Any amino acid
  MOD_RES (1309)..(1313): Any amino acid
  MOD_RES (1335)..(1392): Any amino acid
  MOD_RES (1429)..(1453): Any amino acid
  MOD_RES (1503)..(1504): Any amino acid
  MOD_RES (1528)..(1564): Any amino acid
  MOD_RES (1577)..(1606): Any amino acid
  MOD_RES (1620)..(1714): Any amino acid
  MOD_RES (1726)..(1785): Any amino acid
  MOD_RES (1807)..(1899): Any amino acid
  MOD_RES (1920)..(1930): Any amino acid
  MOD_RES (1951)..(2097): Any amino acid
  MOD_RES (2119)..(2121): Any amino acid
  MOD_RES (2140)..(2150): Any amino acid
  MOD_RES (2201)..(2225): Any amino acid
  MOD_RES (2250)..(2250): Any amino acid
  MOD_RES (2274)..(2344): Any amino acid
  MOD_RES (2363)..(2411): Any amino acid
  MOD_RES (2452)..(2472): Any amino acid
  MOD_RES (2496)..(2528): Any amino acid
  MOD_RES (2550)..(2555): Any amino acid
  MOD_RES (2570)..(2678): Any amino acid
  MOD_RES (2703)..(2712): Any amino acid
  MOD_RES (2745)..(2798): Any amino acid
  MOD_RES (2811)..(2812): Any amino acid
  MOD_RES (2833)..(2848): Any amino acid
  MOD_RES (2889)..(3001): Any amino acid
  MOD_RES (3023)..(3039): Any amino acid
  MOD_RES (3061)..(3112): Any amino acid
  MOD_RES (3145)..(3153): Any amino acid
  MOD_RES (3175)..(3308): Any amino acid
  MOD_RES (3330)..(3346): Any amino acid
XNNQRKKARNTPFNMLKREXXXXXTPQQLTKRFSLGMLQGRGPLKXXXXXXXXXXXXXXXXXXXILKRWGTLKKNKAIRVLRGFRKEIGRMLNILNGRRRSTVTLLCLIPTVMAFHLTTRDGEPLMIVARHERGRPLLFKTTEGINRCTLIAMDVGEMCEDTITYKCPLLRQNEPEDIDCWCNSTSTWVTYGTCTTTGEHRREKRSVXXXXXXXXXXXXXXXXXXXXXXXXXXXXXXXXXXXXXXXXALMAAIMAYTVGTTHFQRALIFILLTAVAPSMTMRCIGVGNRDFVEGVSGGTWVDLVLEHGGXXXXXXKNKPTLDFELIKTEAKQPATLRKYCIEAKLTNTTTESRCXXXXXXXXXXEQDQQFICRRDMVDRGWGNGCXXXXKGGIVTCAMFTCKKNMEGKVVXXXXXXXXXXXXXXSGETHAVGNDTSNHGVTTTITPQSPIVEAELTDYGTLTMECSPRTGIDFNEMILMKMETKTWLVHKQWFLDLPLPWAPGADTLGSNWIQKETLVTFKNPXXXXXXXXXXXSQEGAMHTALTGATEIQMSSGXXXXXGHLKCKVRMEKLRIKGISYSMCSGKFSVDREMAETQHGTIVIRVKYEGAGSPCKIPFEIMDLEKRHVLGRXXXXXXXAESKDSPVNIELEPPFGDSYIIIGVEPGQLKLNWFKKGSSIGKMLESTYRGAKRMXXXXXXAWDFGSLGGVFTSLGKALHQIFGSVYGAAFSGVSWTVKILIGVIILWIGTNSRNTPMAMTCIAVGGXXLFLGFTVHADTGCXXSWNGKELKCGSGIFVTDNVHTWIEQYKFQPESPARLASAILNAHEDGVCGIRSTTXXXXXXXXXXXXXXXXXXXXXGHDLTIVAGDAKGVLVKGKRALTPPVNDLKYSWKTWGKARIFTPEARNSTFLVDGPDXXXCPNERRAWNFLEVEDYGFGMXXXXXXXXXXXXXXXXXXXXXXXXXXXXXXXXXXXXXXXXXXXXXXXXXXXXXXXXXXXXXXXXXXXXXXXXXVLESQMLIPKSYAGPISQHNYRQGYATQTMGPWHLGKLEIXFGECPGTTVAIQDDCGHRGSSLRTXXXXXXXXXXXXXXXXXXXXXXXXXXXXXXYGMEIRPLSEKEENMVKSQVSAGXGTSETFSMGLLCLTLFIEECLRRKVTRKHMILVVVTTLCAIILGGLXXXXXXXAIIMLGDTMLSRMGGQVHLAIMAVFKMXPGYVLGVFLRRLTSRETXXMVIGMAMTTVLSIPHDLMEFIDGLALGLILLKMVTHFDNTQVGTLALALTFIKSTXPLTMAWRTIMAVLFAVTLIPLCRXXXXXNQSHWVEITALTLGAQALPVYXXXXXXXXXXXXXXXXXXXXXXXXXXXXXXXXXXXXXXXXXXXXXXXXXXXXXXXXXXSADLSLERAANVQWDEMADITGSSPVIEVKQDEDGSXXXXXXXXXXXXXXXXXXXXXXXXXLYPLAIPVTMALWYMWQVRTQRSGALWDVPSPAATQKATLTEGVYRIMQXXLLGRTQVGVGVHVEGVFHTMWHVXXXXXXXXXXXXXXXXXXXXXXXXXXXXXXXXXXXXXDKEEDVQVLAVEXXXXXXXXXXXXXXXXXXXXXXXXXXXXXXPGTSGSPIVNRKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIRYQTPAVKAEXXXXXXXXXXXXXXXXXXXXXXXXXXXXXXXXXXXXXXXXXXXXXXXXXXXXXXXXXXXXAIFMTATPPGTTDPFPQSNSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPRRCLKPVISTDGPERVILAXXXXXXXXXXXQRRGRIGRNPTQEDDQYVFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDILTEIATLPAYLSSKAKLALXXXVMLHTTERGGKAYQHALNXXXXXXXXXXXIALLGAMTAGIFLFFMQGKGIGKLSMGLITIAVASGLFWVAELQPQWIAAXXXXXXXXXXXXXXXXXXXXXXXXXQLIYVILTILTIIALVAANEMGLIXKTKADFGFYQEKPETTILDVDLRXXXXXXXXXXXXXXXXXXXXXXXXXXXXXXXXXXXXXXXXXXXXXXXXXXXXXXXXXXXXXXXXXXXXXXXTTLIASLVMLFVHYAIIGXXXXXXXXXXXXXXXXXXXXXXXXXXXXXXXXXXXXXXXXXXXXXXXXXMLLVLCAGQLFLMRTTWAFCEVLTLATGPVLTLWEGNPGRXXXXXXXXXXXXXXXXXXXXXAGLAFSLIKNAQAPRRGTGTTGEXXXXXXXXXXXXXXXXXXXXXXXXXXXXXXXXXAKSALKDGSKIKYAVSRGTSKXXXXXXRGMVKPKGKIVDLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIEELEKLQRKHGGSLIRCPLSRNSXXXXXXXXXXTGNIVSSVNTVSKMLLNRFTTRHRRPTYEKDVXXXXXXXXXXXXXXXXXXXXXXXXXXXXXXXXXXXXXXXXXXXXXXXXXXXXXXAPSTGSTSSMVNXXVKLLTKPWDMIPMVTQLAMTXXXXXXXXXXXXXXXXTRTPQPKPGTRVVMTTTANWLWTLLGRKKTPRLCTREEFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLGYILEDIDRKDGDLMYADDXXXXXXXXXXXXXXXXXLITEQMAPHHRILAKAIFKLTXXXXXXXXXXXXXXXXXXXXXXXXXXXXXXXXXXXXXXXXXXXXXXXXXXXXAEGVITRDDMQNPKGLKERVENWLRECGVDRLXXXXXXXXXCVVKPLDERFATSLLFLNDMGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDNPNMTDKTPVHSWEDVPYLGXXXXXXXXXXXXXXXXXTWAKNIHTAIAQVRNLIGKEEYVDYMPVMRRYSALSESEGVL

SEQ ID NO: 265775 - protein, 3388 aa, Dengue virus
  MOD_RES (1)..(5): Any amino acid
  MOD_RES (18)..(24): Any amino acid
  MOD_RES (46)..(68): Any amino acid
  MOD_RES (123)..(160): Any amino acid
  MOD_RES (177)..(185): Any amino acid
  MOD_RES (198)..(255): Any amino acid
  MOD_RES (277)..(365): Any amino acid
  MOD_RES (379)..(431): Any amino acid
  MOD_RES (462)..(469): Any amino acid
  MOD_RES (518)..(566): Any amino acid
  MOD_RES (578)..(598): Any amino acid
  MOD_RES (631)..(637): Any amino acid
  MOD_RES (651)..(652): Any amino acid
  MOD_RES (670)..(708): Any amino acid
  MOD_RES (720)..(734): Any amino acid
  MOD_RES (746)..(747): Any amino acid
  MOD_RES (759)..(766): Any amino acid
  MOD_RES (780)..(781): Any amino acid
  MOD_RES (808)..(816): Any amino acid
  MOD_RES (834)..(858): Any amino acid
  MOD_RES (891)..(892): Any amino acid
  MOD_RES (904)..(917): Any amino acid
  MOD_RES (938)..(1015): Any amino acid
  MOD_RES (1050)..(1053): Any amino acid
  MOD_RES (1075)..(1111): Any amino acid
  MOD_RES (1129)..(1129): Any amino acid
  MOD_RES (1142)..(1154): Any amino acid
  MOD_RES (1176)..(1184): Any amino acid
  MOD_RES (1210)..(1229): Any amino acid
  MOD_RES (1250)..(1251): Any amino acid
  MOD_RES (1285)..(1285): Any amino acid
  MOD_RES (1299)..(1457): Any amino acid
  MOD_RES (1475)..(1478): Any amino acid
  MOD_RES (1500)..(1506): Any amino acid
  MOD_RES (1519)..(1786): Any amino acid
  MOD_RES (1807)..(2102): Any amino acid
  MOD_RES (2116)..(2169): Any amino acid
  MOD_RES (2199)..(2228): Any amino acid
  MOD_RES (2247)..(2250): Any amino acid
  MOD_RES (2272)..(2344): Any amino acid
  MOD_RES (2359)..(2431): Any amino acid
  MOD_RES (2452)..(2474): Any amino acid
  MOD_RES (2494)..(2528): Any amino acid
  MOD_RES (2545)..(2681): Any amino acid
  MOD_RES (2700)..(2849): Any amino acid
  MOD_RES (2870)..(2871): Any amino acid
  MOD_RES (2889)..(3007): Any amino acid
  MOD_RES (3020)..(3040): Any amino acid
  MOD_RES (3052)..(3126): Any amino acid
  MOD_RES (3140)..(3365): Any amino acid
XXXXXNKVVRPSFNMLKXXXXXXXTVQGLVKRFSIGLFSGKGPLRXXXXXXXXXXXXXXXXXXXXXXXWGQLKKTKAINVLRGFRKEIGRMLNILNRRRRTAGMILCLIPTIMAFHLSTRDGXXXXXXXXXXXXXXXXXXXXXXXXXXXXXXXXXXXXXXDTVTYECPLLVNTEPEXXXXXXXXXSTWVTYGTCTTTXXXXXXXXXXXXXXXXXXXXXXXXXXXXXXXXXXXXXXXXXXXXXXXXXXXXXXXXXXYMIGQTGIQRTIFFVLMMLVAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQDRQYICRRDVVDXXXXXXXXXXXXXXXXXXXXXXXXXXXXXXXXXXXXXXXXXXXXXXXXXXXXXGNDTGKHGVTIKITPRSPSVEVQLPDYGELXXXXXXXXGIDFNEMILMRMENKAWLVHRQWFLDLPLPWLAGADTQGSNWIQKETLXXXXXXXXXXXXXXXXXXXXXXXXXXXXXXXXXXXXXXXXXXXXXXXXXIRMEKLRIKGMXXXXXXXXXXXXXXXXXXXXXTAVVKVQYEGDGSPCKIPIEIRDVNKEKVIGRXXXXXXXVTYTNSVTNIELEXXFGDSYIMIGVGNSALTLXXXXXXXXXXXXXXXXXXXXXXXXXXXXXXXXXXXXXXXFTSLGKAVHQIXXXXXXXXXXXXXXXIRILIGLLVLWXXMNSRNTSMAMTXXXXXXXXLFLGFTVQADVGCXXSWNGRELKCGSGIFVADNVHTWTEQYXXXXXXXXXLASAILNAHKDGVCGVRXXXXXXXXXXXXXXXXXXXXXXXXXHDLTVVAGDVKGVLTKGKRALAPPVNDLKYSWXXWGKAKIFTPEVXXXXXXXXXXXXXXCPNERRAWNFFEVEDYGFGMXXXXXXXXXXXXXXXXXXXXXXXXXXXXXXXXXXXXXXXXXXXXXXXXXXXXXXXXXXXXXXXXXXXXXXXXXXXXXXMLIPKAYAGPISQHNYRQGYATQIAGPWHLGKLEXXXXECPGTTVTIQEDCGHRGSSLRXXXXXXXXXXXXXXXXXXXXXXXXXXXXXXXXXXXXXPLNEKEENMVRSQVTAGXGPSETFSMGLLCXXXXXXXXXXXXXTRKHMILVVVTTFCAIILGGLXXXXXXXXXIMLGDTMFGRIGGQTHLAIMIVFKMXXXXXXXXXXXXXXXXXXXXMVIGMAMTTVLSIPHDLMEFXXGIALGLILLKTVVQFDSTQVGTLALSLTFISSTXPLIMAWRTIMAVFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIPVTMTLWYMWQVRTQXXXXLWDVPSPATAQKATLTEGVYRXXXXXXXGKTQVGVGIHTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFMTATPPGSTDPFPQSNSPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIASLPTYLSSKAKXXXXXXXXXXXXXXXXXXXXXXXXXXXXXXXXXXXXXXXXXXXXXXXXXXXXXXGMGKLSVGLITIAVASGLLWVAELQPQWIXXXXXXXXXXXXXXXXXXXXXXXXXXXXXXYVILAILAIIGLIAANEMXXXXKTKTDFGFYQEKPETTILDVDXXXXXXXXXXXXXXXXXXXXXXXXXXXXXXXXXXXXXXXXXXXXXXXXXXXXXXXXXXXXXXXXXXXXXXXXXTTLTASLAMLLVHYXXXXXXXXXXXXXXXXXXXXXXXXXXXXXXXXXXXXXXXXXXXXXXXXXXXXXXXXXXXXXXXXXXXXXXXXXEVLTLSTGPALTLWEGGPGRXXXXXXXXXXXXXXXXXXXXXXXLAFSLIKNTQTPRRGTGITXXXXXXXXXXXXXXXXXXXXXXXXXXXXXXXXXXXAKSALKDGSKIKYAVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLEKLQRKYGGSLVRCPLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRTPQPKPGTQMIMTTTANWLXXLLGKKKSPRLCTKEEFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDIDKKDGDLMYXXXXXXXXXXXXXXXXXXXXXITEQMAPGHKIXXXXXXXXXXXXXXXXXXXXXXXXXXXXXXXXXXXXXXXXXXXXXXXXXXXXXXXXXXXXXXXXXXXXXXXXXXXGLKEKVEKWLKECXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEYADYMPVMKRYSAHFESEGVL

SEQ ID NO: 265776 - protein, 3388 aa, Dengue virus
  MOD_RES (1)..(71): Any amino acid
  MOD_RES (86)..(90): Any amino acid
  MOD_RES (123)..(256): Any amino acid
  MOD_RES (273)..(432): Any amino acid
  MOD_RES (459)..(471): Any amino acid
  MOD_RES (483)..(496): Any amino acid
  MOD_RES (512)..(617): Any amino acid
  MOD_RES (631)..(637): Any amino acid
  MOD_RES (651)..(653): Any amino acid
  MOD_RES (670)..(734): Any amino acid
  MOD_RES (746)..(766): Any amino acid
  MOD_RES (780)..(781): Any amino acid
  MOD_RES (795)..(796): Any amino acid
  MOD_RES (808)..(863): Any amino acid
  MOD_RES (891)..(1017): Any amino acid
  MOD_RES (1031)..(1054): Any amino acid
  MOD_RES (1074)..(1116): Any amino acid
  MOD_RES (1129)..(1129): Any amino acid
  MOD_RES (1141)..(1154): Any amino acid
  MOD_RES (1176)..(1193): Any amino acid
  MOD_RES (1205)..(1238): Any amino acid
  MOD_RES (1250)..(1262): Any amino acid
  MOD_RES (1276)..(2179): Any amino acid
  MOD_RES (2194)..(2252): Any amino acid
  MOD_RES (2272)..(2482): Any amino acid
  MOD_RES (2494)..(2530): Any amino acid
  MOD_RES (2545)..(2683): Any amino acid
  MOD_RES (2699)..(2850): Any amino acid
  MOD_RES (2867)..(2875): Any amino acid
  MOD_RES (2889)..(3370): Any amino acid
XXXXXXXXXXXXXXXXXXXXXXXXXXXXXXXXXXXXXXXXXXXXXXXXXXXXXXXXXXXXXXXXXXXXXXXIKKSKAINVLRGFRXXXXXMLNILNRRKRSTVTLIMLIPTVMAFHLTTRNGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMIGQTRIQRTVFFVLMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNDIPNHGKEATITPRSPSAEVKLPDYXXXXXXXXXXXXXDFNEMVLLQMEXXXXXXXXXXXXXXPLPWTAGADTLEVHWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEIKDMNKEKVVGRXXXXXXXAEEKDSPVNIEAEXXXGDSYIVIGAGDSALTLXXXXXXXXXXXXXXXXXXXXXXXXXXXXXXXXXXXXXXXXXXXXXXXXXXXXXXXXXXXXXXXXXMKILIGVIITWXXXXXXXXXXXXXXXXXXXXXLFLGFTVRADMGCXXSWTGKELKCGSGIXXIDNVHTWTEQHXXXXXXXXXXXXXXXXXXXXXXXXXXXXXXXXXXXXXXXXXXXXXXXXXXXXXXXXVAGDVKGVLTKGKRTLAPPASDLKYSWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIPKAYAGPISQHNXXXXXXXXXXXXXXXXXXXXXXXXCPGTTVTVREDCDHRGPSLXXXXXXXXXXXXXXXXXXXXXXXXXXXXXXXXXXXXXXXXXXXEENMVKSQATAGXGTPETFSMGLLXXXXXXXXXXXXXXTRKHMILVVAATLCAIILGGLXXXXXXXXXXXXXXXXXXRVGGQTHLAIMXXXXXXXXXXXXXXXXXXXXXXXXXXXXXXXXXXTFSIPHDLMELXXXXXXXXXXXXXVTHFDSTQVGTLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAVASGLLWIAEIXXXXXXXXXXXXXXXXXXXXXXXXXXXXXXXXXXXXXXXXXXXXXXXXXXXXXXXXXXXKTDFGFYQVKTEITILDVDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAQTPRRGTGTIXXXXXXXXXXXXXXXXXXXXXXXXXXXXXXXXXXXXXSALRDGSKTKHAVSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKLQRKYGGSLVRCPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTPQPKLGTRVVMTTTAXXXXXXXXXKKKPRLCTREEFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYMPAMKRYSAPSENEGVL

SEQ ID NO: 265777 - protein, 3434 aa, West Nile virus
  MOD_RES (111)..(121): Any amino acid
  MOD_RES (144)..(144): Any amino acid
  MOD_RES (341)..(342): Any amino acid
  MOD_RES (354)..(354): Any amino acid
  MOD_RES (379)..(379): Any amino acid
  MOD_RES (444)..(449): Any amino acid
  MOD_RES (468)..(468): Any amino acid
  MOD_RES (602)..(602): Any amino acid
  MOD_RES (888)..(890): Any amino acid
  MOD_RES (937)..(937): Any amino acid
  MOD_RES (1080)..(1080): Any amino acid
  MOD_RES (1266)..(1269): Any amino acid
  MOD_RES (1355)..(1355): Any amino acid
  MOD_RES (1839)..(1839): Any amino acid
  MOD_RES (2210)..(2210): Any amino acid
  MOD_RES (2287)..(2303): Any amino acid
  MOD_RES (2571)..(2571): Any amino acid
  MOD_RES (2825)..(2825): Any amino acid
  MOD_RES (2903)..(2903): Any amino acid
  MOD_RES (3055)..(3057): Any amino acid
  MOD_RES (3427)..(3434): Any amino acid
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGXXXXXXXXXXXGAVTLSNFQGKVMMTVNATDVTXVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAXXLAEVRSYCYLAXVSDLSTKAACPTMGEAHNDKRADPXFVCRQGVVDRGWGNGCGLFGKGSIDTCAKFACSTKAIGRTILKENIKYEVAIFVHGPTTVESHGXXXXXXGATQAGRFSITPAAPSYTXKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFXGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHKEGVCGLRSVSRLEHQMWEAVKDELNTLLKENGVDLSVVVEKQEGMXXXAPKRLTATTEKLEIGWKAWGKSILFAPELANNTFVVDGPETKECPTXNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSXSCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYHDARXXXXWEIPDVLNSLAVAWMILRAITFTTTSNVVVPLLALLTPGLRCLNLDVYRILLLMVGIGSLIREKRSAAAKKKGASLLCLALASTGXFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPIXDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAXLGVATFFCWMAEVPGTKIAGMLLLSLLLMIVLIPEPEKQRSQTDNQLAVFLICVMTLVSAVAANEMGWLDKTKSDIXXXXXXXXXXXXXXXXXGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKXARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHXDENHPYRTWNYHGSYDVKPTGSASSLVNGVVRLLSKPWDTITNVTTMAMTDTTPFGQQRVFKEKVDTKAPEPPEGVKXVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGXXXGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTXXXXXXXX

SEQ ID NO: 265778 - protein, 3434 aa, West Nile virus
  MOD_RES (1)..(3): Any amino acid
  MOD_RES (111)..(121): Any amino acid
  MOD_RES (144)..(144): Any amino acid
  MOD_RES (255)..(256): Any amino acid
  MOD_RES (288)..(290): Any amino acid
  MOD_RES (341)..(342): Any amino acid
  MOD_RES (354)..(354): Any amino acid
  MOD_RES (379)..(379): Any amino acid
  MOD_RES (391)..(402): Any amino acid
  MOD_RES (444)..(449): Any amino acid
  MOD_RES (468)..(468): Any amino acid
  MOD_RES (551)..(551): Any amino acid
  MOD_RES (602)..(602): Any amino acid
  MOD_RES (639)..(643): Any amino acid
  MOD_RES (750)..(756): Any amino acid
  MOD_RES (888)..(890): Any amino acid
  MOD_RES (937)..(937): Any amino acid
  MOD_RES (1007)..(1017): Any amino acid
  MOD_RES (1080)..(1080): Any amino acid
  MOD_RES (1219)..(1219): Any amino acid
  MOD_RES (1266)..(1269): Any amino acid
  MOD_RES (1354)..(1355): Any amino acid
  MOD_RES (1375)..(1392): Any amino acid
  MOD_RES (1502)..(1508): Any amino acid
  MOD_RES (1551)..(1559): Any amino acid
  MOD_RES (1746)..(1746): Any amino acid
  MOD_RES (1766)..(1780): Any amino acid
  MOD_RES (1796)..(1799): Any amino acid
  MOD_RES (1817)..(1820): Any amino acid
  MOD_RES (1839)..(1839): Any amino acid
  MOD_RES (1897)..(1904): Any amino acid
  MOD_RES (1980)..(1983): Any amino acid
  MOD_RES (1999)..(2000): Any amino acid
  MOD_RES (2150)..(2151): Any amino acid
  MOD_RES (2210)..(2210): Any amino acid
  MOD_RES (2246)..(2251): Any amino acid
  MOD_RES (2287)..(2303): Any amino acid
  MOD_RES (2341)..(2344): Any amino acid
  MOD_RES (2534)..(2535): Any amino acid
  MOD_RES (2571)..(2571): Any amino acid
  MOD_RES (2591)..(2593): Any amino acid
  MOD_RES (2615)..(2622): Any amino acid
  MOD_RES (2638)..(2644): Any amino acid
  MOD_RES (2744)..(2745): Any amino acid
  MOD_RES (2825)..(2825): Any amino acid
  MOD_RES (2851)..(2859): Any amino acid
  MOD_RES (2875)..(2890): Any amino acid
  MOD_RES (2903)..(2903): Any amino acid
  MOD_RES (2940)..(2943): Any amino acid
  MOD_RES (2987)..(2992): Any amino acid
  MOD_RES (3003)..(3024): Any amino acid
  MOD_RES (3040)..(3041): Any amino acid
  MOD_RES (3055)..(3057): Any amino acid
  MOD_RES (3132)..(3135): Any amino acid
  MOD_RES (3198)..(3202): Any amino acid
  MOD_RES (3227)..(3231): Any amino acid
  MOD_RES (3249)..(3252): Any amino acid
  MOD_RES (3277)..(3289): Any amino acid
  MOD_RES (3305)..(3311): Any amino acid
  MOD_RES (3357)..(3358): Any amino acid
  MOD_RES (3378)..(3381): Any amino acid
  MOD_RES (3427)..(3434): Any amino acid
XXXKPGGPGKNRAVNMQKRGMPRGLSLTGLKRAMLSLIDGRGPTRFVLALLTFFKFTAIAPTRALLDRWRGVRKQTAMKHLTSFKKELGALTNAMNRRSTKQKKRGGTAGXXXXXXXXXXXSALTLSNFQGKLMMTVNATDITXIITIPPAAGKNLCTIRAMDVGYLCEDTITYECPVLAEGNDPEDIDCWCTKSSVFVRYGRCTRTRNSRRSRRSLNVQVHGESSLANKKGAWLDSTKASRYLMKAESWILRNXXYALVAAVTGWMLGSNTMQRVVFAILLLLVAPXXXFNCLGMSNRDFIEGASGATWMDLVLEGDSCVTIMAKDRPTIDVKMVTMGAXXLADVRSYCYAAXVSDLSTRAACPTMGEAHNEKRADPXFVCKQGVVDRGXXXXXXXXXXXXIDTCAKFACSTKATGWIIQRENVKYEVAAFVHGPTTVDTHSXXXXXXAAVQAGRFSITPSAPSYTXTLGDYGEVTFDCEPRSGIDTSAYYVMSVGAKSFLVHREWFTDLNLPWSSPGNTTWRNREALVEFEEAHATKQSVVALGSQEGXLQQALAGAIPVDYKNSVVKLSSGHLKCRVRMEKLKLKGTTYGVCAKAFRFXRTPADTGHGTVVMELQYTGTDGPCKIPITSVASLNDXXXXXRLVTVNPYVSVATANSKILVELEPPFGDSYIVIGKGDQQVTHHWYKSGSSIGKAFTTTLRGAQRLVSLGDTAWDFGSIGGVFTSVGKAIHQLFGGAFRLLFGGMSWXXXXXXXALLLWMGINARDRSIAMTFLAVGGILLFLSANVHADTGCAIDIGRQELRCGSGVFIYNDVEAWVDRYKFHPETPQGLAKIIQKAHAEGVCGVRSVSRLEHQMWESIKDELNTLLKENGVDLSIVVEKQNGMXXXAPKRLAATTEKLEMGWKAWGKSIIFAPELANNTFVIDGPETEECPTXNRAWNSMEVEDFGFGLTSTRMFLRIRETNTTECDTKTIGTAVKNNMAVHSDLSYWIESGFNETWKLERAXXXXXXXXXXXETHTLWGDGVQESDLIIPITLAGLRSNYNKRPGYKTQSQGPWDEGRVELDFDYCPGTTVTISXSCGHRGPAARTTTESGKLISDWCCRSCTLPPLRFQTENGCWYGMEIRPTRHDEKTLVQSRVTAYKAEMIDPFQLGLMVVFLATQEVLRRRWTAKISIPAIMLALLTLVFGGVTYTDLIRYINLVGAAFAEANSGGDVVXLALMATFKIQPVFLVASFLKARWTNQESILLMLAAAFFQMAYYDAKXXXXWEVPDVLNSLSIAWMILRAISFTNTSNVATPLMALLTPGLKCLHLDIYRILLLMVGVGSLIKEKRSSAAKKKGACLICLALASTXXFNPMILAAGLITCDPNRKRXXXXXXXXXXXXXXXXXXGGLAELDIDTMAIPMTIAGLMFVAYVITGRSTDMWIERTADITWESDAEITGTSDRVDVKLDDDGNFQLINDPGAPWKIWMLRMACLAVSAYTPWAILPSVIGFWITLQXXXXXXXLWDTPSPREYKRGDTTTGVYRIMTRGILGSYQAGVGVMVEGVXXXXXXXXXGAALMSGTGRLDPYWGSVREDRLCYGGPWKLQHKWNGHDEVQMIVAEPGRNTRNVQTKPGVFKTPDGEIGAVTLDYPTGTSGSPIVDRSGDVIGLYGNGVIMPNGAYISAIVQGERMEEPAPAGFEPDTLRKKQISVLDLHPGAGKTRKILPQIIKEAINKRLRTAILAPTRVVAAEMSEALRGLPXRYQTSAVTREHSGNEIVDVXXXXXXXXXXXXXXXVPNYNLFIMDEAHFTXXXXIAARGYIATRVELGEAAXXXXTATPPGSSDPFPESNAPIXDMQTEIPDRAWNTGYEWITEYIGKTVWFVPSVRMGNEMAQCLQRAGKKVIQLNRKSYXXXXXXXXNDDWDFVVTTDISEMGANFKANRVIDSRKSVKPTIIEEGDNRVILGEPSAITAASAAQRRGRIGRNSSQAGDEYCXXXXTNEDDSNCAHWTEARXXLDNINMPNGLVAQLYQPEREKVYTMDGEYKLRGEERKNFLEFLRTADLPVWLAYKVAAAGISYHDRKWCFDGPRTNTVLEENTEVEIVTKMGERKILRPRWADARVYSDHQALKSFKDFAAGKRSQIGLVEVLGRMPEHFVVKTWEALDXXYVVATAEKGGRAHRTALEELPDALQTIALITLLSVMSLGVFCLLMQRKGVGKIGLGGTXLGAATLFCWMAEVSGTKIAGMLLLSLLMMIVLIPEXXXXXXQTDNQLAVFLICVLTLVGTVAANEMGWLDKTKNDIXXXXXXXXXXXXXXXXXESFLLDLKPATAWSLYAVSTAVMTPLLKHVITSDYINXXXXSINVQASALFTLSRGFPFVDVGVSALLLAVGCWEQVTLTVTVTATALLLCHYAYMIPGWQAEAMRAAQRRTAAGIMKNVVIDGMVATDVPELERTTPVMQKKVGQVMLILVSMAAVVVNPSVRTVREAGILTSAASVTLWENGAGSVWNATTAIGLCHVMREGWLSCLSITWTLVKNMDKPVLKRGGAKXXTLGEVWKERLNHLTKEEFIRYRKEAITEVDRSAARXARREGNITGGHSVSRGTAKXXXLVERRFLEPVGKVVDLGCGRGXXXXXXXXQKRVQEVKGYTKGGPXXXXXXXVQSYGWNTVTMKSGVDVFYRPSEASDTLLCDIGESASSAEVEEHRTVRVLEMVEDWLHRGPKEFCIKVLCPYMPKVIEKMETLQRRYGGGLIRNPLSRNXXHEMYWVSHASGNIVNSVSMTSQVLLGRMEKKTWKGPQFEEDANLGSGTRAVGRPLLNSDTGKIRNRIERLKKEYSSTWHXDANHPYRTWNYHGSYDVRPTGSASSXXXXXXXXXSKPWDTIMNVTTMAMXXXXXXXXXXXXXXXXDTKAPEPAEGVKXALNETTNWLWTFLARDKKPRMCSREEFIGKVNSNAAXXXXFEEQNQWKNARAAVEDLKFWEMVDDEREAHLRGECNTCIYNMMXXXXXXPGEFGKARGSXXXXXXXXXXXXXXXXXXXXXXEDHWLGRENSGGGVEXXGLQKLGYILKEVGXXXGGKMYADDTAGWDTRITKADLENEAKVLEFLEGEHRRLARSVIELTYRYKVVKVMRPAADGKTVMDIISREDQRXXXXVVTYALNTFTNLSFQLVRMMEGEGVVTPDDVEKLGKGKGVKVRVWLSENGKERLGRMAVSGDXXXXXPLDDRFATALHFLNDMPKVRKDIQXXXXXVGWYDWQQVQFCSNHFTXXXXKDGRTLVTPCRGQDELIGRARISPXXXXXXXXXXXXXKSYAQMWQLLYFHRRXXXXXXXAICSAVPVSWVPTGRTTWSIHAKGEWMTTEDMLAVWNKVWIEENEXXEDKTPVERWSDIPYSGKREXXXXGSLIGTRTRATWAENIHVAINQVRSVIGEEKYVDYMSSLRRYEDTXXXXXXXX

SEQ ID NO: 265779 - protein, 3434 aa, West Nile virus
  MOD_RES (1)..(9): Any amino acid
  MOD_RES (79)..(82): Any amino acid
  MOD_RES (111)..(121): Any amino acid
  MOD_RES (144)..(144): Any amino acid
  MOD_RES (243)..(271): Any amino acid
  MOD_RES (287)..(294): Any amino acid
  MOD_RES (313)..(317): Any amino acid
  MOD_RES (341)..(342): Any amino acid
  MOD_RES (354)..(354): Any amino acid
  MOD_RES (379)..(379): Any amino acid
  MOD_RES (388)..(404): Any amino acid
  MOD_RES (432)..(435): Any amino acid
  MOD_RES (444)..(449): Any amino acid
  MOD_RES (468)..(468): Any amino acid
  MOD_RES (500)..(511): Any amino acid
  MOD_RES (538)..(555): Any amino acid
  MOD_RES (573)..(578): Any amino acid
  MOD_RES (589)..(592): Any amino acid
  MOD_RES (602)..(602): Any amino acid
  MOD_RES (611)..(614): Any amino acid
  MOD_RES (636)..(646): Any amino acid
  MOD_RES (667)..(676): Any amino acid
  MOD_RES (692)..(692): Any amino acid
  MOD_RES (711)..(717): Any amino acid
  MOD_RES (743)..(757): Any amino acid
  MOD_RES (808)..(810): Any amino acid
  MOD_RES (888)..(890): Any amino acid
  MOD_RES (909)..(911): Any amino acid
  MOD_RES (937)..(937): Any amino acid
  MOD_RES (946)..(952): Any amino acid
  MOD_RES (987)..(989): Any amino acid
  MOD_RES (1007)..(1019): Any amino acid
  MOD_RES (1049)..(1058): Any amino acid
  MOD_RES (1080)..(1080): Any amino acid
  MOD_RES (1097)..(1107): Any amino acid
  MOD_RES (1152)..(1152): Any amino acid
  MOD_RES (1212)..(1220): Any amino acid
  MOD_RES (1253)..(1254): Any amino acid
  MOD_RES (1266)..(1269): Any amino acid
  MOD_RES (1352)..(1355): Any amino acid
  MOD_RES (1374)..(1394): Any amino acid
  MOD_RES (1408)..(1409): Any amino acid
  MOD_RES (1423)..(1427): Any amino acid
  MOD_RES (1466)..(1467): Any amino acid
  MOD_RES (1485)..(1486): Any amino acid
  MOD_RES (1501)..(1511): Any amino acid
  MOD_RES (1527)..(1584): Any amino acid
  MOD_RES (1619)..(1641): Any amino acid
  MOD_RES (1655)..(1657): Any amino acid
  MOD_RES (1671)..(1672): Any amino acid
  MOD_RES (1698)..(1707): Any amino acid
  MOD_RES (1728)..(1730): Any amino acid
  MOD_RES (1743)..(1746): Any amino acid
  MOD_RES (1766)..(1801): Any amino acid
  MOD_RES (1815)..(1825): Any amino acid
  MOD_RES (1839)..(1839): Any amino acid
  MOD_RES (1849)..(1853): Any amino acid
  MOD_RES (1869)..(1881): Any amino acid
  MOD_RES (1895)..(1918): Any amino acid
  MOD_RES (1932)..(1933): Any amino acid
  MOD_RES (1956)..(1963): Any amino acid
  MOD_RES (1979)..(1983): Any amino acid
  MOD_RES (1999)..(2006): Any amino acid
  MOD_RES (2031)..(2048): Any amino acid
  MOD_RES (2070)..(2073): Any amino acid
  MOD_RES (2085)..(2094): Any amino acid
  MOD_RES (2149)..(2153): Any amino acid
  MOD_RES (2199)..(2201): Any amino acid
  MOD_RES (2210)..(2210): Any amino acid
  MOD_RES (2230)..(2257): Any amino acid
  MOD_RES (2287)..(2303): Any amino acid
  MOD_RES (2314)..(2314): Any amino acid
  MOD_RES (2334)..(2346): Any amino acid
  MOD_RES (2363)..(2366): Any amino acid
  MOD_RES (2375)..(2381): Any amino acid
  MOD_RES (2398)..(2417): Any amino acid
  MOD_RES (2431)..(2434): Any amino acid
  MOD_RES (2468)..(2468): Any amino acid
  MOD_RES (2484)..(2507): Any amino acid
  MOD_RES (2531)..(2536): Any amino acid
  MOD_RES (2571)..(2571): Any amino acid
  MOD_RES (2590)..(2595): Any amino acid
  MOD_RES (2611)..(2660): Any amino acid
  MOD_RES (2676)..(2683): Any amino acid
  MOD_RES (2699)..(2702): Any amino acid
  MOD_RES (2714)..(2718): Any amino acid
  MOD_RES (2734)..(2748): Any amino acid
  MOD_RES (2769)..(2773): Any amino acid
  MOD_RES (2791)..(2798): Any amino acid
  MOD_RES (2825)..(2825): Any amino acid
  MOD_RES (2835)..(2835): Any amino acid
  MOD_RES (2851)..(2860): Any amino acid
  MOD_RES (2873)..(2893): Any amino acid
  MOD_RES (2903)..(2907): Any amino acid
  MOD_RES (2940)..(2943): Any amino acid
  MOD_RES (2987)..(3043): Any amino acid
  MOD_RES (3055)..(3057): Any amino acid
  MOD_RES (3080)..(3082): Any amino acid
  MOD_RES (3127)..(3140): Any amino acid
  MOD_RES (3194)..(3203): Any amino acid
  MOD_RES (3225)..(3312): Any amino acid
  MOD_RES (3353)..(3362): Any amino acid
  MOD_RES (3374)..(3381): Any amino acid
  MOD_RES (3397)..(3397): Any amino acid
  MOD_RES (3427)..(3434): Any amino acid
XXXXXXXXXKNRAVNMQKRGTPRVGSLIGLKRAVLSLIDGRGPTRFVLALLAFFKFTAIAPTRAVLDRWRSVNKQTAMXXXXSFKRELGILTNAMNRRSLKQKKRGGSIGXXXXXXXXXXXGAVTLSNFQGKVMMTINATETTXIITIPTASGKNLCTVRAMDVGFMCDDTIAYECPALMEGNDPEDIDCWCTKLAVFVRYGRCTRTRQSRRSRRSLTVQTHGESTLSNRKGAWLDSTKASRXXXXXXXXXXXXXXXXXXXXXXXXXXXXXTTQRVVFMILLLLVAXXXXXXXXGMSSRDFLEGVSGATWMDXXXXXDSCVTIMSKNKPTIDVKMTNMEAXXMGEVRSYCHLAXATEISSSAACPAMGEAHNEKRTDSXYVCRQGVVXXXXXXXXXXXXXXXXXTCAKFACTTKATGLTIQREBIKYEVAIXXXXPTTVESHRXXXXXXGATQAGRFSVSPAAPTHTXNLGEYGEVTIDCEPRSGVDVDAFYVMSVGEKXXXXXXXXXXXXNLPWSSAESNNWRNRETLVEFEEPHAXXXXXXXXXXXXXXXXXXLAGAIPLSFTSNTVKLTXXXXXXRVKMEKLKLKXXXXGVCSKAFRFXNTPADTGHXXXXLELQYTGKDGPCKIPITSVASXXXXXXXXXXXTVNPFVSVATANAKILVELEXXXXXXXXXXGRGEQQISHHWHKSGXSIGKAFATTLQGAQRLVSXXXXXXXFGSVGGIFNSIGKAVHQVFGGAFRLXXXXXXXXXXXXXXXLLVWMGISSRDKSIALTFLAIGGVLLFLSINVHADTGCAIDLKRQELRCGXXXFIHNDVEAWIDRYRYHPETPQGLARVIHNAHQEGTCGLRSASRLEHQMWEAIKDELNTPFKENGIDLTVVVEKQSGLXXXAPRRLAATTENLEIGWKAXXXSIIFAPELANHTFVIDGPETKECPSXDRAWNSLEXXXXXXXLTSTRMFMKVRESNTTECDSKTIGTAIKNNLAIHXXXSYWIESRLNHTWKLERAXXXXXXXXXXXXXHTLWGEGVLESDLIIPITLAGPKSNHNKRXXXXXXXXXXWDEGRIEIDFDYCPGTTVTLRXRCGHRGPAIRTTTESGXXXXXXXXXXXTLPPLRYRTESGCWYGMEIRPLKHDEKTLVQSKVNAYKSDMIDPXQLGLLVVFLATQEVLRRRWTAKISVPAIIIALLVLVLGGITYTDVLRYVILVGAAFMEAXXXXXXXXXALMATFKIQPAFMVASFLKTKWTNHENILLMLXXVFFQMAYYDARXXXXWNMPDVLNSLAVAWMILRAIGFTTTSNVVVPLLAFLTPGLKCLNLDVSKILLLMVGVGSLVKERRSAVAKKKGASLICLALAXXXXFSPLILAAGLMACDPNRKXXXXXXXXXXXXXXXXXXXXXLAELDMDSMAIPMXXAGLMFAAYVITGRXXXXXIERTADISWEGDVEITGSSDRVDVRLDDDEDFQLMNDPXXPWKIWMLRMTCLAVSAYXXWAILPSIVGFWITLXXXXXXXXXXXTPSPREYRKGDTTTGXXXXXXXXXXXXXXXXXXXXXXXXXXXXXXXXXXXXXXXXXXXXXXXXXXXXXXXXXXGGPWKLQRKWNGLDEVQMIVVEPGKNAKNVQTKPXXXXXXXXXXXXXXXXXXXXXXXSPIVDKNSDVIGLXXXGVIMPSGSYISAIXXGERMDEPVPAGFDSEMLKKKQITVLXXXXXXXXXXKILPQIIREAINKRLRTAILXXXRVVASEMAEALRXXXXRYQTSAVHREHTGNEIVDVXXXXXXXXXXXXXXXXXXXXXXXXXXXXXXXXXXXXARGYISTRVELGEXXXXXXXXXXXGTSDPFPESNAPVXDIQTEIPDRXXXXXYEWITEYVGKTVWFVXXXXXXXXXXXXXQRAGKRVIQLNRKXXXXXXXXXXXXXXXXXXXXXXXXMGANFRASRVIDSXXSVKPTIITDGEARVVLGEPSAIXXXXXXXXRGRIGRNPTQVGDEYXXXXXTNEDDSNLAHWTEARXXXXXXXXPNGLIAQLYQPEREKVYTMEGEYRXXXXXXXXXXXXXXXXXXPVWLAYQVAAAGVPYHDRRWCXXXXRTNMILEDNNEXXXXXXXXXXKILRPRWVDARVYSDHQALKLFKDFAAGRRSQIGLVEVIGRMPEHFMVKTWEALXXXXXVATADRGGRAHRSALEELPDALQTIVLIALLSVMTLGIFFLLMQRXXXGKIGLGGVXLGLATFFCWMADVPGTKIAXXXXXXXXXXXXXXXXXXXXXXXXXXXXAMFLICVLTLVGTVAANEMGWLDRTKSDIXXXXXXXXXXXXXXXXXESLLLDLKPAXAWSLYAVATAFLTPLLKHVXXXXXXXXXXXXXNVQASALYSLARGFPFXXXXISSLLLAVXXXXXXXLTVTVTSATLLLCHYAXXXXXXXXXXXXXXXXXXXXGIMKNAVIDGMVAXXXXELERATPMMQKKVGQIMLILVSTAALVVNPSVKXVREAGILVTAAAVTLXXXXXXXXXXXXXXXXXXXXXXXXWLSCLSMTWTLIKNMGKPGLKRGXXXXXXLGEVWKDRLNRMTKEEFTRYRREAITEVDRSAAQXARKERNVTGGYPVSRGTAXXXXXXERRFLDPIGKVVDLGXXXXXXXXXXXXXXXXXXXXXXXXXXXXXXXXXXXXXXXXXXXXXXXXXXVYYRASESCDTLLCDXXXXXXXXEVEEHRTLRVLEMVEXXXXRGPKEFCVKVLXXXXXKVIEKMEVLQRRYGGXXXXXXXXXXXXXXXYWVSRASGNIVHAVNMTSQVXXXXXEKKTWKGPHYEEDANLGXXXXXXXXPLLNSDTRKIKSRVERLKKEYGSTWHXDDNHPYRTWXYHGSYEVNPLVSASSXXXXXXXXXXKPWDTITSVTTMXXXXXXXXXXXXXXXXXXXXXAPEPPEGAKXXXXXTTNWLWAFLSRNKRPRMCSREEFIKKVNSNAAXXXXFEEQNQWKSAREAVEDPKFWEIVDEEREAHLRGECYTCIYNMMXXXXXXXXXXXXXXXXXXXXXXXXXXXXXXXXXXXXXXXXXXXXXXXXXXXXXXXXXQKLGYVLREVGXXXGGRVYADDTAGWDTPITKADLEXXXKVLELLEGEHRRLARSIIELTYCHKVVKVMRPAVGGKTVMDIISXXXXXXXXXXXXXXLNPFSNLAVQLVRRREGEGVIGPYDVEKLEKRKGPKVRTWLSENGEERLGRMAXXXXXXXXXXLDDRFASSLHFLNAMSQVRKDXXXXXXXXXXXXXXXXXXXXXXXXXXXXXXXXXXXXXXXXXXXXXXXXXXXXXXXXXXXXXXXXXXXXXXXXXXXXXXXXXXXXXXXXICSAVPADWVPTGRTTWSIHARGEWMTTADMLGVWNRVWIXXXXXXXXXXPVERWSDIPYSXXXXXXXXGSLIGTRSRATWAENXQVAIGQVRSIIGEEKYVDYMGSLKRYEEPXXXXXXXX

SEQ ID NO: 265780 - protein, 3434 aa, West Nile virus
  MOD_RES (1)..(13): Any amino acid
  MOD_RES (32)..(36): Any amino acid
  MOD_RES (49)..(51): Any amino acid
  MOD_RES (60)..(63): Any amino acid
  MOD_RES (75)..(85): Any amino acid
  MOD_RES (111)..(121): Any amino acid
  MOD_RES (144)..(144): Any amino acid
  MOD_RES (185)..(188): Any amino acid
  MOD_RES (204)..(220): Any amino acid
  MOD_RES (236)..(271): Any amino acid
  MOD_RES (287)..(319): Any amino acid
  MOD_RES (341)..(342): Any amino acid
  MOD_RES (354)..(354): Any amino acid
  MOD_RES (368)..(370): Any amino acid
  MOD_RES (379)..(379): Any amino acid
  MOD_RES (388)..(405): Any amino acid
  MOD_RES (424)..(449): Any amino acid
  MOD_RES (468)..(468): Any amino acid
  MOD_RES (480)..(487): Any amino acid
  MOD_RES (500)..(512): Any amino acid
  MOD_RES (535)..(555): Any amino acid
  MOD_RES (567)..(647): Any amino acid
  MOD_RES (666)..(680): Any amino acid
  MOD_RES (689)..(695): Any amino acid
  MOD_RES (708)..(718): Any amino acid
  MOD_RES (736)..(758): Any amino acid
  MOD_RES (774)..(780): Any amino acid
  MOD_RES (789)..(792): Any amino acid
  MOD_RES (807)..(813): Any amino acid
  MOD_RES (853)..(854): Any amino acid
  MOD_RES (869)..(870): Any amino acid
  MOD_RES (888)..(890): Any amino acid
  MOD_RES (908)..(911): Any amino acid
  MOD_RES (937)..(937): Any amino acid
  MOD_RES (946)..(953): Any amino acid
  MOD_RES (980)..(989): Any amino acid
  MOD_RES (1005)..(1019): Any amino acid
  MOD_RES (1044)..(1080): Any amino acid
  MOD_RES (1096)..(1107): Any amino acid
  MOD_RES (1150)..(1154): Any amino acid
  MOD_RES (1166)..(1169): Any amino acid
  MOD_RES (1206)..(1223): Any amino acid
  MOD_RES (1249)..(1254): Any amino acid
  MOD_RES (1266)..(1269): Any amino acid
  MOD_RES (1300)..(1312): Any amino acid
  MOD_RES (1343)..(1358): Any amino acid
  MOD_RES (1374)..(1397): Any amino acid
  MOD_RES (1408)..(1430): Any amino acid
  MOD_RES (1446)..(1455): Any amino acid
  MOD_RES (1465)..(1471): Any amino acid
  MOD_RES (1485)..(1511): Any amino acid
  MOD_RES (1527)..(1585): Any amino acid
  MOD_RES (1601)..(1603): Any amino acid
  MOD_RES (1618)..(1672): Any amino acid
  MOD_RES (1694)..(1711): Any amino acid
  MOD_RES (1727)..(1731): Any amino acid
  MOD_RES (1742)..(1746): Any amino acid
  MOD_RES (1758)..(1801): Any amino acid
  MOD_RES (1815)..(1853): Any amino acid
  MOD_RES (1868)..(1934): Any amino acid
  MOD_RES (1953)..(1964): Any amino acid
  MOD_RES (1975)..(1983): Any amino acid
  MOD_RES (1999)..(2022): Any amino acid
  MOD_RES (2031)..(2050): Any amino acid
  MOD_RES (2069)..(2100): Any amino acid
  MOD_RES (2110)..(2119): Any amino acid
  MOD_RES (2143)..(2157): Any amino acid
  MOD_RES (2169)..(2174): Any amino acid
  MOD_RES (2197)..(2201): Any amino acid
  MOD_RES (2210)..(2210): Any amino acid
  MOD_RES (2221)..(2259): Any amino acid
  MOD_RES (2275)..(2278): Any amino acid
  MOD_RES (2287)..(2303): Any amino acid
  MOD_RES (2313)..(2317): Any amino acid
  MOD_RES (2334)..(2349): Any amino acid
  MOD_RES (2360)..(2389): Any amino acid
  MOD_RES (2398)..(2446): Any amino acid
  MOD_RES (2465)..(2470): Any amino acid
  MOD_RES (2484)..(2507): Any amino acid
  MOD_RES (2531)..(2539): Any amino acid
  MOD_RES (2562)..(2562): Any amino acid
  MOD_RES (2571)..(2571): Any amino acid
  MOD_RES (2584)..(2599): Any amino acid
  MOD_RES (2611)..(2660): Any amino acid
  MOD_RES (2673)..(2688): Any amino acid
  MOD_RES (2699)..(2718): Any amino acid
  MOD_RES (2734)..(2748): Any amino acid
  MOD_RES (2766)..(2775): Any amino acid
  MOD_RES (2790)..(2799): Any amino acid
  MOD_RES (2825)..(2825): Any amino acid
  MOD_RES (2835)..(2835): Any amino acid
  MOD_RES (2849)..(2894): Any amino acid
  MOD_RES (2903)..(2909): Any amino acid
  MOD_RES (2940)..(2944): Any amino acid
  MOD_RES (2968)..(3057): Any amino acid
  MOD_RES (3069)..(3097): Any amino acid
  MOD_RES (3107)..(3115): Any amino acid
  MOD_RES (3126)..(3156): Any amino acid
  MOD_RES (3179)..(3209): Any amino acid
  MOD_RES (3218)..(3312): Any amino acid
  MOD_RES (3353)..(3417): Any amino acid
  MOD_RES (3427)..(3434): Any amino acid
XXXXXXXXXXXXXVNMLKRGKPRGGSLMGLKXXXXXLIDGKGPVRFVLXXXVFFRFTAIXXXXAVLNRWRGVNKXXXXXXXXXXXKELGTLTNAMSRRSAKQKKRGGVVGXXXXXXXXXXXGAVTLSDFQGKVIMTINATDTTXAITIPTAAGKNLCTVRAMDVGHMCDDTITYECSVLSAGNDXXXXDCWCTKLPVYVRYGRXXXXXXXXXXXXXXXXXTHGKSTLSNKKGAWMXXXXXXXXXXXXXXXXXXXXXXXXXXXXXXXXXXXXTMQRVVFAVLLLLVAXXXXXXXXXXXXXXXXXXXXXXXXXXXXXXXXXCVTIMSKNKPTIDVKMMNVEAXXLAGVRDYCYLAXVSELSTKAACPAMXXXHNDKRADSXYFCKQGVVXXXXXXXXXXXXXXXXXXCARFTCSNKATGLTIQREXXXXXXXXXXXXXXXXXXXXXXXXXXGAAQAGRLTITPAAPSHTXKLGDYGEVTIDXXXXXXXXTSAYYVMTVGAKXXXXXXXXXXXXXLPWSSAAGTVWRNRETFMEFEEXXXXXXXXXXXXXXXXXXXXXLAGTIPVEFSSXXXXXXXXXXXXXXXXXXXXXXXXXXXXXXXXXXXXXXXXXXXXXXXXXXXXXXXXXXXXXXXXXXXXXXXXXXXXXXXXXVNPFVSMSTADAKVLIELXXXXXXXXXXXXXXXHQINHHWHXXXXXXXKAFTATLKGAQRXXXXXXXXXXXGSVGGVFTSVGQAIHQVXXXXXXXXXXXXXXXXXXXXXXXLLWMGVNSRDRSIALXXXXXXXVLLFLSINXXXXTGCAIDVGRQELRCXXXXXXXNDVEAWTDRYKFHPETPQGLAKVIQKAHAEGVCGLRSASXXEHQMWESIKDELNTXXKENGVDLSMVVEKQGGMXXXAPRRLTATTEKFEIGWKXXXXSILFAPEIANNTFVVDGSETRECPTXSRAWNSMEXXXXXXXXMTTRMFLKIREGNTTECDSKIIGTAIXXXXXXXXXXSYWIESGLNHTWKLEXXXXXXXXXXXXXXXHTLWGEGVVESELIIPVTLAGPKSXXXXXXXXXXXXXXXXXXXXXXXXXXXXXXXXXXXXXNCEHRGPSARTTTESXXXXXXXXXXXXTLPPLRFQTDNGCWYGMEIRPLKHDERTLVQSRVNAYNAEMIXXXXXGLLIVFLATQEXXXXRWTAKISLPAILIALLVLVFGGVTYADVLRYIILVGXXXXXXXXXXXXXXXXXXATFRVQPVFMVASFLKARWTNHENIXXXXXXAFFQMAYIDSQXXXXWEMPDVLNSLAIAWMILRAITFTSTSNVVVXXXXXXXXXXXXXNLDVYRILLLMIGIGSLIKERRNAAAKKKGXXXXXXXXXXXXXXXXMILVAGLLACDPNRKXXXXXXXXXXXXXXXXXXXXXXXXLDIDTMAIPMXXXXXXXXXXXXXXXXXXXXXXXVADISWENDAEITGSXXXXXXXXXXGGNFQLMSDXXXXXXXWILRMACLAVSAYXXXXXXXXXXXXXXXXXXXXXXXXXXXTPSPKEYEKGDTTTGXXXXXXXXXXXXXXXXXXXXXXXXXXXXXXXXXXXXXXXXXXXXXXXXXXXXXXXXXXXGPWKLQHRWNGQDEVXXXVAKPGRKTRNVQTKXXXXXXXXXXXXXXXXXXXXXXXXXXXXXXXXXXXXXXXXXXXXXXXXXXXXXXXGERMDEPIPVGFEPETLKKKQXXXXXXXXXXXXXXXXXXQIIKEAMSKRLRTAIXXXXXVVAAEMADALXXXXXRYQTSAVAREHXXXXXXXXXXXXXXXXXXXXXXXXXXXXXXXXXXXXXXXXXXXXAGGYISTRVELGDXXXXXXXXXXXXXXXXXXXXXXXXXXXXXXXXXXXXXXXYEWITEFVGKTVWFXXXXXXXXXXXXXXXXXXXXXXXXXXXXXXXXXXXXXXXXXXXXXXXXXXXXXXXXXXXXXXXXXXXVKPTSITEGESRVVLGEPXXXXXXXXXXXXGRVGRNPSQVXXXXXXXXXTNEDDSNYAHWTEARXXXXXXXXXXXXXXXXXXXXXXXXCTMDGEYRXXXXXXXXXXXXXXXXXXXXWLAYKVASAGISYHDRRWXXXXXXXXXXXXXXXXXXXXXXXXXXXXXXXXWIDARVYLDXXXXXXXXXXASGKRSQIGFIEVLGRMPEHFMVXXXXXXXXXXXXXXXEKGGRAHRSALXXXXXXLQTIALIALLSVMSMGIFFLLMXXXXXGKIGLGGIXLGVATLFCWMXXXXXXXXXXXXXXXXXXXXXXXXXXXXXXXXXXXXXXXFMICVLTFISAVAANXXXXLDKTKSDVXXXXXXXXXXXXXXXXXEDLLLDLKPXXXXXLYAVSTAVLTPLIKHLXXXXXXXXXXXXXXXXASTLFTLARGXXXXXXXXXXXXXXXXXXXXXXXXXXXXXXVLLFCHYAXXXXXXXXXXXXXXXXXXXXXXXXXXXXXXXXXXXXXXXXXXXXXXXXXIGQIILILVSLAALVVNPXXXXXXEAGILTSAAAVTLXXXXXXXXXXXXXXXXXXXXXXXXWLSCLSIMWTLIKSLEKPVLKRGXXXXXXXXXVWKERLNYMSKEEFSRYRKEAIXEVDRSTAKXARREGNVTGGHSXXXXXXXXXXXXXXXXVEPIGKVIDLGXXXXXXXXXXXXXXXXXXXXXXXXXXXXXXXXXXXXXXXXXXXXXXXXXXVFYRPSESCDTLXXXXXXXXXXXXXXXXRTMRVLEMVEXXXXXXXXXXXXXXXXXXXXKVIEKMEILQRRYGGXXXXXXXXXXXXXXXYWVSQASGNIVHAVNMTXXXXXXXXXXKTWKGAQYEEDANLXXXXXXXXXXLLNSDTSKIKNRIEKLKREYSLTWHXDGNHPYRTWXYHGSYDVNPTGSAXXXXXXXXXXXXXXXXXXXXXXXXXXXXXXXXXXXXXXXXXXXXXXPEPPEGVRXXXXXXXNWLWAYLARGKRPRMCTREEFISKVNSNAAXXXXXEEQNQWSNAREAVEDSTFWEMVDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKIFADDTAGXXXXXXXXXXXXXXXXXXXXXXXXXXXXXAIIQLTYRHXXXXXXXXXADRKTVMDVIXXXXXXXXXXXXXXXXXXXXXXXXXXXXXXXGEGVIGPDDVERLGRGKGPKVRXXXXXXXXXXXXXXXXXXXXXXXXXXXXXXXTSLHFLNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXICSAVPVDWVPTGRTTWSIHVRGEWMTTEDMLSVWNRVWIXXXXXXXXXXXXXXXXXXXXXXXXXXXXXXXXXXXXXXXXXXXXXXXXXXXXXXXXXXXXXXXXXGSLRRYEDAXXXXXXXX

SEQ ID NO: 265781 - protein, 3434 aa, West Nile virus
  MOD_RES (1)..(13): Any amino acid
  MOD_RES (28)..(85): Any amino acid
  MOD_RES (94)..(95): Any amino acid
  MOD_RES (110)..(121): Any amino acid
  MOD_RES (130)..(135): Any amino acid
  MOD_RES (144)..(144): Any amino acid
  MOD_RES (153)..(165): Any amino acid
  MOD_RES (174)..(189): Any amino acid
  MOD_RES (198)..(220): Any amino acid
  MOD_RES (229)..(272): Any amino acid
  MOD_RES (287)..(342): Any amino acid
  MOD_RES (353)..(354): Any amino acid
  MOD_RES (365)..(451): Any amino acid
  MOD_RES (467)..(487): Any amino acid
  MOD_RES (500)..(513): Any amino acid
  MOD_RES (530)..(648): Any amino acid
  MOD_RES (664)..(792): Any amino acid
  MOD_RES (807)..(813): Any amino acid
  MOD_RES (832)..(836): Any amino acid
  MOD_RES (848)..(854): Any amino acid
  MOD_RES (868)..(871): Any amino acid
  MOD_RES (888)..(890): Any amino acid
  MOD_RES (907)..(918): Any amino acid
  MOD_RES (937)..(961): Any amino acid
  MOD_RES (973)..(996): Any amino acid
  MOD_RES (1005)..(1020): Any amino acid
  MOD_RES (1035)..(1081): Any amino acid
  MOD_RES (1091)..(1109): Any amino acid
  MOD_RES (1118)..(1125): Any amino acid
  MOD_RES (1137)..(1139): Any amino acid
  MOD_RES (1148)..(1156): Any amino acid
  MOD_RES (1165)..(1177): Any amino acid
  MOD_RES (1189)..(1194): Any amino acid
  MOD_RES (1203)..(1232): Any amino acid
  MOD_RES (1249)..(1254): Any amino acid
  MOD_RES (1263)..(1269): Any amino acid
  MOD_RES (1279)..(1323): Any amino acid
  MOD_RES (1341)..(1358): Any amino acid
  MOD_RES (1374)..(1430): Any amino acid
  MOD_RES (1446)..(1471): Any amino acid
  MOD_RES (1485)..(1511): Any amino acid
  MOD_RES (1525)..(1589): Any amino acid
  MOD_RES (1600)..(1674): Any amino acid
  MOD_RES (1685)..(1712): Any amino acid
  MOD_RES (1727)..(1746): Any amino acid
  MOD_RES (1757)..(1939): Any amino acid
  MOD_RES (1952)..(2053): Any amino acid
  MOD_RES (2063)..(2122): Any amino acid
  MOD_RES (2135)..(2183): Any amino acid
  MOD_RES (2196)..(2201): Any amino acid
  MOD_RES (2210)..(2210): Any amino acid
  MOD_RES (2219)..(2261): Any amino acid
  MOD_RES (2270)..(2303): Any amino acid
  MOD_RES (2313)..(2450): Any amino acid
  MOD_RES (2462)..(2512): Any amino acid
  MOD_RES (2530)..(2539): Any amino acid
  MOD_RES (2556)..(2660): Any amino acid
  MOD_RES (2673)..(2718): Any amino acid
  MOD_RES (2727)..(2750): Any amino acid
  MOD_RES (2762)..(2775): Any amino acid
  MOD_RES (2789)..(2801): Any amino acid
  MOD_RES (2825)..(2825): Any amino acid
  MOD_RES (2835)..(2917): Any amino acid
  MOD_RES (2934)..(2947): Any amino acid
  MOD_RES (2959)..(3057): Any amino acid
  MOD_RES (3068)..(3116): Any amino acid
  MOD_RES (3125)..(3158): Any amino acid
  MOD_RES (3171)..(3341): Any amino acid
  MOD_RES (3350)..(3418): Any amino acid
  MOD_RES (3427)..(3434): Any amino acid
XXXXXXXXXXXXXVNMLKRGKPRGGSLXXXXXXXXXXXXXXXXXXXXXXXXXXXXXXXXXXXXXXXXXXXXXXXXXXXXXXXXXXKELGTLTNXXNRRSEKKKKRGGSIXXXXXXXXXXXXRAVTLSNFXXXXXXTVNATDVAXIITIPPAAXXXXXXXXXXXXXFMCDDTITXXXXXXXXXXXXXXXXCWCTKAAVXXXXXXXXXXXXXXXXXXXXXXXTHGKSTLAXXXXXXXXXXXXXXXXXXXXXXXXXXXXXXXXXXXXXXXXXXXXMQRVVFIVLLLLVAXXXXXXXXXXXXXXXXXXXXXXXXXXXXXXXXXXXXXXXXXXXXXXXXXXXXXXXXLAEVRSYCHLXXVNELSTRAACXXXXXXXXXXXXXXXXXXXXXXXXXXXXXXXXXXXXXXXXXXXXXXXXXXXXXXXXXXXXXXXXXXXXXXXXXXXXXXXXXXXXXXXTQAGRFSVTPAAPSYXXXXXXXXXXXXXXXXXXXXXTGAYYVMSVGSKXXXXXXXXXXXXXXPWSSAGGTAWRNRETLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNPFVAAATADAKVLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTGCAIDVSRQELRCXXXXXXXNDVEVWMDRYKYHPETPQXXXXXIQKAHESGTCGXXXXXXXEHQMWDSVKDELNXXXXENGVDLTVVVEKQDGLXXXAPKRLKATTDKLEIGWXXXXXXXXXXXXLANSTFVVDGPETEECPSXXXXXXXXXXXXXXXXXXXXXXXXXVRKVNTTECDAXXXXXXXXXXXXXXXXXXXXXXXXFNETWKLEXXXXXXXXXXXXXXXXTLWGDGVIESELIIXXXXXXXXXXXXXXXXXXXXXXXXXXXXXXXXXXXXXXXXXXXXXXXCGHRGPSARXXXXXXXXXXXXXXXXXXXPPLRFKTEXXXXXXXXIRPQKHDERTLXXXRVSAYKSDXXXXXXXXXLVVVLATQXXXXXXXXXXXXXPAILLALLVLVXXXXXXTDVLRYVNXXXXXXXXXXXXXXXXXXXXXXXXXXXXXXVVATFVKARWTNQENTXXXXXXAFFQMAYHXXXXXXXWGIPDVLNSXXXXXXXXXXXXXXXXXXXXXXXXXXXXXXXXXXXXXXXXXXXXXVGIGSLIKEKKNSAAKKXXXXXXXXXXXXXXXXXXITLAAGLVACDPNRKXXXXXXXXXXXXXXXXXXXXXXXXXXXXXXXXXXXXXXXXXXXXXXXXXXXXXXXXXTADISWESDVEITGSXXXXXXXXXXXXXXXXXXXXXXXXXXWMLRMFCLAISAYXXXXXXXXXXXXXXXXXXXXXXXXXXXTPSPKEYEKGDTTXXXXXXXXXXXXXXXXXXXXXXXXXXXXXXXXXXXXXXXXXXXXXXXXXXXXXXXXXXXXXXXXXLGCKWNGQDEXXXXXXXXXXXXXXXXXXXXXXXXXXXXXXXXXXXXXXXXXXXXXXXXXXXXXXXXXXXXXXXXXXXXXXXXXXXRMEEPVPSGFXXXXXXXXXXXXXXXXXXXXXXXXXXXXIIKEAIDRRLRTAVXXXXXXXXXXXXXXXXXXXXRYQTSAVNREXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITDGESRVVLGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHKVASAGISXXXXXXXXXXXXXXXXXXXXXXXXXXXXXXXXXXXXXXXXXXXXXXXXXXXXXXXXXXXXKRSQMGLIEVLGXXXXXXXXXXXXXXXXXXXXXXXXXXXXXXXXXXXXXXXXXXXXXXXXXLSVMTMGVFLLLXXXXXXSKIGLAGVXLAVATFFCXXXXXXXXXXXXXXXXXXXXXXXXXXXXXXXXXXXXXXXXXXXICVMTLVGXXXXXXXXXXXXXXXXXXXXXXXXXXXXXXXXXXANFLLDLRPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMLIWVSLAAVVXXXXXXXXXXXXXXXXXXXXXXXXXXXXXXXXXXXXXXXXXXXXXXXXXXXSIAWTLIKNMEKPVLKRXXXXXXXXXXAWKEKLNQMTKEEFARXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFYRTSEASDTLXXXXXXXXXXXXXXXXXXXXXXXXXXXXXXXXXXXXXXXXXXXXXXRVIEKMETXXXXXXXXXXXXXXXXXXXXXXXXVSRASSNVVHSXXXXXXXXXXXXXXKTWKGPQYEEDVSXXXXXXXXXXXXXSSDTSKINNRIERLKREYGSTWHXDSNHPYRTWXXXXXXXXXXXXXXXXXXXXXXXXXXXXXXXXXXXXXXXXXXXXXXXXXXXXXXXXXXXXXXXXXXXXXXXXXXXXXXXXXXXRDKRPRLCSREEFISKXXXXXXXXXXXXXXNQWRSARAAVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKIFADDTAXXXXXXXXXXXXXXXXXXXXXXXXXXXXXXXXXXXXXXXXXXXXXXXXXDGKTVMSLXXXXXXXXXXXXXXXXXXXXXXXXXXXXXXXXXXGVIGPEDVEKLTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDMLGVWNKXXXXXXXXXXXXXXXXXXXXXXXXXXXXXXXXXXXXXXXXXXXXXXXXXXXXXXXXXXXXXXXXXXXXXSLKRYEDVXXXXXXXX

SEQ ID NO: 265782 - protein, 3434 aa, West Nile virus
  MOD_RES (112)..(121): Any amino acid
  MOD_RES (144)..(144): Any amino acid
  MOD_RES (341)..(344): Any amino acid
  MOD_RES (354)..(354): Any amino acid
  MOD_RES (379)..(379): Any amino acid
  MOD_RES (444)..(449): Any amino acid
  MOD_RES (468)..(468): Any amino acid
  MOD_RES (498)..(498): Any amino acid
  MOD_RES (522)..(522): Any amino acid
  MOD_RES (602)..(602): Any amino acid
  MOD_RES (842)..(842): Any amino acid
  MOD_RES (885)..(896): Any amino acid
  MOD_RES (937)..(937): Any amino acid
  MOD_RES (1080)..(1081): Any amino acid
  MOD_RES (1266)..(1269): Any amino acid
  MOD_RES (1355)..(1355): Any amino acid
  MOD_RES (1839)..(1839): Any amino acid
  MOD_RES (2210)..(2210): Any amino acid
  MOD_RES (2287)..(2303): Any amino acid
  MOD_RES (2519)..(2519): Any amino acid
  MOD_RES (2571)..(2571): Any amino acid
  MOD_RES (2821)..(2825): Any amino acid
  MOD_RES (2903)..(2903): Any amino acid
  MOD_RES (3055)..(3057): Any amino acid
  MOD_RES (3168)..(3170): Any amino acid
  MOD_RES (3426)..(3434): Any amino acid
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIXXXXXXXXXXGAVTLSNFQGKVMMTVNATDVTXVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAXXXXEVRSYCYLAXVSDLSTKAACPTMGEAHNDKRADPXFVCRQGVVDRGWGNGCGLFGKGSIDTCAKFACSTKAIGRTILKENIKYEVAIFVHGPTTVESHGXXXXXXGATQAGRFSITPAAPSYTXKLGEYGEVTVDCEPRSGIDTNAYYVMTVGXKTFLVHREWFMDLNLPWSSAGSTXWRNRETLMEFEEPHATKQSVIALGSQEGALHQALAGAIPVEFSSNTVKLTSGHLKCRVKMEKLQLKGTTYGVCSKAFKFXGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHXEGVCGLRSVSRLEHQMWEAVKDELNTLLKENGVDLSVVVEKQXXXXXXXXXXXXATTEKLEIGWKAWGKSILFAPELANNTFVVDGPETKECPTXNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSXXCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYHDARXXXXWEIPDVLNSLAVAWMILRAITFTTTSNVVVPLLALLTPGLRCLNLDVYRILLLMVGIGSLIREKRSAAAKKKGASLLCLALASTGXFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPIXDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAXLGVATFFCWMAEVPGTKIAGMLLLSLLLMIVLIPEPEKQRSQTDNQLAVFLICVMTLVSAVAANEMGWLDKTKSDIXXXXXXXXXXXXXXXXXGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLXKNMEKPGLKRGGAKGRTLGEVWKERLNQMTKEEFTRYRKEAIIEVDRSAAKXARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSXXXXXDENHPYRTWNYHGSYDVKPTGSASSLVNGVVRLLSKPWDTITNVTTMAMTDTTPFGQQRVFKEKVDTKAPEPPEGVKXVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGXXXGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEXXXKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDXXXXXXXXX

SEQ ID NO: 265783 - protein, 3434 aa, West Nile virus
  MOD_RES (1)..(2): Any amino acid
  MOD_RES (112)..(121): Any amino acid
  MOD_RES (144)..(144): Any amino acid
  MOD_RES (289)..(289): Any amino acid
  MOD_RES (341)..(344): Any amino acid
  MOD_RES (354)..(354): Any amino acid
  MOD_RES (379)..(379): Any amino acid
  MOD_RES (392)..(401): Any amino acid
  MOD_RES (444)..(449): Any amino acid
  MOD_RES (468)..(468): Any amino acid
  MOD_RES (498)..(498): Any amino acid
  MOD_RES (522)..(522): Any amino acid
  MOD_RES (602)..(602): Any amino acid
  MOD_RES (640)..(642): Any amino acid
  MOD_RES (751)..(755): Any amino acid
  MOD_RES (842)..(842): Any amino acid
  MOD_RES (885)..(896): Any amino acid
  MOD_RES (937)..(937): Any amino acid
  MOD_RES (1008)..(1016): Any amino acid
  MOD_RES (1080)..(1081): Any amino acid
  MOD_RES (1266)..(1269): Any amino acid
  MOD_RES (1355)..(1355): Any amino acid
  MOD_RES (1376)..(1391): Any amino acid
  MOD_RES (1503)..(1507): Any amino acid
  MOD_RES (1552)..(1558): Any amino acid
  MOD_RES (1767)..(1779): Any amino acid
  MOD_RES (1797)..(1798): Any amino acid
  MOD_RES (1818)..(1819): Any amino acid
  MOD_RES (1839)..(1839): Any amino acid
  MOD_RES (1898)..(1903): Any amino acid
  MOD_RES (1981)..(1982): Any amino acid
  MOD_RES (2210)..(2210): Any amino acid
  MOD_RES (2247)..(2250): Any amino acid
  MOD_RES (2287)..(2303): Any amino acid
  MOD_RES (2342)..(2343): Any amino acid
  MOD_RES (2519)..(2519): Any amino acid
  MOD_RES (2571)..(2571): Any amino acid
  MOD_RES (2592)..(2592): Any amino acid
  MOD_RES (2616)..(2621): Any amino acid
  MOD_RES (2639)..(2643): Any amino acid
  MOD_RES (2821)..(2825): Any amino acid
  MOD_RES (2852)..(2858): Any amino acid
  MOD_RES (2876)..(2889): Any amino acid
  MOD_RES (2903)..(2903): Any amino acid
  MOD_RES (2941)..(2942): Any amino acid
  MOD_RES (2988)..(2991): Any amino acid
  MOD_RES (3004)..(3023): Any amino acid
  MOD_RES (3055)..(3057): Any amino acid
  MOD_RES (3133)..(3134): Any amino acid
  MOD_RES (3168)..(3170): Any amino acid
  MOD_RES (3199)..(3201): Any amino acid
  MOD_RES (3228)..(3230): Any amino acid
  MOD_RES (3250)..(3251): Any amino acid
  MOD_RES (3278)..(3288): Any amino acid
  MOD_RES (3306)..(3310): Any amino acid
  MOD_RES (3379)..(3380): Any amino acid
  MOD_RES (3426)..(3434): Any amino acid
XXKKPGGPGKNRAVNMQKRGMPRGLSLTGLKRAMLSLIDGRGPTRFVLALLTFFKFTAIAPTRALLDRWRGVRKQTAMKHLLSFKKELGALTNAMNRRSTKQKKRGGTAGFXXXXXXXXXXSALTLSNFQGKVMMTVNATDITXIITIPTAAGKNLCTVRAMDVGYLCEDTITYECPVLAEGNDPEDIDCWCTKSSVFVRYGRCTRTRNSRRSRRSLNVQVHGESSLANKKGAWLDSTKASRYLMKAESWILRNPGYALVAVVTGWMLGSNTMQRVVFAILLLLVAPAXSFNCLGMSNRDFIEGASGATWMDLVLEGDSCVTIMAKDRPTIDVKMVTMGAXXXXDVRSYCYLAXVSDLSTRAACPTMGEAHNEKRADPXFVCKQGVVDRGWXXXXXXXXXXSIDTCAKFACSTKATGWIIQRENVKYEVAAFVHGPTTVDTHSXXXXXXAAVQAGRFSITPSAPSYTXTLGDYGEVTFDCEPRSGIDTSAYYVMSVGXKSFLVHREWFTDLNLPWSSPGNTXWRNREALVEFEEPHATKQSVVALGSQEGALHQALAGAIPVDYKNSVVKLSSGHLKCRVRMEKLKLKGTTYGVCAKAFRFXRTPADTGHGTVVMELQYTGTDGPCKIPITSVASLNDLXXXGRLVTVNPYVSVATANSKILVELEPPFGDSYIVIGKGDQQVTHHWYKSGSSIGKAFTTTLRGAQRLVSLGDTAWDFGSIGGVFTSVGKAIHQLFGGAFRLLFGGMSWIXXXXXGALLLWMGINARDRSIAMTFLAIGGILLFLSANVHADTGCAIDIGRQELRCGNGVFIHNDVEAWVDRYKFHPETPQGLAKIIHNAHXEGVCGVRSVSRLEHQMWESIKDELNTLLKENGVDLSIVVEKQXXXXXXXXXXXXATTEKLEMGWKAWGKSIIFAPELANNTFVIDGPETEECPTXNRAWNSMEVEDFGFGLTSTRMFLRIRETNTTECDTKTIGTAVKNNMAVHSDLSYWIESGFNETWKLERAVXXXXXXXXXPETHTLWGDGVLESDLIIPITLAGLRSNHNRRPGYKTQSQGPWDEGRVELDFDYCPGTTVTISXXCGHRGPAARTTTESGKLISDWCCRSCTLPPLRFQTENGCWYGMEIRPTKHDEKTLVQSRVTAYNAEMIDPFQLGLMVVFLVTKEVLRKRWTAKISIPAIMLALLTLVFGGVTYTDLIRYIILVGAAFAEANSGGDVVHLALMATFKIQPVFLVASFLKTRWTNQESILLMLAAAFFQMAYYDAKXXXXWEVPDVLNSLSIAWMILRAISFTNTSNVATPLLALLTPGLKCLHLDIYRILLLMVGVGSLIKEKRSSAAKKKGACLICLALASTGXFNPMILAAGLITCDPNRKRGXXXXXXXXXXXXXXXXVGGLAELDIDSMAVPMTIAGLMFVAYVITGRSTDMWIERTADITWESDAEITGTSDRVDVKLDDDGNFQLISDPGAPWKIWMLRMACLAVSAYTPWAILPSVIGFWITLQYXXXXXVLWDTPSPREYKRGDTTTGVYRIMTRGILGSYQAGVGVMVEGVFXXXXXXXKGAALMSGTGRLDPYWGSVREDRLCYGGPWKLQHKWNGHDEVQMIVAEPGRNTRNVQTKPGVFKTPDGEIGAVTLDYPTGTSGSPIVDRSGDVIGLYGNGVIMPNGAYISAIVQGERMEEPAPAGFEPDTLKKKKISVLDLHPGAGKTRKILPQIIKEAINKRLRTAILAPTRVVAAEMSEALRGLPIRYQTSAVHREHSGNEIVDVMXXXXXXXXXXXXXRVPNYNLFIMDEAHFTDXXSIAARGYIATRVELGEAAAXXMTATPPGTSDPFPESNAPIXDMQTEIPDRAWNTGYEWITEYIGKTVWFVPSVRMGNEMAQCLQRAGKKVIQLNRKSYEXXXXXXKNDDWDFVVTTDISEMGANFKANRVIDSRKSVKPTIIEEGDNRVILGEPSAITAASAAQRRGRIGRNSSQAGDEYCYXXHTNEDDSNYAHWTEARIMPDNINMPNGLVAQLYQPEREKVYTMDGEYKLRGEERKNFLEFLRTADLPVWLAYKVAAAGISYHDRKWCFDGPRTNTVLEENTEVEIVTKMGERKILRPRWADARVYSDHQALKSFKDFAAGKRSQIGLVEVLGRMPEHFVVKTWEALDTMYVVATAEKGGRAHRTALEELPDALQTIALITLLSVMSLGVFCLLMQRKGIGKIGLGGTXLGAATFFCWMAEVSGTKIAGMLLLSLLMMIVLIPEPXXXXSQTDNQLAVFLICVLTLVGTVAANEMGWLDKTKNDIXXXXXXXXXXXXXXXXXESFLLDLKPATAWSLYAVSTAVMTPLLKHVITSDYINTXXTSINVQASALFTLSRGFPFVDVGVSALLLAVGCWGQVTLTVTVTSAALLLCHYAYMIPGWQAEAMRAAQRRTAAGIMKNAVIDGMVATDVPELERTTPVMQKKVGQVMLILVSMAAVVVNPSVRTVREAGILTSSAAVTLWENGAGSVWNATTAIGLCHVMRGGWLSCLSMTWTLXKNMDKPVLKRGGAKGRTLGEVWKERLNHLTKEEFTRYRKEAITEVDRSAAKXARREGNITGGHSVSRGTAKLXWLVERRFLEPVGKVVDLGCGRGGXXXXXXTQKRVQEVKGYTKGGPGXXXXXLVQSYGWNTVTMKSGVDVFYRPSEASDTLLCDIGESASSAEVEEHRTVRVLEMVEDWLHRGPKEFCIKVLCPYMPKVIEKMETLQRRYGGGLIRNPLSRNSTHEMYWVSHASGNIVNSVSMTSQVLLGRMEKKTWKGPQFEEDANLGSGTRAVGKPLLNSDTGKIRNRIERLKKEYSXXXXXDANHPYRTWNYHGSYDVRPTGSASSLXXXXXXXLSKPWDTITSVTTMAMTXXXXXXXXXXXXXXVDTKAPEPAEGVKXVLNETTNWLWTFLARDKKPRMCSREEFIGKVNSNAALXXMFEEQNQWKNARAAVEDPKFWEMVDDEREAHLRGECNTCIYNMMGXXXXKPGEFGKARGSRXXXXXXXXXXXXXXXXXXXXNEDHWLGRENSGGGVEGLGLQKLGYILKEVGXXXGGKMYADDTAGWDTRITKADLENEAKVLEFLEGEHRRLARSVIELTYCHKVVKVMRPAADGKTVMDIISREDQRGXXQVVTYALNTFTNLSFQLGRMMEGEGVVGPDDVEXXXKGKGVKVRVWLSENGKERLGRMAVSGDDXXXKPLDDRFATALHFLNDMSQVRKDIQEXXXSVGWYDWQQVQFCSNHFTEXXMKDGRTLVTPCRGQDELIGRARISPGXXXXXXXXXXXAKSYAQMWQLLYFHRRDXXXXXNAICSAVPVSWVPTGRTTWSIHAKGEWMTTEDMLAVWNKVWIEENEWMEDKTPVERWSDIPYSGKREDXXCGSLIGTRTRATWAENIHVAINQVRSVIGEEKYVDYMSSLRRYEDXXXXXXXXX

SEQ ID NO: 265784 - protein, 3434 aa, West Nile virus
  MOD_RES (1)..(8): Any amino acid
  MOD_RES (80)..(81): Any amino acid
  MOD_RES (112)..(121): Any amino acid
  MOD_RES (144)..(144): Any amino acid
  MOD_RES (244)..(270): Any amino acid
  MOD_RES (288)..(293): Any amino acid
  MOD_RES (314)..(316): Any amino acid
  MOD_RES (341)..(344): Any amino acid
  MOD_RES (354)..(354): Any amino acid
  MOD_RES (379)..(379): Any amino acid
  MOD_RES (389)..(403): Any amino acid
  MOD_RES (433)..(434): Any amino acid
  MOD_RES (444)..(449): Any amino acid
  MOD_RES (468)..(468): Any amino acid
  MOD_RES (498)..(510): Any amino acid
  MOD_RES (522)..(522): Any amino acid
  MOD_RES (544)..(554): Any amino acid
  MOD_RES (574)..(577): Any amino acid
  MOD_RES (590)..(591): Any amino acid
  MOD_RES (602)..(602): Any amino acid
  MOD_RES (612)..(613): Any amino acid
  MOD_RES (637)..(645): Any amino acid
  MOD_RES (668)..(675): Any amino acid
  MOD_RES (712)..(716): Any amino acid
  MOD_RES (744)..(756): Any amino acid
  MOD_RES (809)..(809): Any amino acid
  MOD_RES (842)..(842): Any amino acid
  MOD_RES (885)..(896): Any amino acid
  MOD_RES (910)..(910): Any amino acid
  MOD_RES (937)..(937): Any amino acid
  MOD_RES (947)..(951): Any amino acid
  MOD_RES (988)..(988): Any amino acid
  MOD_RES (1008)..(1018): Any amino acid
  MOD_RES (1056)..(1057): Any amino acid
  MOD_RES (1080)..(1081): Any amino acid
  MOD_RES (1098)..(1106): Any amino acid
  MOD_RES (1213)..(1219): Any amino acid
  MOD_RES (1266)..(1269): Any amino acid
  MOD_RES (1353)..(1355): Any amino acid
  MOD_RES (1375)..(1393): Any amino acid
  MOD_RES (1424)..(1426): Any amino acid
  MOD_RES (1502)..(1510): Any amino acid
  MOD_RES (1528)..(1534): Any amino acid
  MOD_RES (1544)..(1583): Any amino acid
  MOD_RES (1620)..(1640): Any amino acid
  MOD_RES (1656)..(1656): Any amino acid
  MOD_RES (1699)..(1706): Any amino acid
  MOD_RES (1729)..(1729): Any amino acid
  MOD_RES (1744)..(1745): Any amino acid
  MOD_RES (1767)..(1800): Any amino acid
  MOD_RES (1816)..(1824): Any amino acid
  MOD_RES (1839)..(1839): Any amino acid
  MOD_RES (1850)..(1852): Any amino acid
  MOD_RES (1870)..(1878): Any amino acid
  MOD_RES (1896)..(1917): Any amino acid
  MOD_RES (1957)..(1962): Any amino acid
  MOD_RES (1980)..(1982): Any amino acid
  MOD_RES (2000)..(2005): Any amino acid
  MOD_RES (2032)..(2047): Any amino acid
  MOD_RES (2071)..(2072): Any amino acid
  MOD_RES (2086)..(2093): Any amino acid
  MOD_RES (2150)..(2152): Any amino acid
  MOD_RES (2200)..(2200): Any amino acid
  MOD_RES (2210)..(2210): Any amino acid
  MOD_RES (2231)..(2256): Any amino acid
  MOD_RES (2287)..(2303): Any amino acid
  MOD_RES (2335)..(2345): Any amino acid
  MOD_RES (2364)..(2365): Any amino acid
  MOD_RES (2376)..(2380): Any amino acid
  MOD_RES (2399)..(2416): Any amino acid
  MOD_RES (2432)..(2433): Any amino acid
  MOD_RES (2485)..(2505): Any amino acid
  MOD_RES (2519)..(2519): Any amino acid
  MOD_RES (2532)..(2535): Any amino acid
  MOD_RES (2571)..(2571): Any amino acid
  MOD_RES (2591)..(2594): Any amino acid
  MOD_RES (2612)..(2659): Any amino acid
  MOD_RES (2677)..(2682): Any amino acid
  MOD_RES (2700)..(2701): Any amino acid
  MOD_RES (2715)..(2717): Any amino acid
  MOD_RES (2735)..(2747): Any amino acid
  MOD_RES (2770)..(2772): Any amino acid
  MOD_RES (2792)..(2797): Any amino acid
  MOD_RES (2821)..(2825): Any amino acid
  MOD_RES (2852)..(2859): Any amino acid
  MOD_RES (2874)..(2892): Any amino acid
  MOD_RES (2903)..(2905): Any amino acid
  MOD_RES (2941)..(2942): Any amino acid
  MOD_RES (2988)..(3042): Any amino acid
  MOD_RES (3055)..(3057): Any amino acid
  MOD_RES (3081)..(3081): Any amino acid
  MOD_RES (3128)..(3139): Any amino acid
  MOD_RES (3168)..(3170): Any amino acid
  MOD_RES (3195)..(3202): Any amino acid
  MOD_RES (3226)..(3311): Any amino acid
  MOD_RES (3354)..(3361): Any amino acid
  MOD_RES (3375)..(3380): Any amino acid
  MOD_RES (3426)..(3434): Any amino acid
XXXXXXXXGKNRAVNMQKRGTPRVMSLIGLKRAVLSLIDGRGPIRFVLALLAFFKFTAIAPTRAVLDRWRSVNKQTAMKXXTSFKKELGALTNAMNRRSLKQKKRGGNTGIXXXXXXXXXXGAVVLSNFQGKLIMTINATDTTXIITIPTASGKNLCIIRAMDVGFMCDDTIAYECPALMEGNDPEDIDCWCTKLAVFVRYGRCTKTRHSRRSKRSLTVQTHGESTLSNRKGAWLDSTKASRYXXXXXXXXXXXXXXXXXXXXXXXXXXXNTTQRVVFMILLLLVAPXXXXXXLGMSSRDFLEGVSGATWMDLXXXGDSCVTITAKDRPTIDVKMTNMEAXXXXEVRSYCYAAXATEISSSAACPAMGEAHNEKRTDSXYVCRQGVVDXXXXXXXXXXXXXXXDTCAKFACTTKATGLTIQREBIKYEVAIFXXGPTTVESHRXXXXXXGAAQAGRFSVSPAAPTHTXNLGDYGEVTIDCEPRSGVDVDAFYVMTVGXXXXXXXXXXXXXLNLPWSSAESNXWRNRETLVEFEEAHATKQSVVXXXXXXXXXXXALAGAIPLSFSSNTVTLTSXXXXCRVKMEKLKLKGXXYGVCSKAFRFXNTPADTGHGXXVLELQYTGKDGPCKIPISSVASLXXXXXXXXXVTVNPFVSVSTANAKILVELEPXXXXXXXXVGRGEQQINHHWYKSGSSIGKAFATTLQGAQRLVSLXXXXXDFGSVGGVFNSIGKAVHQVFGGAFRLLXXXXXXXXXXXXXALLLWMGINSRDRSIALTFLAVGGVLLFLSVSVHADTGCAIDLKRQELRCGSXVFIHNDVEAWIDRYRYHPETPQGLARIIQKAHXEGICGIRSVSRLEHQMWEAVKDELNTLLKENGIDLTVVVEKQXXXXXXXXXXXXATTENLEIGWKAWXKSIIFAPELANHTFVIDGPETKECPSXDRAWNSLEVXXXXXGLTSTRMFMKIRESNTTECDSKTIGTAIKNNLAIHSXLSYWIESRLNHTWKLERAVXXXXXXXXXXXTHTLWGEGVQESDLIIPITLAGPRSNHNKRPGYKTQNXXPWDEGRIEIDFDYCPGTTVTVSXXCGHRGPAIRTTTESGKXXXXXXXXXCTLPPLRYRTESGCWYGMEIRPLRHDEKTLVQSKVSAHNADMIDPFQLGLLVVFLATKEVLRKRWTAKISVPAIIIALAVLVLGGITYIDVLRYVILVGAAFMEANXXXXXXXLALMATFKIQPAFMVASFLKAKWTNHENILLMLAAVFFQMAYYDARXXXXWNIPDVLNSLAAAWMILRAIGFTTTSNVVVPAMAFLTPGLKCLNLDVYKIVLLMVGVGSLVKERRSAVAKKKGASLICLALASXXXFSPLILAAGLMACDPNRKRXXXXXXXXXXXXXXXXXXXGLAELDVDSMAIPMTIAGLMFAAYVITGRSXXXWIERTADISWEGDVEITGSSERVDVRLDDGGNFQLMSDPGAPWKLWMLRMTCLAVSAYTPWAVLPSVVGFWISLQXXXXXXXXXDTPSPREYRKGDTTTGVXXXXXXXLLGNYQAGVXXXXXXXXXXXXXXXXXXXXXXXXXXXXXXXXXXXXXXXXYGGPWKLQRKWNGLDEVQMIVVEPGKNAKNVQTKPGXXXXXXXXXXXXXXXXXXXXXGSPIVDKNSDVIGLYXNGVIMPSGSYISAIVQGERMDEPVPAGFDSEMLRKKQISVLDXXXXXXXXRKILPQIIREAINKRLRTAILAXTRVVASEMAEALRGXXIRYQTSAVTREHTGNEIVDVMXXXXXXXXXXXXXXXXXXXXXXXXXXXXXXXXXXAARGYISTRVELGEAXXXXXXXXXPGTHDPFPESNAPVXDIQTEIPDRAXXXGYEWITEYVGKTVWFVPXXXXXXXXXLCLQRAGKRVIQLNRKSXXXXXXXXXXXXXXXXXXXXXXEMGANFRASRVIDSRKSVKPTIITDGEGKVVLGEPSAITXXXXXXRRGRTGRNPSQAGDEYCXXXHTNEDDSNCAHWTEARIXXXXXXMPNGLIAQLYQPEREKVYTMEGEYRLXXXXXXXXXXXXXXXXLPVWLAYQVAAAGIPYHDRRWCFXXPRTNMILEDNNEVXXXXXXXXRKILRPRWVDARVYSDHQALKLFKDFASGRRSQIGLVEVIGRMPEHFMVKTWEALDXXXVVATAEKGGRAHRSALEELPDALQTIVLIALLSVMTLGVFLLLMQRKXIGKIGLGGVXLGLATFFCWMADVPGTKIAGXXXXXXXXXXXXXXXXXXXXXXXXXXLAMFLICVMTLVGTVAANEMGWLDRTKSDIXXXXXXXXXXXXXXXXXESLLLDLKPATAWSLYAIATAFLTPLIKHLIXXXXXXXXXXXINVQASALYSLARGFPFVXXGISALLLAAGXXXXXTLTVTVTATTLLLCHYAYXXXXXXXXXXXXXXXXXXAGIMKNVVVDGIVATXXPELERATPIMQKKVGQIMLILVSTAALVVNPSVKTVREAGILVTAAAVTLWXXXXXXXXXXXXXXXXXXXXXGGWLSCLSIMWTLXKNMGKPGLKRGGXXXXTLGEVWKDRLNRMTKEEFIRYRKEAIIEVDRSAARXARKERNVTGGYPVSRGTAKXXXXVERKFLDPIGKVVDLGCXXXXXXXXXXXXXXXXXXXXXXXXXXXXXXXXXXXXXXXXXXXXXXXXDVYYRASEVSDTLLCDIXXXXXXAEVEEHRTLRVLEMVEDXXHRGPKEFCVKVLCXXXPKVIEKMEVLQRRYGGGXXXXXXXXXXXXXMYWVSRASGNIVHAVNMTSQVLXXXMEKKTWKGPQYEEDANLGSXXXXXXKPLLNSDTSRIKSRIEKLKKEYGXXXXXDDNHPYRTWNYHGSYEVNPLVSASSLXXXXXXXXSKPWDVITNVTTMAXXXXXXXXXXXXXXXXXXXKAPEPPEGVRXXXKETTNWLWSHLERNKRPRMCSREEFISKVNSNAALXXMFEEQNQWKSAREAVEDLKFWEIVDEEREAHLRGECYTCIYNMMGXXXXXXXXXXXXXXXXXXXXXXXXXXXXXXXXXXXXXXXXXXXXXXXXXXXXXXXLQKLGYVLREVGXXXGGKVYADDTAGWDTPITKADLENXAKVLELLDREHRRLARSIIQLTYRYKVVKVMRPAVGGKTVMDIISRXXXXXXXXXXXXALNPFSNLAVQLVRRREGEGVIGPYDVEXXXKRKGPKVRTWLFENGEERLGRMAVXXXXXXXXPLDDRFATSLHFLNAMSQVRKDIXXXXXXXXXXXXXXXXXXXXXXXXXXXXXXXXXXXXXXXXXXXXXXXXXXXXXXXXXXXXXXXXXXXXXXXXXXXXXXXXXXXXXXAICSAVPADWVPTGRTTWSIHARGEWMTTADMLGVWNRVWIEXXXXXXXXTPVERWSDIPYSGXXXXXXCGSLIGTRSRATWAENIQVAINQVRSIIGEEKYVDYMGSLKRYEEXXXXXXXXX

SEQ ID NO: 265785 - protein, 3434 aa, West Nile virus
  MOD_RES (1)..(12): Any amino acid
  MOD_RES (33)..(35): Any amino acid
  MOD_RES (76)..(84): Any amino acid
  MOD_RES (112)..(121): Any amino acid
  MOD_RES (144)..(144): Any amino acid
  MOD_RES (186)..(187): Any amino acid
  MOD_RES (205)..(205): Any amino acid
  MOD_RES (215)..(219): Any amino acid
  MOD_RES (237)..(270): Any amino acid
  MOD_RES (288)..(318): Any amino acid
  MOD_RES (341)..(344): Any amino acid
  MOD_RES (354)..(354): Any amino acid
  MOD_RES (379)..(379): Any amino acid
  MOD_RES (389)..(404): Any amino acid
  MOD_RES (425)..(449): Any amino acid
  MOD_RES (468)..(468): Any amino acid
  MOD_RES (481)..(486): Any amino acid
  MOD_RES (498)..(511): Any amino acid
  MOD_RES (522)..(522): Any amino acid
  MOD_RES (536)..(554): Any amino acid
  MOD_RES (571)..(646): Any amino acid
  MOD_RES (667)..(679): Any amino acid
  MOD_RES (693)..(694): Any amino acid
  MOD_RES (709)..(717): Any amino acid
  MOD_RES (737)..(757): Any amino acid
  MOD_RES (790)..(791): Any amino acid
  MOD_RES (809)..(813): Any amino acid
  MOD_RES (842)..(842): Any amino acid
  MOD_RES (885)..(896): Any amino acid
  MOD_RES (909)..(910): Any amino acid
  MOD_RES (937)..(937): Any amino acid
  MOD_RES (947)..(952): Any amino acid
  MOD_RES (981)..(988): Any amino acid
  MOD_RES (1006)..(1018): Any amino acid
  MOD_RES (1045)..(1081): Any amino acid
  MOD_RES (1097)..(1106): Any amino acid
  MOD_RES (1151)..(1153): Any amino acid
  MOD_RES (1167)..(1168): Any amino acid
  MOD_RES (1207)..(1222): Any amino acid
  MOD_RES (1250)..(1253): Any amino acid
  MOD_RES (1266)..(1269): Any amino acid
  MOD_RES (1301)..(1301): Any amino acid
  MOD_RES (1344)..(1357): Any amino acid
  MOD_RES (1375)..(1396): Any amino acid
  MOD_RES (1409)..(1429): Any amino acid
  MOD_RES (1447)..(1454): Any amino acid
  MOD_RES (1466)..(1471): Any amino acid
  MOD_RES (1486)..(1510): Any amino acid
  MOD_RES (1528)..(1584): Any amino acid
  MOD_RES (1602)..(1602): Any amino acid
  MOD_RES (1619)..(1671): Any amino acid
  MOD_RES (1696)..(1710): Any amino acid
  MOD_RES (1728)..(1730): Any amino acid
  MOD_RES (1743)..(1745): Any amino acid
  MOD_RES (1758)..(1800): Any amino acid
  MOD_RES (1816)..(1852): Any amino acid
  MOD_RES (1869)..(1933): Any amino acid
  MOD_RES (1954)..(1963): Any amino acid
  MOD_RES (1976)..(1982): Any amino acid
  MOD_RES (2000)..(2021): Any amino acid
  MOD_RES (2032)..(2049): Any amino acid
  MOD_RES (2070)..(2099): Any amino acid
  MOD_RES (2111)..(2118): Any amino acid
  MOD_RES (2144)..(2156): Any amino acid
  MOD_RES (2170)..(2173): Any amino acid
  MOD_RES (2198)..(2200): Any amino acid
  MOD_RES (2210)..(2210): Any amino acid
  MOD_RES (2225)..(2258): Any amino acid
  MOD_RES (2276)..(2277): Any amino acid
  MOD_RES (2287)..(2303): Any amino acid
  MOD_RES (2314)..(2316): Any amino acid
  MOD_RES (2335)..(2348): Any amino acid
  MOD_RES (2361)..(2389): Any amino acid
  MOD_RES (2399)..(2438): Any amino acid
  MOD_RES (2466)..(2468): Any amino acid
  MOD_RES (2485)..(2506): Any amino acid
  MOD_RES (2519)..(2519): Any amino acid
  MOD_RES (2532)..(2538): Any amino acid
  MOD_RES (2571)..(2571): Any amino acid
  MOD_RES (2585)..(2598): Any amino acid
  MOD_RES (2612)..(2659): Any amino acid
  MOD_RES (2674)..(2687): Any amino acid
  MOD_RES (2700)..(2717): Any amino acid
  MOD_RES (2735)..(2747): Any amino acid
  MOD_RES (2767)..(2774): Any amino acid
  MOD_RES (2791)..(2797): Any amino acid
  MOD_RES (2821)..(2825): Any amino acid
  MOD_RES (2850)..(2893): Any amino acid
  MOD_RES (2903)..(2908): Any amino acid
  MOD_RES (2941)..(2943): Any amino acid
  MOD_RES (2969)..(3057): Any amino acid
  MOD_RES (3070)..(3096): Any amino acid
  MOD_RES (3108)..(3114): Any amino acid
  MOD_RES (3127)..(3155): Any amino acid
  MOD_RES (3168)..(3170): Any amino acid
  MOD_RES (3180)..(3208): Any amino acid
  MOD_RES (3219)..(3311): Any amino acid
  MOD_RES (3354)..(3397): Any amino acid
  MOD_RES (3407)..(3416): Any amino acid
  MOD_RES (3426)..(3434): Any amino acid
XXXXXXXXXXXXAVNMLKRGKPRGGSLMGLKRXXXSLIDGKGPVRFVLALLVFFRFTAVAPTRALLNRWRGVNKQXXXXXXXXXKRELGILTNAINRRSSKEKKRGGSIGVXXXXXXXXXXRAVTLSDFQGKLMMTINATETTXVITIPPAAGKNLCTVRAMDVGHMCDDTITYECSVLSAGNDPXXVDCWCTKSAMYVRYGRCXKTRQSRRSRXXXXXQTHGKSTLSNKKGAWMDXXXXXXXXXXXXXXXXXXXXXXXXXXXXXXXXXXNTMQRVVFAVLLLLVAPXXXXXXXXXXXXXXXXXXXXXXXXXXXXXXXSCVTLMSKDKPTIDVKMMKMEAXXXXEVRSYCHLAXVSELSPKAACPTMGDAHNDKRADSXYFCKQGVVDXXXXXXXXXXXXXXXXTCAKFTCSNKATGLTIQRENXXXXXXXXXXXXXXXXXXXXXXXXXGATQAGRLSITPAAPSHTXKLGGYGEVTVDCXXXXXXDTSAYYVMTVGXXXXXXXXXXXXXXNLPWSSAGGTXWRNRGTLMEFEEPXXXXXXXXXXXXXXXXXXXALAGAIPVSFTSNTVKXXXXXXXXXXXXXXXXXXXXXXXXXXXXXXXXXXXXXXXXXXXXXXXXXXXXXXXXXXXXXXXXXXXXXXXXXXXXTVNPFVSMAAADAKVLIELEXXXXXXXXXXXXXEHQINHHWHKSGIXXGKAFTATLKGAQRLXXXXXXXXXFGSVGGVLTSFGKAVHQVFXXXXXXXXXXXXXXXXXXXXXLLVWMGINSRDRSIALTFLAVGGVLLFLSINVXXDTGCAINVTRQELRCGSXXXXXNDVEAWTDRYKFHPETPQGLARVIQKAHXSGVCGLRSASRLEHQMWESIKDELNTPFRENGVDLSMVVEKQXXXXXXXXXXXXATTEKFEIGWKAXXKSIMFAPEIANNTFVVDGSETRECPTXSRAWNSMEVXXXXXXLMTTRMFLKVREGNTTECDSKIIGTAIKXXXXXXXXLSYWIESGFNETWKLERXXXXXXXXXXXXXTHTLWGEGVIESELIIPATLAGPRSNXXXXXXXXXXXXXXXXXXXXXXXXXXXXXXXXXXXXXCEHRGASTRTTTDSGXXXXXXXXXXCTLPPLRFQTDNGCWYGMEIRPLKHDGRTLVQSRVNAHNADMIDXXXLGLLIVFLATQEVXXKRWTAKISLPAIMIALLVLVFGGVTYADVLRYVNLVGAXXXXXXXXXXXXXXXXMATFRVQPVFMVASFLRARWTNHENILXXXXAAFFQMAYIDSQXXXXWEMSDVLNSLAVAWMILRAITFTSTSNVVVPXLALLTPRLRCLNLDVYRILLLMIGIGSLIKERRNSAAKKKGAXXXXXXXXXXXXXXPMILVAGLLACDPNRKRXXXXXXXXXXXXXXXXXXXXXXELDIDSMAVPMTXXXXXXXXXXXXXXXXXXXXXRTADISWENDAEITGSSXXXXXXXXDDGNFQLMSDPXXXXXXWILRMVCLAVSAYTXXXXXXXXXXXXXXXXXXXXXXXXXDTPSPKVYRKGDTATGVXXXXXXXXXXXXXXXXXXXXXXXXXXXXXXXXXXXXXXXXXXXXXXXXXXXXXXXXXGGPWKLGHRWNGMDEVQXIVAKPGEKTRNVQTKPXXXXXXXXXXXXXXXXXXXXXXXXXXXXXXXXXXXXXXXXXXXXXXXXXXXXXQGERMDEPIPVGFEPETLKKKQITXXXXXXXXXXXXXXXPQIIKEAMNRRLRTAILXXXRVVAAEMADALRXXXIRYQTSAVAREHXXXXXXXXXXXXXXXXXXXXXXXXXXXXXXXXXXXXXXXXXXXAARGYISTRVELGDAXXXXXXXXXXXXXXXXXXXXXXXXXXXXXXXXXXXXXGYEWITEFVGKTVWFVXXXXXXXXXXXXXXXXXXXXXXXXXXXXXXXXXXXXXXXXXXXXXXXXXXXXXXXXXXXXXXXXXSVKPTSITDGEARVILGEPSXXXXXXXXXXRGRIGRNPTQVGXXXXXXXHTNEDDSNLAHWTEARIXXXXXXXXXXXXXXXXXXXXXXVCTMDGEYRLXXXXXXXXXXXXXXXXXXVWLAYKAAAAGVPYHDRRWCXXXXXXXXXXXXXXXXXXXXXXXXXXXXXXRWIDARVYLDHXXXXXXXXFASGKRSQIGFIEVLGRMPEHFMVKXXXXXXXXXXXXXAERGRRAHRMALEXXXXALQTVALITLLSVMTMGIFFLLMQXXXIGKIGLGGIXLGVATLFCWMAEVPXXXXXXXXXXXXXXXXXXXXXXXXXXXXXXXXXXVFMICVMTPVSAVAANEXXWLDKTKSDVXXXXXXXXXXXXXXXXXENFLLDLRPAXXXSLYAVSTAVLTPLLKHVIXXXXXXXXXXXXXXQASTLFTLARGFXXXXXXXXXXXXXXXXXXXXXXXXXXXXXVLLFCHYAYXXXXXXXXXXXXXXXXXXXXXXXXXXXXXXXXXXXXXXXXTTPMMQKKIGQIILILVSLAALVVNPSXXXVREAGILTSAAAVTLWXXXXXXXXXXXXXXXXXXXXXXGWLSCLSIAWTLXKNMEKPVLKRGGXXXXXXXEVWKERLNYMTKEEFARYRKEAITEVDRAPAKXARKEGNVTGGHSVXXXXXXXXXXXXXXFVEPVGRVIDLGCXXXXXXXXXXXXXXXXXXXXXXXXXXXXXXXXXXXXXXXXXXXXXXXXDVFYRTSEASDTLLXXXXXXXXXXXXXXHRTIRVLEIVEDXXXXXXXXXXXXXXXXXXPKVIEKMEILQRRYGGGXXXXXXXXXXXXXMYWVSQASGNIVHAVNMTSXXXXXXXXKKTWKGAHYEEDVNLGXXXXXXXRPLLNSDTSKINNRIERLKREYSXXXXXDGNHPYRTWNYHGSYEVNPLVSASXXXXXXXXXXXXXXXXXXXXXXXXXXXXXXXXXXXXXXXXXXXXAPEPPAGVKXXXXXXTNWLWAYLARGKRPRMCTREEFIKKVNSNAALXXXFEEQNQWSSAREAVEDPKFWEIVDEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGRIFADDTAGWXXXXXXXXXXXXXXXXXXXXXXXXXXXRAIIELTYRYKXXXXXXXAADGKTVMSLISXXXXXXXXXXXXXXXXXXXXXXXXXXXXXEGEGVIGPEDVEXXXRGKGPKVRTXXXXXXXXXXXXXXXXXXXXXXXXXXXXXASSLHFLNAMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAICSAVPVDWVPTGRTTWSIHARGEWMTTEDMLSVWNRVWIEXXXXXXXXXXXXXXXXXXXXXXXXXXXXXXXXXXXXXXXXXXXXQVAIGQVRSXXXXXXXXXXMSSLRRYEEXXXXXXXXX

SEQ ID NO: 265786 - protein, 3434 aa, West Nile virus
  MOD_RES (1)..(12): Any amino acid
  MOD_RES (28)..(64): Any amino acid
  MOD_RES (74)..(84): Any amino acid
  MOD_RES (95)..(95): Any amino acid
  MOD_RES (112)..(121): Any amino acid
  MOD_RES (131)..(132): Any amino acid
  MOD_RES (144)..(144): Any amino acid
  MOD_RES (154)..(157): Any amino acid
  MOD_RES (175)..(187): Any amino acid
  MOD_RES (198)..(219): Any amino acid
  MOD_RES (237)..(272): Any amino acid
  MOD_RES (288)..(344): Any amino acid
  MOD_RES (354)..(354): Any amino acid
  MOD_RES (366)..(407): Any amino acid
  MOD_RES (417)..(450): Any amino acid
  MOD_RES (468)..(486): Any amino acid
  MOD_RES (498)..(512): Any amino acid
  MOD_RES (522)..(647): Any amino acid
  MOD_RES (665)..(764): Any amino acid
  MOD_RES (782)..(791): Any amino acid
  MOD_RES (808)..(813): Any amino acid
  MOD_RES (833)..(853): Any amino acid
  MOD_RES (869)..(870): Any amino acid
  MOD_RES (884)..(896): Any amino acid
  MOD_RES (908)..(917): Any amino acid
  MOD_RES (937)..(961): Any amino acid
  MOD_RES (974)..(996): Any amino acid
  MOD_RES (1006)..(1019): Any amino acid
  MOD_RES (1036)..(1081): Any amino acid
  MOD_RES (1092)..(1108): Any amino acid
  MOD_RES (1118)..(1124): Any amino acid
  MOD_RES (1138)..(1138): Any amino acid
  MOD_RES (1149)..(1155): Any amino acid
  MOD_RES (1166)..(1168): Any amino acid
  MOD_RES (1204)..(1227): Any amino acid
  MOD_RES (1250)..(1253): Any amino acid
  MOD_RES (1264)..(1269): Any amino acid
  MOD_RES (1281)..(1315): Any amino acid
  MOD_RES (1342)..(1357): Any amino acid
  MOD_RES (1375)..(1429): Any amino acid
  MOD_RES (1447)..(1471): Any amino acid
  MOD_RES (1486)..(1510): Any amino acid
  MOD_RES (1526)..(1588): Any amino acid
  MOD_RES (1601)..(1673): Any amino acid
  MOD_RES (1694)..(1711): Any amino acid
  MOD_RES (1728)..(1745): Any amino acid
  MOD_RES (1758)..(1939): Any amino acid
  MOD_RES (1953)..(2052): Any amino acid
  MOD_RES (2064)..(2120): Any amino acid
  MOD_RES (2136)..(2157): Any amino acid
  MOD_RES (2167)..(2182): Any amino acid
  MOD_RES (2197)..(2200): Any amino acid
  MOD_RES (2210)..(2210): Any amino acid
  MOD_RES (2220)..(2258): Any amino acid
  MOD_RES (2268)..(2303): Any amino acid
  MOD_RES (2314)..(2321): Any amino acid
  MOD_RES (2334)..(2450): Any amino acid
  MOD_RES (2463)..(2519): Any amino acid
  MOD_RES (2531)..(2538): Any amino acid
  MOD_RES (2571)..(2573): Any amino acid
  MOD_RES (2583)..(2659): Any amino acid
  MOD_RES (2674)..(2717): Any amino acid
  MOD_RES (2730)..(2749): Any amino acid
  MOD_RES (2761)..(2774): Any amino acid
  MOD_RES (2790)..(2800): Any amino acid
  MOD_RES (2821)..(2825): Any amino acid
  MOD_RES (2836)..(2917): Any amino acid
  MOD_RES (2935)..(2946): Any amino acid
  MOD_RES (2969)..(3057): Any amino acid
  MOD_RES (3069)..(3097): Any amino acid
  MOD_RES (3107)..(3115): Any amino acid
  MOD_RES (3126)..(3157): Any amino acid
  MOD_RES (3168)..(3332): Any amino acid
  MOD_RES (3351)..(3434): Any amino acid
XXXXXXXXXXXXAVNMQKRGKPRGGSLXXXXXXXXXXXXXXXXXXXXXXXXXXXXXXXXXXXXXVLERWRGVNXXXXXXXXXXXKKELGILTNAXNRRSAKQKKRGGKTGSXXXXXXXXXXGAVTLSDFQXXLMMTVNATDVAXAITIPTAAGXXXXTVRAIDVGFMCDDTITYXXXXXXXXXXXXXIDCWCTKLAMXXXXXXXXXXXXXXXXXXXXXXQTHGESTLVNKKGAWLDXXXXXXXXXXXXXXXXXXXXXXXXXXXXXXXXXXXXMQRVVFIVLLLLVAPXXXXXXXXXXXXXXXXXXXXXXXXXXXXXXXXXXXXXXXXXXXXXXXXXXXXXXXXXGVRDYCYLAXVSDLSPRAACPXXXXXXXXXXXXXXXXXXXXXXXXXXXXXXXXXXXXXXXXXXKFACTSKATXXXXXXXXXXXXXXXXXXXXXXXXXXXXXXXXXXATQAGRFSVSPSAPTYTXXXXXXXXXXXXXXXXXXXDTNAYYVMSVGXXXXXXXXXXXXXXXLPWSSAGGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVNPFVAAATADAKVLIEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSARDKSIAMTFLAVGGIXXXXXXXXXXDTGCAIDITRQELRCGXXXXXXNDVEVWMDRYKYHPETPQGXXXXXXXXXXXXXXXXXXXXXLEHQMWDSVKDELNTXXKENGIDLSMVVEKXXXXXXXXXXXXXATSEKLEIGWKXXXXXXXXXXELANHTFVVDGPETEECPSXXXXXXXXXXXXXXXXXXXXXXXXXVRKVNTTECDSKXXXXXXXXXXXXXXXXXXXXXXXLNHTWKLERXXXXXXXXXXXXXXHTLWGDGVVESDLIIPXXXXXXXXXXXXXXXXXXXXXXXXXXXXXXXXXXXXXXXXXXXXXXCGHRGPSARTXXXXXXXXXXXXXXXXXLPPLRYTTEXXXXXXXEIRPQRHDGKTLVXSRVNAHNADMXXXXXXXLLVVFLVTQEXXXRRWTAKISMPAILLALLVLVFGGVTYTDVLRYIILXXXXXXXXXXXXXXXXXXXXXXXXIQPVFVVASFLKARWTNQENTLXXXXAAFFQMAYHDXXXXXXWGISDVLNSLAXXXXXXXXXXXXXXXXXXXXXXXXXXXXXXXXXXXVSRILLLMIGIGSLIKEKKNSAAKKKXXXXXXXXXXXXXXXXPITLAAGLVACDPNRKRXXXXXXXXXXXXXXXXXXXXXXXXXXXXXXXXXXXXXXXXXXXXXXXXXXXXXXXRVADISWESDVEITGSSXXXXXXXXXXXXXXXXXXXXXXXXXWMLKMACLAVSAYTXXXXXXXXXXXXXXXXXXXXXXXXXDTPSPKEYRKGDTATXXXXXXXXXXXXXXXXXXXXXXXXXXXXXXXXXXXXXXXXXXXXXXXXXXXXXXXXXXXXXXXKLQHRWNGMDEVXXXXXXXXXXXXXXXXXXXXXXXXXXXXXXXXXXXXXXXXXXXXXXXXXXXXXXXXXXXXXXXXXXXXXXXXXERMEEPVPSGFEPEMLRKKKXXXXXXXXXXXXXXXXXXQIIKEAMSKRLRTAILXXXXXXXXXXXXXXXXXXIRYQTSAVNREHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITEGEGKVVLSEPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYKVASAGISYXXXXXXXXXXXXXXXXXXXXXXXXXXXXXXXXXXXXXXXXXXXXXXXXXXXXXXXXXAGKRSQMGLIEVLGKXXXXXXXXXXXXXXXXXXXXXXDKGGRAHRMXXXXXXXXXXXXXXXXLLGVMTMGVFLLLMXXXXVSKIGLAGVXLAVATFFCWXXXXXXXXXXXXXXXXXXXXXXXXXXXXXXXXXXXXXXXVFMICVMTLXXXXXXXXXXXXXXXXXXXXXXXXXXXXXXXXXXXXGEFFLDLRPAXXXXXXXXTTAFLTPLLKHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMLILVSVAAVVVXXXXXXXXXXXXXXXXXXXXXXXXXXXXXXXXXXXXXXXXXXXXXXXXXXXXXXXXXKNLEKPGLKRGXXXXXXXXEVWKEKLNQMTKEEFTRYRREAIIEVDRSTAKXXXREGNVTGGHXXXXXXXXXXXXXXXXXXXXXXXXXXXXXXXXXXXXXXXXXXXXXXXXXXXXXXXXXXXXXXXXXXXXXXXXXXXXXDVFYRPSEVSDTLLXXXXXXXXXXXXXXXXXXXXXXXXXXXXXXXXXXXXXXXXXXXXPRVVEKMEVLQRXXXXXXXXXXXXXXXXXXXXWVSRASRNVVHXXXXXXXXXXXXXXKKTWKGPHYEEDVNLXXXXXXXXXXXLNSDTRKIKNRIERLKKEYNXXXXXDSNHPYRTWNXXXXXXXXXXXXXXXXXXXXXXXXXXXXXXXXXXXXXXXXXXXXXXXXXXXXXXXXXXXXXXXXXXXXXXXXXXXXXXXXXXREKKPRLCSREEFISKVXXXXXXXXXXXXQNQWRSAREAVEDSTFWEMVDEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKTYADDTAGXXXXXXXXXXXXXXXXXXXXXXXXXXXXXSIIQLTYRHXXXXXXXXXADRKTVMDVIXXXXXXXXXXXXXXXXXXXXXXXXXXXXXXXXEGVITPDDVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVGGEWMTTEDMLGVWNKVXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265787 - protein, 3427 aa, West Nile virus
  MOD_RES (111)..(121): Any amino acid
  MOD_RES (142)..(144): Any amino acid
  MOD_RES (341)..(354): Any amino acid
  MOD_RES (379)..(379): Any amino acid
  MOD_RES (444)..(449): Any amino acid
  MOD_RES (468)..(468): Any amino acid
  MOD_RES (498)..(498): Any amino acid
  MOD_RES (522)..(522): Any amino acid
  MOD_RES (602)..(602): Any amino acid
  MOD_RES (842)..(842): Any amino acid
  MOD_RES (885)..(896): Any amino acid
  MOD_RES (937)..(937): Any amino acid
  MOD_RES (1080)..(1081): Any amino acid
  MOD_RES (1266)..(1269): Any amino acid
  MOD_RES (1355)..(1355): Any amino acid
  MOD_RES (1839)..(1839): Any amino acid
  MOD_RES (2210)..(2210): Any amino acid
  MOD_RES (2287)..(2303): Any amino acid
  MOD_RES (2519)..(2519): Any amino acid
  MOD_RES (2571)..(2571): Any amino acid
  MOD_RES (2821)..(2825): Any amino acid
  MOD_RES (2903)..(2903): Any amino acid
  MOD_RES (3055)..(3057): Any amino acid
  MOD_RES (3168)..(3170): Any amino acid
  MOD_RES (3426)..(3427): Any amino acid
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGXXXXXXXXXXXGAVTLSNFQGKVMMTVNATDXXXVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAXXXXXXXXXXXXXXVSDLSTKAACPTMGEAHNDKRADPXFVCRQGVVDRGWGNGCGLFGKGSIDTCAKFACSTKAIGRTILKENIKYEVAIFVHGPTTVESHGXXXXXXGATQAGRFSITPAAPSYTXKLGEYGEVTVDCEPRSGIDTNAYYVMTVGXKTFLVHREWFMDLNLPWSSAGSTXWRNRETLMEFEEPHATKQSVIALGSQEGALHQALAGAIPVEFSSNTVKLTSGHLKCRVKMEKLQLKGTTYGVCSKAFKFXGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHXEGVCGLRSVSRLEHQMWEAVKDELNTLLKENGVDLSVVVEKQXXXXXXXXXXXXATTEKLEIGWKAWGKSILFAPELANNTFVVDGPETKECPTXNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSXXCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYHDARXXXXWEIPDVLNSLAVAWMILRAITFTTTSNVVVPLLALLTPGLRCLNLDVYRILLLMVGIGSLIREKRSAAAKKKGASLLCLALASTGXFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPIXDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAXLGVATFFCWMAEVPGTKIAGMLLLSLLLMIVLIPEPEKQRSQTDNQLAVFLICVMTLVSAVAANEMGWLDKTKSDIXXXXXXXXXXXXXXXXXGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLXKNMEKPGLKRGGAKGRTLGEVWKERLNQMTKEEFTRYRKEAIIEVDRSAAKXARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSXXXXXDENHPYRTWNYHGSYDVKPTGSASSLVNGVVRLLSKPWDTITNVTTMAMTDTTPFGQQRVFKEKVDTKAPEPPEGVKXVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGXXXGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEXXXKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDXX

SEQ ID NO: 265788 - protein, 3427 aa, West Nile virus
  MOD_RES (1)..(1): Any amino acid
  MOD_RES (111)..(121): Any amino acid
  MOD_RES (142)..(144): Any amino acid
  MOD_RES (341)..(354): Any amino acid
  MOD_RES (379)..(379): Any amino acid
  MOD_RES (393)..(400): Any amino acid
  MOD_RES (444)..(449): Any amino acid
  MOD_RES (468)..(468): Any amino acid
  MOD_RES (498)..(498): Any amino acid
  MOD_RES (522)..(522): Any amino acid
  MOD_RES (602)..(602): Any amino acid
  MOD_RES (641)..(641): Any amino acid
  MOD_RES (752)..(754): Any amino acid
  MOD_RES (842)..(842): Any amino acid
  MOD_RES (885)..(896): Any amino acid
  MOD_RES (937)..(937): Any amino acid
  MOD_RES (1009)..(1015): Any amino acid
  MOD_RES (1080)..(1081): Any amino acid
  MOD_RES (1266)..(1269): Any amino acid
  MOD_RES (1355)..(1355): Any amino acid
  MOD_RES (1377)..(1390): Any amino acid
  MOD_RES (1504)..(1506): Any amino acid
  MOD_RES (1553)..(1557): Any amino acid
  MOD_RES (1768)..(1778): Any amino acid
  MOD_RES (1839)..(1839): Any amino acid
  MOD_RES (1899)..(1902): Any amino acid
  MOD_RES (2210)..(2210): Any amino acid
  MOD_RES (2248)..(2249): Any amino acid
  MOD_RES (2287)..(2303): Any amino acid
  MOD_RES (2519)..(2519): Any amino acid
  MOD_RES (2571)..(2571): Any amino acid
  MOD_RES (2617)..(2620): Any amino acid
  MOD_RES (2640)..(2642): Any amino acid
  MOD_RES (2821)..(2825): Any amino acid
  MOD_RES (2853)..(2857): Any amino acid
  MOD_RES (2877)..(2888): Any amino acid
  MOD_RES (2903)..(2903): Any amino acid
  MOD_RES (2989)..(2990): Any amino acid
  MOD_RES (3005)..(3022): Any amino acid
  MOD_RES (3055)..(3057): Any amino acid
  MOD_RES (3168)..(3170): Any amino acid
  MOD_RES (3200)..(3200): Any amino acid
  MOD_RES (3229)..(3229): Any amino acid
  MOD_RES (3279)..(3287): Any amino acid
  MOD_RES (3307)..(3309): Any amino acid
  MOD_RES (3426)..(3427): Any amino acid
XSKKPGGPGKNRAVNMQKRGMPRGLSLTGLKRAMLSLIDGRGPTRFVLALLTFFKFTAIAPTRALLDRWRGVRKQTAMKHLLSFKKELGALTNAMNRRSTKQKKRGGTAGXXXXXXXXXXXSALTLSNFQGKVIMTVNATDXXXIITIPTAAGKNLCTVRAMDVGYLCEDTITYECPVLAEGNDPEDIDCWCTKSSVFVRYGRCTRTRNSRRSRRSLNVQVHGESTLANKKGAWLDSTKASRYLMKAESWILRNPGYALVAVVIGWMLGSNTMQRVVFAILLLLVAPAYSFNCLGMSNRDFIEGASGATWMDLVLEGDSCVTIMAKDRPTIDVKMVTMGAXXXXXXXXXXXXXXVSDLSTRAACPTMGEAHNEKRADPXFVCKQGVVDRGWGXXXXXXXXGSIDTCAKFACSTKATGWIIQRENVKYEVAAFVHGPTTVDTHSXXXXXXAAVQAGRFSITPSAPSYTXTLGDYGEVTFDCEPRSGIDTSAYYVMSVGXKSFLVHREWFMDLNLPWSSPGNTXWRNREALVEFEEPHATKQSVVALGSQEGALHQALAGAIPVDYKNSVVKLTSGHLKCRVRMEKLKLKGTTYGVCAKAFRFXRTPADTGHGTVVMELQYTGTDGPCKIPITSVASLNDLTXVGRLVTVNPYVSVATANSKILVELEPPFGDSYIVIGKGDQQVTHHWHKSGSSIGKAFTTTLRGAQRLVSLGDTAWDFGSIGGVFTSVGKAIHQLFGGAFRLLFGGMSWITXXXLGALLLWMGINARDRSIAMTFLAVGGVLLFLSVSVHADTGCAIDIGRQELRCGNGVFIYNDVEAWVDRYKFHPETPQGLAKIIHNAHXEGVCGVRSVSRLEHQMWESIKDELNTLLKENGVDLSIVVEKQXXXXXXXXXXXXATTEKLEMGWKAWGKSIIFAPELANNTFVIDGPETEECPTXNRAWNSMEVEDFGFGLTSTRMFLRIRETNTTECDTKIIGTAVKNNMAVHSDLSYWIESGFNETWKLERAVLXXXXXXXWPETHTLWGDGVLESDLIIPITLAGLKSNHNRRPGYKTQSQGPWDEGRVELDFDYCPGTTVTISXXCGHRGPAARTTTESGKLISDWCCRSCTLPPLRFQTENGCWYGMEIRPTKHDEKTLVQSRVTAYKSDMIDPFQLGLMVVFLATQEVLRKRWTAKISIPAIMLALLTLVFGGVTYTDLIRYVILVGAAFAEANSGGDVVHLALMATFKIQPVFLVASFLKTRWTNQESILLMLAAAFFQMAYYDAKXXXXWEVPDVLNSLSVAWMILRAISFTNTSNVATPLLALLTPGLKCLHLDIYRILLLMVGVGSLIKEKRSSAAKKKGACLICLALASTGXFNPMILAAGLITCDPNRKRGWXXXXXXXXXXXXXXIVGGLAELDIDSMAVPMTIAGLMFVAYVITGRSTDMWIERTADITWESDAEITGTSDRVDVKLDDDGNFQLISDPGAPWKIWILRMACLAVSAYTPWAILPSVIGFWITLQYTXXXGVLWDTPSPREYKRGDTTTGVYRIMTRGILGSYQAGVGVMVEGVFHXXXXXTKGAALMSGTGRLDPYWGSVREDRLCYGGPWKLQHKWNGHDEVQMIVAEPGRNTRNVQTKPGVFKTPDGEIGAVTLDYPTGTSGSPIVDRSGDVIGLYGNGVIMPNGAYISAIVQGERMEEPAPAGFEPDTLRKKQISVLDLHPGAGKTRKILPQIIKEAINKRLRTAILAPTRVVAAEMSEALRGLPIRYQTSAVHREHSGNEIVDVMCXXXXXXXXXXXHRVPNYNLFIMDEAHFTDPASIAARGYIATRVELGEAAAIFMTATPPGTSDPFPESNAPIXDMQTEIPDRAWNSGYEWITEYIGKTVWFVPSVRMGNEMAQCLQRAGKKVIQLNRKSYETXXXXCKNDDWDFVVTTDISEMGANFRANRVIDSRKSVKPTIIEEGDNRVILGEPSAITAASAAQRRGRIGRNSSQAGDEYCYGGHTNEDDSNLAHWTEARIMPDNINMPNGLVAQLYQPEREKVYTMDGEYKLRGEERKNFLEFLRTADLPVWLAYKVAAAGISYHDRKWCFDGPRTNTVLEENTEVEIVTKMGERKILRPRWADARVYSDHQALKSFKDFAAGKRSQIGLVEVLGRMPEHFVVKTWEALDTMYVVATAEKGGRAHRTALEELPDALQTIALITLLSVMSLGVFCLLMQRKGIGKIGLGGTXLGAATFFCWMAEVSGTKIAGMLLLSLLMMIVLIPEPEXXRSQTDNQLAVFLICVLTLVGTVAANEMGWLDKTKNDIXXXXXXXXXXXXXXXXXESFLLDLKPATAWSLYAVSTAVMTPLLKHVITSDYINTSLTSINVQASALFTLSRGFPFVDVGVSALLLAVGCWGQVTLTVTVTSAALLLCHYAYMIPGWQAEAMRAAQRRTAAGIMKNVVIDGMVATDVPELERTTPVMQKKVGQVMLILVSMAAVVVNPSVRTVREAGILTTAAAVTLWENGAGSVWNATTAIGLCHVMRGGWLSCLSMTWTLXKNMDKPVLKRGGAKGRTLGEVWKERLNHLTKEEFTRYRKEAITEVDRSAAKXARREGNITGGHSVSRGTAKLRWLVERRFLEPVGKVVDLGCGRGGWXXXXATQKRVQEVKGYTKGGPGHXXXQLVQSYGWNTVTMKSGVDVFYRPSEASDTLLCDIGESASSAEVEEHRTVRVLEMVEDWLHRGPKEFCIKVLCPYMPKVIEKMETLQRRYGGGLIRNPLSRNSTHEMYWVSHASGNIVNSVSMTSQVLLGRMEKKTWKGPQFEEDANLGSGTRAVGKPLLNSDTGKIRNRIERLKKEYSXXXXXDANHPYRTWNYHGSYDVRPTGSASSLVXXXXXLLSKPWDTITSVTTMAMTDXXXXXXXXXXXXKVDTKAPEPAEGVKXVLNETTNWLWTFLARDKKPRMCSREEFIGKVNSNAALGAMFEEQNQWKNAREAVEDPKFWEMVDDEREAHLRGECNTCIYNMMGKXXKKPGDFGKAKGSRAXXXXXXXXXXXXXXXXXXLNEDHWLGRENSGGGVEGLGLQKLGYILKEVGXXXGGKMYADDTAGWDTRITKADLENEAKVLEFLDGEHRRLARSVIQLTYCYKVVKVMRPAADGKTVMDIISREDQRGSGQVVTYALNTFTNLSFQLVRMMEGEGVVGPDDVEXXXKGKGVKVRVWLSENGKERLGRMAVSGDDCXVKPLDDRFATALHFLNAMPKVRKDIQEWXPSTGWYDWQQVQFCSNHFTELIMKDGRTLVVPCRGQDELIGRARISPGAXXXXXXXXXLAKSYAQMWQLLYFHRRDLXXXANAICSAVPVSWVPTGRTTWSIHAKGEWMTTEDMLAVWNKVWIEENEWMEDKTPVERWSDIPYSGKREDIWCGSLIGTRTRATWAENIHVAINQVRSVIGEEKYVDYMSSLRRYEDXX

SEQ ID NO: 265789 - protein, 3427 aa, West Nile virus
  MOD_RES (1)..(7): Any amino acid
  MOD_RES (111)..(121): Any amino acid
  MOD_RES (142)..(144): Any amino acid
  MOD_RES (245)..(263): Any amino acid
  MOD_RES (289)..(292): Any amino acid
  MOD_RES (315)..(315): Any amino acid
  MOD_RES (341)..(354): Any amino acid
  MOD_RES (379)..(379): Any amino acid
  MOD_RES (390)..(402): Any amino acid
  MOD_RES (444)..(449): Any amino acid
  MOD_RES (468)..(468): Any amino acid
  MOD_RES (498)..(508): Any amino acid
  MOD_RES (522)..(522): Any amino acid
  MOD_RES (545)..(552): Any amino acid
  MOD_RES (602)..(602): Any amino acid
  MOD_RES (638)..(644): Any amino acid
  MOD_RES (669)..(674): Any amino acid
  MOD_RES (713)..(715): Any amino acid
  MOD_RES (745)..(755): Any amino acid
  MOD_RES (842)..(842): Any amino acid
  MOD_RES (885)..(896): Any amino acid
  MOD_RES (937)..(937): Any amino acid
  MOD_RES (948)..(950): Any amino acid
  MOD_RES (1009)..(1017): Any amino acid
  MOD_RES (1080)..(1081): Any amino acid
  MOD_RES (1104)..(1105): Any amino acid
  MOD_RES (1214)..(1218): Any amino acid
  MOD_RES (1266)..(1269): Any amino acid
  MOD_RES (1354)..(1355): Any amino acid
  MOD_RES (1376)..(1392): Any amino acid
  MOD_RES (1425)..(1425): Any amino acid
  MOD_RES (1503)..(1509): Any amino acid
  MOD_RES (1529)..(1533): Any amino acid
  MOD_RES (1545)..(1582): Any amino acid
  MOD_RES (1621)..(1639): Any amino acid
  MOD_RES (1703)..(1705): Any amino acid
  MOD_RES (1768)..(1799): Any amino acid
  MOD_RES (1817)..(1823): Any amino acid
  MOD_RES (1839)..(1839): Any amino acid
  MOD_RES (1851)..(1851): Any amino acid
  MOD_RES (1871)..(1877): Any amino acid
  MOD_RES (1897)..(1916): Any amino acid
  MOD_RES (1958)..(1961): Any amino acid
  MOD_RES (1981)..(1981): Any amino acid
  MOD_RES (2001)..(2004): Any amino acid
  MOD_RES (2033)..(2046): Any amino acid
  MOD_RES (2087)..(2090): Any amino acid
  MOD_RES (2151)..(2151): Any amino acid
  MOD_RES (2210)..(2210): Any amino acid
  MOD_RES (2232)..(2255): Any amino acid
  MOD_RES (2287)..(2303): Any amino acid
  MOD_RES (2336)..(2344): Any amino acid
  MOD_RES (2379)..(2379): Any amino acid
  MOD_RES (2400)..(2415): Any amino acid
  MOD_RES (2490)..(2502): Any amino acid
  MOD_RES (2519)..(2519): Any amino acid
  MOD_RES (2533)..(2534): Any amino acid
  MOD_RES (2571)..(2571): Any amino acid
  MOD_RES (2592)..(2593): Any amino acid
  MOD_RES (2613)..(2658): Any amino acid
  MOD_RES (2678)..(2681): Any amino acid
  MOD_RES (2716)..(2716): Any amino acid
  MOD_RES (2736)..(2746): Any amino acid
  MOD_RES (2771)..(2771): Any amino acid
  MOD_RES (2793)..(2796): Any amino acid
  MOD_RES (2821)..(2825): Any amino acid
  MOD_RES (2853)..(2858): Any amino acid
  MOD_RES (2875)..(2891): Any amino acid
  MOD_RES (2903)..(2904): Any amino acid
  MOD_RES (2989)..(3041): Any amino acid
  MOD_RES (3055)..(3057): Any amino acid
  MOD_RES (3134)..(3138): Any amino acid
  MOD_RES (3168)..(3170): Any amino acid
  MOD_RES (3196)..(3201): Any amino acid
  MOD_RES (3227)..(3231): Any amino acid
  MOD_RES (3242)..(3250): Any amino acid
  MOD_RES (3270)..(3310): Any amino acid
  MOD_RES (3355)..(3360): Any amino acid
  MOD_RES (3376)..(3379): Any amino acid
  MOD_RES (3426)..(3427): Any amino acid
XXXXXXXPGKNRAVNMQKRGTPRVLSLIGLKRAVLSLIDGRGPIRFVLALLAFFKFTAIAPTRAVLDRWRSVNKQTAMKHLLSFKRELGILTNAINRRSLKQKKRGGNTGXXXXXXXXXXXGAVTLSNFQGKLMMTINATDXXXAITIPTASGKNLCIIRAMDVGFMCDDTIAYECPALMEGNDPEDIDCWCTKLAMYVRYGRCTKTRQSRRSKRSLTVQTHGESSLSNRKGAWLDSTKASRYLXXXXXXXXXXXXXXXXXXXTGWMLGSNTMQRVVFAVLLLLVAPAXXXXCLGMSSRDFLEGVSGATWMDLVXEGDSCVTIMSKDKPTIDVKMTNMEAXXXXXXXXXXXXXXATEISSSAACPTMGEAHNEKRTDSXYVCRQGVVDRXXXXXXXXXXXXXIDTCAKFACTTKATGLTIQKEBIKYEVAVFVHGPTTVESHRXXXXXXGAAQAGRFSVSPAAPTHTXNLGDYGEVTIDCEPRSGVDVDAFYVMTVGXXXXXXXXXXXTDLNLPWSSAESNXWRNRETLVEFEEAHATKQSVVAXXXXXXXXQQALAGTIPVEFTSNTVKLSSGHLKCRVKMEKLKLKGTTYGVCSKAFRFXNTPADTGHGTVVLELQYTGTDGPCKIPISSVASLNXXXXXXXLVTVNPFVSVSTANAKILVELEPPXXXXXXVVGRGEHQINHHWYKSGSSIGKAFATTLQGAQRLVSLGXXXWDFGSVGGVFNSIGKAVHQVFGGAFRLLFXXXXXXXXXXXGALLLWMGISSRDRSIALTFLAIGGILLFLSANVHADTGCAIDLKRQELRCGSGVFIHNDVEAWIDRYRYYPETPQGLARIIQKAHXSGTCGIRSVSRLEHQMWEAVKDELNTLLKENGIDLSIVVEKQXXXXXXXXXXXXATTENLEIGWKAWGKSILFAPELANHTFVIDGPETKECPSXDRAWNSLEVEXXXFGLTSTRMFMKVREGNTTECDSKTIGTAVKNNLAVHSDLSYWIESRLNHTWKLERAVLXXXXXXXXXETHTLWGEGVQESELIIPITLAGPRSNYNRRPGYKMQNQGPWDEGRIEIDFDYCPGTTVTVSXXCGHRGPAIRTTTESGKLITDWWXXSCTLPPLRYRTESGCWYGMEIRPLRHDEKTLVQSKVNAYKSDMIDPFQLGLLVVFLVTQEVLRKRWTAKISVPAIIIALLVLVLGGITYADVLRYINLVGAAFMEANSXXXXXHLALMATFKIQPAFMVASFLKAKWTNHENILLMLAAVFFQMAYYDARXXXXWEMSDVLNSLAVAWMILRAIGFTTTSNVVVPLMALLTPGLKCLNLDVSRILLLMVGVGSLVKERRSAVAKKKGASLICLALASTXXFNPLILAAGLMACDPNRKRGXXXXXXXXXXXXXXXXXGGLAELDMDSMAIPMTIAGLMFAAYVITGRSTXMWIERTADISWEGDVEITGSSERVDVRLDDDEDFQLMSDPGAPWKLWMLRMTCLAVSAYTPWAVLPSVVGFWISLQYXXXXXXXWDTPSPREYRKGDTTTGVYXXXXXGLLGNYQAGVGXXXXXXXXXXXXXXXXXXXXXXXXXXXXXXXXXXXXXXCYGGPWKLQRKWNGLDEVQMIVVEPGKNAKNVQTKPGVXXXXXXXXXXXXXXXXXXXSGSPIVDKSGDVIGLYGNGVIMPSGSYISAIVQGERMDEPVPAGFEPDMLRKKKITVLDLHPGXXXTRKILPQIIREAINKRLRTAILAPTRVVASEMAEALRGLPIRYQTSAVTREHTGNEIVDVMCXXXXXXXXXXXXXXXXXXXXXXXXXXXXXXXXIAARGYISTRVELGEAAXXXXXXXPPGTHDPFPESNAPVXDIQTEIPDRAWXTGYEWITEYVGKTVWFVPSXXXXXXXALCLQRAGKRVIQLNRKSYXXXXXXXXXXXXXXXXXXXXSEMGANFKANRVIDSRKSVKPTIITDGESRVVLGEPSAITAXXXXQRRGRIGRNPSQAGDEYCYXGHTNEDDSNCAHWTEARIMXXXXNMPNGLIAQFYQPEREKVCTMDGEYRLRXXXXXXXXXXXXXXDLPVWLAYQVAAAGVPYHDRRWCFDGPRTNTVLEDNNEVEXXXXVGERKILRPRWVDARVYSDHQALKLFKDFASGRRSQIGLVEVIGRMPEHFMVKTWEALDTXYVVATAEKGRRAHRSALEELPDALQTIVLIALLSVMTLGIFFLLMQRKGIGKIGLGGVXLGLATLFCWMADVPGTKIAGMXXXXXXXXXXXXXXXXXXXXXXXXQLAMFLICVMTLVGTVAANEMGWLDRTKSDIXXXXXXXXXXXXXXXXXESFFLDLRPATAWSLYAITTAVLTPLLKHVITXXXXXXXXXSINVQASALYSLARGFPFVDVGISALLLAAGCWEXVTLTVTVTATTLLLCHYAYMXXXXXXXXXXXXXXXXAAGIMKNAVIDGMVATDVPELERATPIMQKKVGQIILILVSTAALVVNPSVKTVREAGILVSAASVTLWENGASXXXXXXXXXXXXXVMRGGWLSCLSIMWTLXKNMGKPGLKRGGAXXRTLGEVWKDRLNRMTKEEFIRYRKEAIIEVDRSAARXARKERNVTGGHPVSRGSAKLXXLVERRFLDPIGKVVDLGCGXXXXXXXXXXXXXXXXXXXXXXXXXXXXXXXXXXXXXXXXXXXXXXVDVYYRASESCDTLLCDIGXXXXSAEVEEHRTLRVLEMVEDWLHRGPKEFCVKVLCPXMPKVIEKMEVLQRRYGGGLXXXXXXXXXXXEMYWVSRASGNIVHAVNMTSQVLLXRMEKKTWKGPHYEEDANLGSGXXXXGKPLLNSDTSKINSRIERLKREYSXXXXXDDNHPYRTWNYHGSYEVNPTGSASSLVXXXXXXLSKPWDTIMNVTTMAMXXXXXXXXXXXXXXXXXTKAPEPPEGAKXXLNETTNWLWAYLARNKRPRMCSREEFISKVNSNAALGAMFEEQNQWKSARAAVEDPKFWEIVDEEREAHLRGECYTCIYNMMGKXXXXXXXXXXXXXXXXXXXXXXXXXXXXXXXXXXXXXXXXXXXXXXXXXXXXXGLQKLGYVLREVGXXXGGKVYADDTAGWDTRITMTDLENEAKVLELLEGEHRRLARSIIELTYRHKVVKVMRPAVGGKTVMDVISREDQRGRXXXXXYALNPFTNLAVQLVRRREGEGVIGPYDVEXXXKRKGPKVRTWLFENGEERLSRTAVSXXXXXXKPLDDRFATSLHFLNDMSKVRKDIQXXXXXVGWYDWQQVPXXXXXXXXXIMKDGRTLVTPCRGQDELVXXXXXXXXXXXXXXXXXXXXXXXXXXXXXXXXXXXXXXXXXNAICSAVPADWVPTGRTTWSIHARGEWMTTADMLGVWNRVWIEEXXXXXXKTPVERWSDIPYSGKXXXXWCGSLIGTRTRATWAENIQVAINQVRSIIGEEKYVDYMGSLKRYEEXX

SEQ ID NO: 265790 - protein, 3427 aa, West Nile virus
  MOD_RES (1)..(11): Any amino acid
  MOD_RES (77)..(83): Any amino acid
  MOD_RES (111)..(121): Any amino acid
  MOD_RES (142)..(144): Any amino acid
  MOD_RES (216)..(218): Any amino acid
  MOD_RES (238)..(269): Any amino acid
  MOD_RES (289)..(317): Any amino acid
  MOD_RES (341)..(354): Any amino acid
  MOD_RES (379)..(379): Any amino acid
  MOD_RES (390)..(403): Any amino acid
  MOD_RES (426)..(449): Any amino acid
  MOD_RES (468)..(468): Any amino acid
  MOD_RES (482)..(485): Any amino acid
  MOD_RES (498)..(510): Any amino acid
  MOD_RES (522)..(522): Any amino acid
  MOD_RES (537)..(553): Any amino acid
  MOD_RES (572)..(621): Any amino acid
  MOD_RES (632)..(645): Any amino acid
  MOD_RES (668)..(678): Any amino acid
  MOD_RES (710)..(716): Any amino acid
  MOD_RES (738)..(756): Any amino acid
  MOD_RES (810)..(813): Any amino acid
  MOD_RES (842)..(842): Any amino acid
  MOD_RES (885)..(896): Any amino acid
  MOD_RES (937)..(937): Any amino acid
  MOD_RES (948)..(951): Any amino acid
  MOD_RES (982)..(987): Any amino acid
  MOD_RES (1007)..(1017): Any amino acid
  MOD_RES (1046)..(1081): Any amino acid
  MOD_RES (1098)..(1105): Any amino acid
  MOD_RES (1152)..(1152): Any amino acid
  MOD_RES (1212)..(1221): Any amino acid
  MOD_RES (1251)..(1252): Any amino acid
  MOD_RES (1266)..(1269): Any amino acid
  MOD_RES (1347)..(1356): Any amino acid
  MOD_RES (1376)..(1395): Any amino acid
  MOD_RES (1410)..(1428): Any amino acid
  MOD_RES (1448)..(1453): Any amino acid
  MOD_RES (1467)..(1475): Any amino acid
  MOD_RES (1487)..(1509): Any amino acid
  MOD_RES (1529)..(1583): Any amino acid
  MOD_RES (1620)..(1670): Any amino acid
  MOD_RES (1697)..(1709): Any amino acid
  MOD_RES (1744)..(1744): Any amino acid
  MOD_RES (1758)..(1799): Any amino acid
  MOD_RES (1817)..(1826): Any amino acid
  MOD_RES (1837)..(1851): Any amino acid
  MOD_RES (1870)..(1878): Any amino acid
  MOD_RES (1889)..(1932): Any amino acid
  MOD_RES (1955)..(1962): Any amino acid
  MOD_RES (1977)..(1981): Any amino acid
  MOD_RES (2001)..(2020): Any amino acid
  MOD_RES (2033)..(2048): Any amino acid
  MOD_RES (2071)..(2098): Any amino acid
  MOD_RES (2112)..(2117): Any amino acid
  MOD_RES (2145)..(2155): Any amino acid
  MOD_RES (2171)..(2172): Any amino acid
  MOD_RES (2199)..(2199): Any amino acid
  MOD_RES (2210)..(2210): Any amino acid
  MOD_RES (2226)..(2257): Any amino acid
  MOD_RES (2287)..(2303): Any amino acid
  MOD_RES (2315)..(2315): Any amino acid
  MOD_RES (2336)..(2347): Any amino acid
  MOD_RES (2362)..(2389): Any amino acid
  MOD_RES (2400)..(2437): Any amino acid
  MOD_RES (2467)..(2467): Any amino acid
  MOD_RES (2486)..(2505): Any amino acid
  MOD_RES (2519)..(2519): Any amino acid
  MOD_RES (2533)..(2537): Any amino acid
  MOD_RES (2571)..(2571): Any amino acid
  MOD_RES (2586)..(2597): Any amino acid
  MOD_RES (2613)..(2658): Any amino acid
  MOD_RES (2675)..(2686): Any amino acid
  MOD_RES (2701)..(2716): Any amino acid
  MOD_RES (2736)..(2746): Any amino acid
  MOD_RES (2768)..(2773): Any amino acid
  MOD_RES (2792)..(2796): Any amino acid
  MOD_RES (2821)..(2825): Any amino acid
  MOD_RES (2851)..(2892): Any amino acid
  MOD_RES (2903)..(2905): Any amino acid
  MOD_RES (2942)..(2942): Any amino acid
  MOD_RES (2970)..(3057): Any amino acid
  MOD_RES (3071)..(3095): Any amino acid
  MOD_RES (3109)..(3113): Any amino acid
  MOD_RES (3128)..(3154): Any amino acid
  MOD_RES (3168)..(3170): Any amino acid
  MOD_RES (3181)..(3207): Any amino acid
  MOD_RES (3221)..(3310): Any amino acid
  MOD_RES (3355)..(3388): Any amino acid
  MOD_RES (3407)..(3415): Any amino acid
  MOD_RES (3426)..(3427): Any amino acid
XXXXXXXXXXXRAVNMLKRGKPRGGSLMGLKRAILSLIDGKGPIRFVLALLAFFRFTAIAPTRAVLERWRGVNKQTXXXXXXXFKKELGALTSAISRRSAKKKKRGGSIGXXXXXXXXXXXRAVVLSNFQGKLMMTINATEXXXIITIPTAAGKNLCTVRAMDVGHMCDDTITYECPALAAGNDPEDIDCWCTKAAMYVRYGRCTKTRHSRRSKRXXXVQAHGESTLSNKKGAWMDSXXXXXXXXXXXXXXXXXXXXXXXXXXXXXXXXSNTTQRVVFMILLLLVAPAXXXXXXXXXXXXXXXXXXXXXXXXXXXXXDSCVTLMSKDKPTIDVKMMKMEAXXXXXXXXXXXXXXVSELSPKAACPTMGEAHNDKRADSXYFCKQGVVDRXXXXXXXXXXXXXXDTCAKFTCSNKATGLTIQRENVXXXXXXXXXXXXXXXXXXXXXXXXGATQAGRLSITPAAPSHTXKLGEYGEVTMDCEXXXXIDTSAYYVMTVGXXXXXXXXXXXXXLNLPWSSAGGTXWRNRETFMEFEEPHXXXXXXXXXXXXXXXXXQALAGAIPVSFTSNTVKLXXXXXXXXXXXXXXXXXXXXXXXXXXXXXXXXXXXXXXXXXXXXXXXXXXKDGPCKVPISXXXXXXXXXXXXXXVTVNPFVAAATADAKVLIELEPXXXXXXXXXXXGEQQINHHWHKSGISIGKAFTATLKGAQRLAXXXXXXXDFGSVGGVLTSFGKAVHQVFGXXXXXXXXXXXXXXXXXXXALLLWMGINSRDRSIALTFLAVGGVLLFLSINVHADTGCAIDVTRQELRCGSGXXXXNDVEAWTDRYKFYLETPQGLAKVIQKAHXEGVCGLRSASRLEHQMWESIKDELNTLLKENGVDFSVVVEKQXXXXXXXXXXXXATTEKFEIGWKAWGKSIIFAPEIANNTFVVDGSETRECPTXSRAWNSMEVEXXXXGLTSTRIFLKIREVNTTECDSKIIGTAIKNXXXXXXDLSYWIESGLNHTWKLERAXXXXXXXXXXXETHTLWGEGVIESELIIPVTLAGPRSNYXXXXXXXXXXXXXXXXXXXXXXXXXXXXXXXXXXXXCEHRGASARTTTESGKXXXXXXXXSCTLPPLRFQTDNGCWYGMEIRPLKHDEKTLVQSRVNAYNAEMIDPXQLGLLVVFLATKEVLRKRWTAKISLPAIMVALLVLVFGGVTYTDVLRYVILAGAAFAESXXXXXXXXXXLMATFRVQPVFVVATFVKARWTNHENILLXXAAAFFQMAYIDSQXXXXWNIPDVLNSLAVAWMVLRAISFTTTSNVVVPLLALLTPGLRCLNLDVYRILLLMIGIGSLIKEKRNAAAKKKGASLIXXXXXXXXXXNPMILVAGLLACDPNRKRGXXXXXXXXXXXXXXXXXXXXAELDVDSMAIPMTIXXXXXXXXXXXXXXXXXXXERTADISWESDVEITGSSEXXXXXXDDGGDFQLMNDPGXXXXXXXXXMFCLAISAYTPXXXXXXXXXXXXXXXXXXXXXXXWDTPSPKEYEKGDTTTGVYXXXXXXXXXXXXXXXXXXXXXXXXXXXXXXXXXXXXXXXXXXXXXXXXXXXXXXXYGGPWKLQHRWNGMDEVQMIVVEPGESVKNVQTKPGXXXXXXXXXXXXXXXXXXXXXXXXXXXXXXXXXXXXXXXXXXXXXXXXXXXVQGERMDEPIPVGFESEMLRKKKITVXXXXXXXXXXXXXLPQIIKEAMDRRLRTAVLAPTRVVAAEMADALRGXPIRYQTSAVAREHXXXXXXXXXXXXXXXXXXXXXXXXXXXXXXXXXXXXXXXXXXIAARGYISTRVELGDAAXXXXXXXXXXSSDPFPESNAXXXXXXXXXXXXXXXSGYEWITEYAGKTVWFVPXXXXXXXXXLCLQRAGKKIXXXXXXXXXXXXXXXXXXXXXXXXXXXXXXXXXXXXXXXXXXXXKSVKPTSITEGEARVILGEPSAXXXXXXXXRRGRTGRNPSQAGDXXXXXGHTNEDDSNYAHWTEARIMXXXXXXXXXXXXXXXXXXXXKVYTMEGEYRLRXXXXXXXXXXXXXXXXPVWLAYKVAAAGISYHDRRWCFXXXXXXXXXXXXXXXXXXXXXXXXXXXXPRWTDARVYSDHQXXXXXXDFASGKRSQIGFIEVLGRMPEHFMVKTXXXXXXXXXXXTAEKGGRAHSMALEEXXDALQTVALIALLSVMTMGIFFLLMQRXGIGKIGLGGIXLGAATFFCWMADVPGXXXXXXXXXXXXXXXXXXXXXXXXXXXXXXXXAVFMICVMTFISAVAANEMGWLDKTKNDMXXXXXXXXXXXXXXXXXANFLLDLRPATXWSLYAVSTAVLTPLIKHLITXXXXXXXXXXXXVQASTLFTLARGFPXXXXXXXXXXXXXXXXXXXXXXXXXXXXILLFCHYAYMXXXXXXXXXXXXXXXXXXXXXXXXXXXXXXXXXXXXXXRATPVMQKKIGQIMLILVSLAALVVNPSVXTVREAGILITSASVTLWEXXXXXXXXXXXXXXXXXXXXGGWLSCLSIAWTLXKSMEKPVLKRGGAXXXXXGEVWKERLNYMTKEEFSRYRKEAIIEVDRSAAQXARKEGNVTGGHSVSXXXXXXXXXXXXRFLEPIGKVIDLGCGXXXXXXXXXXXXXXXXXXXXXXXXXXXXXXXXXXXXXXXXXXXXXXVDVFYRPSEVSDTLLCXXXXXXXXXXXXEHRTIRVLEIVEDWXXXXXXXXXXXXXXXXMPKVIEKMEILQRRYGGGLXXXXXXXXXXXEMYWVSRASRNIVHAVNMTSQXXXXXXEKKTWKGAQYEEDANLGSXXXXXGKPLLSSDTSKIKNRIERLKKEYNXXXXXDGNHPYRTWNYHGSYDVNPTGSASSXXXXXXXXXXXXXXXXXXXXXXXXXXXXXXXXXXXXXXXXXXKAPEPPEGVRXXXKETTNWLWAFLSRGKRPRMCTREEFIKKVNSNAALGXMFEEQNQWSSAREAVEDLKFWEMVDEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGRIFADDTAGWDXXXXXXXXXXXXXXXXXXXXXXXXXARSIIELTYRYKVXXXXXPAADRKTVMDVISRXXXXXXXXXXXXXXXXXXXXXXXXXXXMEGEGVIGPEDVEXXXRGKGPKVRTWXXXXXXXXXXXXXXXXXXXXXXXXXXXFATSLHFLNAMPKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAICSAVPVDWVPTGRTTWSIHARGEWMTTEDMLSVWNRVWIEEXXXXXXXXXXXXXXXXXXXXXXXXXXXXXXXXXXSRATWAENIQVAINQVKAXXXXXXXXXYMSSLRRYEEXX

SEQ ID NO: 265791 - protein, 3434 aa, West Nile virus
  MOD_RES (1)..(11): Any amino acid
  MOD_RES (28)..(63): Any amino acid
  MOD_RES (75)..(83): Any amino acid
  MOD_RES (111)..(121): Any amino acid
  MOD_RES (142)..(144): Any amino acid
  MOD_RES (176)..(186): Any amino acid
  MOD_RES (197)..(218): Any amino acid
  MOD_RES (238)..(272): Any amino acid
  MOD_RES (289)..(354): Any amino acid
  MOD_RES (379)..(406): Any amino acid
  MOD_RES (418)..(449): Any amino acid
  MOD_RES (468)..(468): Any amino acid
  MOD_RES (479)..(485): Any amino acid
  MOD_RES (498)..(511): Any amino acid
  MOD_RES (522)..(646): Any amino acid
  MOD_RES (666)..(765): Any amino acid
  MOD_RES (783)..(790): Any amino acid
  MOD_RES (808)..(813): Any amino acid
  MOD_RES (834)..(852): Any amino acid
  MOD_RES (885)..(896): Any amino acid
  MOD_RES (909)..(916): Any amino acid
  MOD_RES (937)..(961): Any amino acid
  MOD_RES (972)..(996): Any amino acid
  MOD_RES (1007)..(1018): Any amino acid
  MOD_RES (1046)..(1081): Any amino acid
  MOD_RES (1093)..(1107): Any amino acid
  MOD_RES (1118)..(1123): Any amino acid
  MOD_RES (1150)..(1154): Any amino acid
  MOD_RES (1167)..(1167): Any amino acid
  MOD_RES (1204)..(1227): Any amino acid
  MOD_RES (1251)..(1252): Any amino acid
  MOD_RES (1265)..(1269): Any amino acid
  MOD_RES (1280)..(1280): Any amino acid
  MOD_RES (1291)..(1314): Any amino acid
  MOD_RES (1343)..(1356): Any amino acid
  MOD_RES (1376)..(1428): Any amino acid
  MOD_RES (1448)..(1475): Any amino acid
  MOD_RES (1487)..(1509): Any amino acid
  MOD_RES (1527)..(1587): Any amino acid
  MOD_RES (1602)..(1672): Any amino acid
  MOD_RES (1696)..(1710): Any amino acid
  MOD_RES (1729)..(1744): Any amino acid
  MOD_RES (1758)..(1851): Any amino acid
  MOD_RES (1862)..(1939): Any amino acid
  MOD_RES (1954)..(2051): Any amino acid
  MOD_RES (2068)..(2119): Any amino acid
  MOD_RES (2137)..(2156): Any amino acid
  MOD_RES (2168)..(2182): Any amino acid
  MOD_RES (2198)..(2199): Any amino acid
  MOD_RES (2210)..(2210): Any amino acid
  MOD_RES (2223)..(2257): Any amino acid
  MOD_RES (2269)..(2303): Any amino acid
  MOD_RES (2315)..(2320): Any amino acid
  MOD_RES (2335)..(2441): Any amino acid
  MOD_RES (2464)..(2505): Any amino acid
  MOD_RES (2516)..(2519): Any amino acid
  MOD_RES (2532)..(2537): Any amino acid
  MOD_RES (2571)..(2572): Any amino acid
  MOD_RES (2583)..(2658): Any amino acid
  MOD_RES (2675)..(2716): Any amino acid
  MOD_RES (2731)..(2748): Any amino acid
  MOD_RES (2761)..(2773): Any amino acid
  MOD_RES (2791)..(2797): Any amino acid
  MOD_RES (2821)..(2825): Any amino acid
  MOD_RES (2837)..(2917): Any amino acid
  MOD_RES (2936)..(2945): Any amino acid
  MOD_RES (2970)..(3057): Any amino acid
  MOD_RES (3070)..(3096): Any amino acid
  MOD_RES (3108)..(3114): Any amino acid
  MOD_RES (3127)..(3154): Any amino acid
  MOD_RES (3168)..(3209): Any amino acid
  MOD_RES (3220)..(3331): Any amino acid
  MOD_RES (3352)..(3434): Any amino acid
XXXXXXXXXXXRAVNMLKRGMPRVMSLXXXXXXXXXXXXXXXXXXXXXXXXXXXXXXXXXXXXAVLERWRGVNKXXXXXXXXXFKKELGALTSAINRRSEKQKKRGGVVGXXXXXXXXXXXGSVTLSNFQGKLMMTVNATDXXXIITIPIASGKNLCTVRAIDVGFMCDDTITYEXXXXXXXXXXXDIDCWCTKSPXXXXXXXXXXXXXXXXXXXXXXVQTHGESTLANKKGAWMBSXXXXXXXXXXXXXXXXXXXXXXXXXXXXXXXXXXXMQRVVFIVLLLLVAPAXXXXXXXXXXXXXXXXXXXXXXXXXXXXXXXXXXXXXXXXXXXXXXXXXXXXXXXXXXXXXXXXXXVNDLSTKAACPTMGDAHNDKRADPXXXXXXXXXXXXXXXXXXXXXXXXXXXXARFACSTKATGXXXXXXXXXXXXXXXXXXXXXXXXXXXXXXXXGATQAGRFTVSPSAPTYTXKLGGYGEVTVXXXXXXXIDTGAYYVMSVGXXXXXXXXXXXXXXNLPWSSAGGNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVNPFVSVAAANAKVLIELXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARDRSIAMTFLAVGGILXXXXXXXXADTGCAIDVSRQELRCGXXXXXXNDVKAWMDRYKFHPETPQGLXXXXXXXXXXXXXXXXXXXRLEHQMWDSVKDELNTLFKENGIDLSMVVEKQXXXXXXXXXXXXATTEKFEIGWKAXXXXXXXXPELANHTFVVDGPETKECSTXXXXXXXXXXXXXXXXXXXXXXXXXARESNTTECDXXXXXXXXXXXXXXXXXXXXXXXXXFNETWKLERAXXXXXXXXXXXXTHTLWGDGVLESELIIPATLAGPRSNHXXXXXXXXXXXXXXXXXXXXXXXXXXXXXXXXXXXXCGHRGPSARTTXXXXXXXXXXXXXXXTLPPLRFKTEXXXXXXMEIRPQKHDERTLVQSQVNAYNAEMIXXXXXGLLVVFLATKEVXRRRWTAKISMPAILVALAVLVFGGITYIDVLRYVILXXXXXXXXXXXXXXXXXXXXXXXXIQPVFMVASFLRAGWTNQENILLXXAAAFFQMAYHDAXXXXXWGIPDVLNSLXIAWMILRAITXXXXXXXXXXXXXXXXXXXXXXXXDVYKILLLMVGVGSLIKEKKNSAAKKKGXXXXXXXXXXXXXXSPLVLAAGLVACDPNRKRGXXXXXXXXXXXXXXXXXXXXXXXXXXXXXXXXXXXXXXXXXXXXXXXXXXXXXERVADISWENDAEITGSSEXXXXXXXXXXXXXXXXXXXXXXXXXXXXMVCLAVSAYTPXXXXXXXXXXXXXXXXXXXXXXXWDTPSPKEYEKGDTTTGXXXXXXXXXXXXXXXXXXXXXXXXXXXXXXXXXXXXXXXXXXXXXXXXXXXXXXXXXXXXXWKLGHRWNGQDEVQXXXXXXXXXXXXXXXXXXXXXXXXXXXXXXXXXXXXXXXXXXXXXXXXXXXXXXXXXXXXXXXXXXXXXXXGERMEEPVPSGFDPETLKKKQITXXXXXXXXXXXXXXXPQIIKEAISKRLRTAILAXXXXXXXXXXXXXXXXPIRYQTSAVNREHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSGYEWITEYAXXXXXXXXXXXXXXXXXXXXXXXXXXXXXXXXXXXXXXXXXXXXXXXXXXXXXXXXXXXXXXXXXXXXXXXXXXXXXXITDGEARVILGEPSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAHKAAAAGVSYHDRKXXXXXXXXXXXXXXXXXXXXXXXXXXXXXXXXXXXXXXXXXXXXXXXXXXXXASGKRSQMGLIEVLGKMXXXXXXXXXXXXXXXXXXXXAEKGRRAHRMAXXXXXXXXXXXXXXXLLGVMTMGIFFLLMQXXGVSKIGLAGVXLAVATLFCWMAEXXXXXXXXXXXXXXXXXXXXXXXXXXXXXXXXXXXAVFLICVLTFIXXXXXXXXXXXXXXXXXXXXXXXXXXXXXXXXXXXEDLLLDLKPATXXXXXXVATAFLTPLLKHLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMMQKKVGQVMLILVSVAAVVVNXXXXXXXXXXXXXXXXXXXXXXXXXXXXXXXXXXXXXXXXXXEGWLSCLSITXXXXKNLEKPGLKRGGXXXXXXGEVWKEKLNQMTREEFARYRKEAIIEVDRSTAKXXRKEGNVTGGYXXXXXXXXXXXXXXXXXXXXXXXXXXXXXXXXXXXXXXXXXXXXXXXXXXXXXXXXXXXXXXXXXXXXXXXXXXXXVDVFYRPSESCDTLLCXXXXXXXXXXXXXXXXXXXXXXXXXXXXXXXXXXXXXXXXXXMPKVVEKMEVLQRRXXXXXXXXXXXXXXXXXXYWVSQASGNIVHXXXXXXXXXXXXXEKKTWKGPQYEEDVSLGXXXXXXXKPLLNSDTRKIKNRVERLKREYGXXXXXDVNHPYRTWNYXXXXXXXXXXXXXXXXXXXXXXXXXXXXXXXXXXXXXXXXXXXXXXXXXXXXXXXXXXXXXXXXXXXXXXXXXXXXXXXXXREKKPRLCSREEFKRKVNXXXXXXXXXXEQNQWRSAREAVEDSTFWEMVDEEXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKTYADDTAGWXXXXXXXXXXXXXXXXXXXXXXXXXXXRAIIELTYCHKXXXXXXXAADGKTVMDIISXXXXXXXXXXXXXXXXXXXXXXXXXXXXMEGEGVITPDDVEXXXXXXXXXXXXXXXXXXXXXXXXXXXXXXXXXXXXXXXXXXISLHFLNAMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHVGGEWMTTEDMLGVWNKVWXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265792 - protein, 3427 aa, West Nile virus
  MOD_RES (108)..(121): Any amino acid
  MOD_RES (142)..(144): Any amino acid
  MOD_RES (341)..(354): Any amino acid
  MOD_RES (379)..(379): Any amino acid
  MOD_RES (444)..(449): Any amino acid
  MOD_RES (466)..(468): Any amino acid
  MOD_RES (498)..(498): Any amino acid
  MOD_RES (522)..(522): Any amino acid
  MOD_RES (602)..(602): Any amino acid
  MOD_RES (842)..(842): Any amino acid
  MOD_RES (885)..(896): Any amino acid
  MOD_RES (936)..(937): Any amino acid
  MOD_RES (962)..(965): Any amino acid
  MOD_RES (1080)..(1081): Any amino acid
  MOD_RES (1265)..(1272): Any amino acid
  MOD_RES (1355)..(1355): Any amino acid
  MOD_RES (1839)..(1839): Any amino acid
  MOD_RES (2210)..(2210): Any amino acid
  MOD_RES (2287)..(2303): Any amino acid
  MOD_RES (2519)..(2519): Any amino acid
  MOD_RES (2571)..(2571): Any amino acid
  MOD_RES (2810)..(2825): Any amino acid
  MOD_RES (2903)..(2903): Any amino acid
  MOD_RES (3055)..(3057): Any amino acid
  MOD_RES (3168)..(3170): Any amino acid
  MOD_RES (3426)..(3427): Any amino acid
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGXXXXXXXXXXXXXXGAVTLSNFQGKVMMTVNATDXXXVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAXXXXXXXXXXXXXXVSDLSTKAACPTMGEAHNDKRADPXFVCRQGVVDRGWGNGCGLFGKGSIDTCAKFACSTKAIGRTILKENIKYEVAIFVHGPTTVESHGXXXXXXGATQAGRFSITPAAPSXXXKLGEYGEVTVDCEPRSGIDTNAYYVMTVGXKTFLVHREWFMDLNLPWSSAGSTXWRNRETLMEFEEPHATKQSVIALGSQEGALHQALAGAIPVEFSSNTVKLTSGHLKCRVKMEKLQLKGTTYGVCSKAFKFXGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHXEGVCGLRSVSRLEHQMWEAVKDELNTLLKENGVDLSVVVEKQXXXXXXXXXXXXATTEKLEIGWKAWGKSILFAPELANNTFVVDGPETKECPXXNRAWNSLEVEDFGFGLTSTRMFLKXXXXNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSXXCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYHDAXXXXXXXXPDVLNSLAVAWMILRAITFTTTSNVVVPLLALLTPGLRCLNLDVYRILLLMVGIGSLIREKRSAAAKKKGASLLCLALASTGXFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPIXDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAXLGVATFFCWMAEVPGTKIAGMLLLSLLLMIVLIPEPEKQRSQTDNQLAVFLICVMTLVSAVAANEMGWLDKTKSDIXXXXXXXXXXXXXXXXXGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLXKNMEKPGLKRGGAKGRTLGEVWKERLNQMTKEEFTRYRKEAIIEVDRSAAKXARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKXXXXXXXXXXXXXXXXDENHPYRTWNYHGSYDVKPTGSASSLVNGVVRLLSKPWDTITNVTTMAMTDTTPFGQQRVFKEKVDTKAPEPPEGVKXVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGXXXGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEXXXKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDXX

SEQ ID NO: 265793 - protein, 3427 aa, West Nile virus
  MOD_RES (108)..(121): Any amino acid
  MOD_RES (142)..(144): Any amino acid
  MOD_RES (341)..(354): Any amino acid
  MOD_RES (379)..(379): Any amino acid
  MOD_RES (394)..(399): Any amino acid
  MOD_RES (444)..(449): Any amino acid
  MOD_RES (466)..(468): Any amino acid
  MOD_RES (498)..(498): Any amino acid
  MOD_RES (522)..(522): Any amino acid
  MOD_RES (602)..(602): Any amino acid
  MOD_RES (753)..(753): Any amino acid
  MOD_RES (842)..(842): Any amino acid
  MOD_RES (885)..(896): Any amino acid
  MOD_RES (936)..(937): Any amino acid
  MOD_RES (962)..(965): Any amino acid
  MOD_RES (1010)..(1014): Any amino acid
  MOD_RES (1080)..(1081): Any amino acid
  MOD_RES (1265)..(1272): Any amino acid
  MOD_RES (1355)..(1355): Any amino acid
  MOD_RES (1378)..(1389): Any amino acid
  MOD_RES (1505)..(1505): Any amino acid
  MOD_RES (1554)..(1556): Any amino acid
  MOD_RES (1769)..(1777): Any amino acid
  MOD_RES (1839)..(1839): Any amino acid
  MOD_RES (1900)..(1901): Any amino acid
  MOD_RES (2210)..(2210): Any amino acid
  MOD_RES (2287)..(2303): Any amino acid
  MOD_RES (2519)..(2519): Any amino acid
  MOD_RES (2571)..(2571): Any amino acid
  MOD_RES (2618)..(2619): Any amino acid
  MOD_RES (2641)..(2641): Any amino acid
  MOD_RES (2810)..(2825): Any amino acid
  MOD_RES (2854)..(2856): Any amino acid
  MOD_RES (2878)..(2887): Any amino acid
  MOD_RES (2903)..(2903): Any amino acid
  MOD_RES (3006)..(3021): Any amino acid
  MOD_RES (3055)..(3057): Any amino acid
  MOD_RES (3168)..(3170): Any amino acid
  MOD_RES (3280)..(3286): Any amino acid
  MOD_RES (3308)..(3308): Any amino acid
  MOD_RES (3426)..(3427): Any amino acid
MSKKPGGPGKNRAVNMQKRGMPRGLSLTGLKRAMLSLIDGRGPIRFVLALLTFFRFTAIAPTRALLDRWRGVRKQTAMKHLLSFKKELGALTNAMNRRSTKQKKRGGXXXXXXXXXXXXXXSALTLSNFQGKVIMTVNATDXXXIITIPTAAGKNLCTVRAMDVGYLCEDTITYECPVLAEGNDPEDIDCWCTKSSVFVRYGRCTRTRNSRRSRRSLNVQVHGESTLANKKGAWLDSTKASRYLMKAESWILRNPGYALVAVVIGWMLGSNTMQRVVFAILLLLVAPAYSFNCLGMSNRDFIEGASGATWMDLVLEGDSCVTIMAKDRPTIDVKMVTMGAXXXXXXXXXXXXXXVSDLSTRAACPTMGEAHNEKRADPXFVCKQGVVDRGWGNXXXXXXKGSIDTCAKFACSTKATGWIIQRENVKYEVAAFVHGPTTVDTHSXXXXXXAAVQAGRFSITPSAPSXXXTLGDYGEVTFDCEPRSGIDTSAYYVMSVGXKSFLVHREWFMDLNLPWSSPGNTXWRNREALVEFEEPHATKQSVVALGSQEGALHQALAGAIPVDYKNSVVKLTSGHLKCRVRMEKLKLKGTTYGVCAKAFRFXRTPADTGHGTVVMELQYTGTDGPCKIPITSVASLNDLTPVGRLVTVNPYVSVATANSKILVELEPPFGDSYIVIGKGDQQVTHHWHKSGSSIGKAFTTTLRGAQRLVSLGDTAWDFGSIGGVFTSVGKAIHQLFGGAFRLLFGGMSWITQXLMGALLLWMGINARDRSIAMTFLAVGGVLLFLSINVHADTGCAIDIGRQELRCGNGVFIHNDVEAWVDRYKFHPETPQGLAKIIHNAHXEGVCGVRSVSRLEHQMWESIKDELNTLLKENGVDLSIVVEKQXXXXXXXXXXXXATTEKLEMGWKAWGKSIIFAPELANNTFVIDGPETEECPXXNRAWNSMEVEDFGFGLTSTRMFLRXXXXNTTECDTKIIGTAVKNNMAVHSDLSYWIESGFNETWKLERAVLGXXXXXTWPETHTLWGDGVLESDLIIPITLAGLKSNHNRRPGYKTQSQGPWDEGRVELDFDYCPGTTVTISXXCGHRGPAARTTTESGKLISDWCCRSCTLPPLRFQTENGCWYGMEIRPTRHDEKTLVQSRVTAHNADMIDPFQLGLMVVFLATKEVLRKRWTAKISIPAIMLALLTLVFGGVTYTDLIRYVILVGAAFAEANSGGDVVHLALMATFKIQPVFLVASFLKTRWTNQESILLMLAAAFFQMAYYDAXXXXXXXXPDVLNSLSVAWMILRAISFTNTSNVATPLLALLTPGLKCLHLDIYRILLLMVGVGSLIKEKRSSAAKKKGACLICLALASTGXFNPMILAAGLITCDPNRKRGWPXXXXXXXXXXXXAIVGGLAELDIDSMAIPMTIAGLMFVAYVITGRSTDMWIERTADITWESDAEITGTSDRVDVKLDDDGNFQLINDPGAPWKIWILRMACLAVSAYTPWAILPSVIGFWITLQYTKXGGVLWDTPSPREYKRGDTTTGVYRIMTRGILGSYQAGVGVMVEGVFHTXXXTTKGAALMSGTGRLDPYWGSVREDRLCYGGPWKLQHKWNGHDEVQMIVAEPGRNTRNVQTKPGVFKTPEGEIGAVTLDYPTGTSGSPIVDRSGDVIGLYGNGVIMPNGAYISAIVQGERMEEPAPAGFEPDMLKKKQITVLDLHPGAGKTRKILPQIIKEAINKRLRTAILAPTRVVAAEMSDALRGLPIRYQTSAVHREHSGNEIVDVMCHXXXXXXXXXPHRVPNYNLFIMDEAHFTDPASIAARGYIATRVELGEAAAIFMTATPPGTSDPFPESNAPIXDMQTEIPDRAWNSGYEWITEYIGKTVWFVPSVRMGNEMALCLQRAGKKVIQLNRKSYETEXXKCKNDDWDFVVTTDISEMGANFKANRVIDSRKSVKPTIIEEGDGRVILGEPSAITAASAAQRRGRIGRNSSQAGDEYCYGGHTNEDDSNCAHWTEARIMLDNINMPNGLVAQLYQPEREKVYTMDGEYKLRGEERKNFLEFLKTADLPVWLAYKVAAAGISYHDRKWCFDGPRTNTVLEENTEVEIVTKMGERKILRPRWADARVYSDHQALKSFKDFAAGKRSQIGLVEVLGRMPEHFVVKTWEALDTMYVVATAEKGGRAHRTALEELPDALQTIALITLLSVMSLGVFCLLMQRKGIGKIGLGGTXLGAATFFCWMAEVSGTKIAGMLLLSLLMMIVLIPEPEKQRSQTDNQLAVFLICVLTLVGTVAANEMGWLDKTKNDIXXXXXXXXXXXXXXXXXESFLLDLKPATAWSLYAVSTAVMTPLLKHVITSDYINTSLTSINVQASALFTLSRGFPFVDVGVSALLLAVGCWGQVTLTVTVTATALLLCHYAYMVPGWQAEAMRAAQRRTAAGIMKNVVIDGMVATDVPELERTTPVMQKKVGQVMLILVSMAAVVVNPSVRTVREAGILTTAAAVTLWENGAGSVWNATTAIGLCHVMRGGWLSCLSMTWTLXKNMDKPVLKRGGAKGRTLGEVWKERLNHMTKEEFTRYRKEAITEVDRSAAKXARREGNITGGHSVSRGTAKLRWLVERRFLEPVGKVVDLGCGRGGWCXXMATQKRVQEVKGYTKGGPGHEXPQLVQSYGWNTVTMKSGVDVFYRPSEASDTLLCDIGESASSAEVEEHRTVRVLEMVEDWLHRGPKEFCIKVLCPYMPKVIEKMETLQRRYGGGLIRNPLSRNSTHEMYWVSHASGNIVNSVSMTSQVLLGRMEKKTWKGPQFEEDASLGSGTRAVGKPLLNSDTGKIRXXXXXXXXXXXXXXXXDANHPYRTWNYHGSYDVRPTGSASSLVNXXXRLLSKPWDTITSVTTMAMTDTXXXXXXXXXXEKVDTKAPEPAEGVKXVLNETTNWLWTFLARDKKPRMCSREEFIGKVNSNAALGAMFEEQNQWKNARAAVEDPKFWEMVDDEREAHLRGECNTCIYNMMGKREKKPGEFGKARGSRAIXXXXXXXXXXXXXXXXFLNEDHWLGRENSGGGVEGLGLQKLGYILKEVGXXXGGKMYADDTAGWDTRITKADLENEAKVLEFLDGEHRRLARSVIELTYCHKVVKVMRPAADGKTVMDIISREDQRGSGQVVTYALNTFTNLSFQLVRMMEGEGVVGPDDVEXXXKGKGVKVRVWLSENGEERLGRMAVSGDDCVVKPLDDRFATALHFLNDMPKVRKDIQEWKPSTGWYDWQQVQFCSNHFTELIMKDGRTLVVPCRGQDELIGRARISPGAGXXXXXXXCLAKSYAQMWQLLYFHRRDLRXMANAICSAVPVSWVPTGRTTWSIHAKGEWMTTEDMLAVWNRVWIEENEWMEDKTPVERWSDIPYSGKREDIWCGSLIGTRTRATWAENIHVAINQVRSVIGEEKYVDYMSSLRRYEDXX

SEQ ID NO: 265794 - protein, 3427 aa, West Nile virus
  MOD_RES (1)..(6): Any amino acid
  MOD_RES (108)..(121): Any amino acid
  MOD_RES (142)..(144): Any amino acid
  MOD_RES (246)..(262): Any amino acid
  MOD_RES (290)..(291): Any amino acid
  MOD_RES (341)..(354): Any amino acid
  MOD_RES (379)..(379): Any amino acid
  MOD_RES (391)..(401): Any amino acid
  MOD_RES (444)..(449): Any amino acid
  MOD_RES (466)..(468): Any amino acid
  MOD_RES (498)..(507): Any amino acid
  MOD_RES (522)..(522): Any amino acid
  MOD_RES (546)..(551): Any amino acid
  MOD_RES (602)..(602): Any amino acid
  MOD_RES (639)..(643): Any amino acid
  MOD_RES (670)..(673): Any amino acid
  MOD_RES (714)..(714): Any amino acid
  MOD_RES (746)..(754): Any amino acid
  MOD_RES (842)..(842): Any amino acid
  MOD_RES (885)..(896): Any amino acid
  MOD_RES (936)..(937): Any amino acid
  MOD_RES (949)..(949): Any amino acid
  MOD_RES (962)..(965): Any amino acid
  MOD_RES (1010)..(1016): Any amino acid
  MOD_RES (1080)..(1081): Any amino acid
  MOD_RES (1215)..(1217): Any amino acid
  MOD_RES (1265)..(1272): Any amino acid
  MOD_RES (1355)..(1355): Any amino acid
  MOD_RES (1377)..(1391): Any amino acid
  MOD_RES (1504)..(1508): Any amino acid
  MOD_RES (1530)..(1532): Any amino acid
  MOD_RES (1546)..(1581): Any amino acid
  MOD_RES (1622)..(1624): Any amino acid
  MOD_RES (1636)..(1638): Any amino acid
  MOD_RES (1704)..(1704): Any amino acid
  MOD_RES (1769)..(1798): Any amino acid
  MOD_RES (1818)..(1822): Any amino acid
  MOD_RES (1839)..(1839): Any amino acid
  MOD_RES (1872)..(1876): Any amino acid
  MOD_RES (1898)..(1915): Any amino acid
  MOD_RES (1959)..(1960): Any amino acid
  MOD_RES (2034)..(2045): Any amino acid
  MOD_RES (2088)..(2089): Any amino acid
  MOD_RES (2210)..(2210): Any amino acid
  MOD_RES (2233)..(2254): Any amino acid
  MOD_RES (2287)..(2303): Any amino acid
  MOD_RES (2341)..(2343): Any amino acid
  MOD_RES (2411)..(2414): Any amino acid
  MOD_RES (2491)..(2501): Any amino acid
  MOD_RES (2519)..(2519): Any amino acid
  MOD_RES (2571)..(2571): Any amino acid
  MOD_RES (2614)..(2624): Any amino acid
  MOD_RES (2636)..(2651): Any amino acid
  MOD_RES (2679)..(2680): Any amino acid
  MOD_RES (2736)..(2745): Any amino acid
  MOD_RES (2794)..(2795): Any amino acid
  MOD_RES (2810)..(2825): Any amino acid
  MOD_RES (2854)..(2857): Any amino acid
  MOD_RES (2876)..(2890): Any amino acid
  MOD_RES (2903)..(2903): Any amino acid
  MOD_RES (2990)..(3040): Any amino acid
  MOD_RES (3055)..(3057): Any amino acid
  MOD_RES (3135)..(3137): Any amino acid
  MOD_RES (3168)..(3170): Any amino acid
  MOD_RES (3197)..(3200): Any amino acid
  MOD_RES (3228)..(3230): Any amino acid
  MOD_RES (3243)..(3249): Any amino acid
  MOD_RES (3271)..(3309): Any amino acid
  MOD_RES (3356)..(3359): Any amino acid
  MOD_RES (3377)..(3378): Any amino acid
  MOD_RES (3426)..(3427): Any amino acid
XXXXXXGPGKNRAVNMQKRGTPRVLSLIGLKRAVLSLIDGRGPTRFVLALLAFFKFTAIAPTRAVLDRWRSVNKQTAMKHLTSFKKELGTLTNAMNRRSLKQKKRGGXXXXXXXXXXXXXXGAVTLSNFQGKLMMTINATEXXXIITIPTAAGKNLCIIRAMDVGFMCDDTIAYECPALMEGNDPEDIDCWCTKLAVYVRYGRCTKTRQSRRSRRSLTVQTHGESSLSNRKGAWLDSTKASRYLMXXXXXXXXXXXXXXXXXVTGWMLGSNTMQRVVFAVLLLLVAPAYXXNCLGMSSRDFLEGVSGATWMDLVLEGDSCVTLTAKDKPTIDVKMTNMEAXXXXXXXXXXXXXXATEISSSAACPTMGEAHNEKRTDSXYVCRQGVVDRGXXXXXXXXXXXSIDTCAKFACTTKATGLTIQKEBIKYEVAIFVHGPTTVESHRXXXXXXGATQAGRFSVSPAAPTXXXKLGDYGEVTMDCEPRSGVDVDAFYVMTVGXXXXXXXXXXFMDLNLPWSSAESNXWRNRETLVEFEEAHATKQSVVALXXXXXXLHQALAGAIPVSFTSNTVKLSSGHLKCRVKMEKLKLKGTTYGVCSKAFRFXNTPADTGHGTVVLELQYTGTDGPCKIPISSVASLNDXXXXXRLVTVNPFVSVSTANAKILVELEPPFXXXXIVVGRGEQQINHHWHKSGSSIGKAFATTLQGAQRLVSLGDXAWDFGSVGGVFNSIGKAVHQVFGGAFRLLFGXXXXXXXXXLGALLLWMGISSRDRSIALTFLAVGGVLLFLSANVHADTGCAIDLKRQELRCGSGVFIHNDVEAWIDRYRYYLETPQGLAKVIQKAHXSGVCGIRSVSRLEHQMWEAVKDELNTLLKENGIDLSIVVEKQXXXXXXXXXXXXATTENLEIGWKAWGKSILFAPELANHTFVIDGPETKECPXXDRAWNSLEVEDXGFGLTSTRMFMKXXXXNTTECDSKTIGTAIKNNLAIHSDLSYWIESRLNHTWKLERAVLGXXXXXXXPETHTLWGEGILESDLIIPITLAGPKSNHNRRPGYKMQNQGPWDEGRIEIDFDYCPGTTVTVSXXCGHRGPAIRTTTESGKLITDWWCRSCTLPPLRYRTESGCWYGMEIRPLRHDEKTLVQSKVNAYKSDMIDPFQLGLLVVVLATQEVLRKRWTAKISVPAIIIALLVLVLGGVTYIDVLRYIILVGAAFMEANSGXXXVHLALMATFKIQPAFMVASFLKAKWTNQENILLMLAAVFFQMAYYDAXXXXXXXXPDVLNSLSVAWMILRAIGFTTTSNVVVPLMALLTPGLKCLNLDVYRILLLMVGVGSLVKERRSAVAKKKGASLICLALASTGXFNPLILAAGLMACDPNRKRGWXXXXXXXXXXXXXXXVGGLAELDMDSMAIPMTIAGLMFAAYVITGRSTDMWIERTADISWEGDVEITGSSERVDVRLDDDEDFQLMSDPGAPWKIWMLKMTCLAVSAYTPWAILPSVVGFWISLQYTXXXXXLWDTPSPREYRKGDTTTGVYRXXXRGLLGNYQAGVGVXXXXXXXXXXXXXXXXXXXXXXXXXXXXXXXXXXXXLCYGGPWKLQRKWNGLDEVQMIVVEPGKNAKNVQTKPGVFXXXDGEIGAVTLDYXXXTSGSPIVDKNSDVIGLYGNGVIMPSGSYISAIVQGERMDEPVPAGFDPDTLRKKKITVLDLHPGAXKTRKILPQIIREAINKRLRTAILAPTRVVASEMAEALRGLPIRYQTSAVTREHTGNEIVDVMCHXXXXXXXXXXXXXXXXXXXXXXXXXXXXXXSIAARGYISTRVELGEAAAXXXXXTPPGTSDPFPESNAPVXDIQTEIPDRAWNTGYEWITEYVGKTVWFVPSVXXXXXMAQCLQRAGKRVIQLNRKSYEXXXXXXXXXXXXXXXXXXISEMGANFRASRVIDSRKSVKPTIITDGENRVVLGEPSAITAAXXAQRRGRVGRNPTQVGDEYCYGGHTNEDDSNLAHWTEARIMPDNINMPNGLIAQLYQPEREKVYTMEGEYRLRGXXXXXXXXXXXXADLPVWLAYQVAAAGVPYHDRRWCFDGPRTNTVLEDNNEVEVXXKVGERKILRPRWVDARVYSDHQALKLFKDFASGRRSQIGLVEVIGRMPEHFMVKTWEALDTMYVVATAERGGRAHSMALEELPDALQTIVLIALLSVMTLGVFLLLMQRKGIGKIGLGGVXLGLATFFCWMADVPGTKIAGMLXXXXXXXXXXXXXXXXXXXXXXNQLAMFLICVMTLVGTVAANEMGWLDRTKSDIXXXXXXXXXXXXXXXXXESFFLDLRPATAWSLYAVATAVLTPLLKHLITSDYITXXXTSINVQASALYSLARGFPFVDVGISSLLLAVGCWEQVTLTVTVTSATLLFCHYAYMIPGWQAEAMRSXXXXTAAGIMKNAVIDGMVATDVPELERATPIMQKKVGQIILILVSTAALVVNPSVKTVREAGILVSAAAVTLWEKGASSXXXXXXXXXXXHVMRGGWLSCLSIMWTLXKNMGKPGLKRGGAKGRTLGEVWKDRLNRLTKEEFIRYRKEAIIEVDRSAARXARKERNVTGGYPVSRGTAKLRWLVERRFLDPIGKVVDLGCGRXXXXXXXXXXXRVQEVRGYTKRXXXXXXXXXXXXXXXXIVTMKSGVDVYYRASEVSDTLLCDIGEXXSSAEVEEHRTLRVLEMVEDWLHRGPKEFCVKVLCPYMPKVIEKMEVLQRRYGGGLXXXXXXXXXXHEMYWVSRASGNIVHAVNMTSQVLLGRMEKKTWKGPHYEEDANLGSGTXXVGKPLLNSDTSKINXXXXXXXXXXXXXXXXDDNHPYRTWNYHGSYEVNPTGSASSLVNXXXXLLSKPWDVITNVTTMAMTXXXXXXXXXXXXXXXDTKAPEPPEGVRXVLNETTNWLWAYLARNKRPRMCSREEFIKKVNSNAALGAMFEEQNQWKSAREAVEDPKFWEIVDEEREAHLRGECYTCIYNMMGKRXXXXXXXXXXXXXXXXXXXXXXXXXXXXXXXXXXXXXXXXXXXXXXXXXXXLGLQKLGYVLREVGXXXGGKVYADDTAGWDTPITKADLENEAKVLELLDGEHRRLARSIIQLTYRYKVVKVMRPAVGGKTVMDVISREDQRGRGXXXTYALNPFTNLAFQLVRRMEGEGVIGPYDVEXXXKGKGPKVRTWLFENGKERLGRMAVSGXXXXVKPLDDRFAISLHFLNAMPKVRKDIQEXXXSTGWYDWQKVQFXXXXXXXLVMKDGRTLVTPCRGQDELVGXXXXXXXXXXXXXXXXXXXXXXXXXXXXXXXXXXXXXXXANAICSAVPADWVPTGRTTWSIHARGEWMTTADMLGVWNRVWIEENXXXXDKTPVERWSDIPYSGKRXXIWCGSLIGTRTRATWAENIQVAINQVRSIIGEEKYVDYMGSLKRYEEXX

SEQ ID NO: 265795 - protein, 3427 aa, West Nile virus
  MOD_RES (1)..(11): Any amino acid
  MOD_RES (78)..(82): Any amino acid
  MOD_RES (108)..(121): Any amino acid
  MOD_RES (142)..(144): Any amino acid
  MOD_RES (239)..(268): Any amino acid
  MOD_RES (290)..(316): Any amino acid
  MOD_RES (341)..(354): Any amino acid
  MOD_RES (379)..(379): Any amino acid
  MOD_RES (391)..(402): Any amino acid
  MOD_RES (432)..(449): Any amino acid
  MOD_RES (466)..(468): Any amino acid
  MOD_RES (483)..(484): Any amino acid
  MOD_RES (498)..(508): Any amino acid
  MOD_RES (522)..(522): Any amino acid
  MOD_RES (538)..(552): Any amino acid
  MOD_RES (573)..(620): Any amino acid
  MOD_RES (633)..(644): Any amino acid
  MOD_RES (669)..(677): Any amino acid
  MOD_RES (711)..(715): Any amino acid
  MOD_RES (743)..(755): Any amino acid
  MOD_RES (842)..(842): Any amino acid
  MOD_RES (885)..(896): Any amino acid
  MOD_RES (936)..(937): Any amino acid
  MOD_RES (949)..(950): Any amino acid
  MOD_RES (962)..(968): Any amino acid
  MOD_RES (983)..(986): Any amino acid
  MOD_RES (1008)..(1016): Any amino acid
  MOD_RES (1056)..(1081): Any amino acid
  MOD_RES (1099)..(1104): Any amino acid
  MOD_RES (1213)..(1220): Any amino acid
  MOD_RES (1265)..(1272): Any amino acid
  MOD_RES (1348)..(1355): Any amino acid
  MOD_RES (1377)..(1394): Any amino acid
  MOD_RES (1411)..(1427): Any amino acid
  MOD_RES (1449)..(1451): Any amino acid
  MOD_RES (1468)..(1475): Any amino acid
  MOD_RES (1488)..(1488): Any amino acid
  MOD_RES (1500)..(1508): Any amino acid
  MOD_RES (1530)..(1582): Any amino acid
  MOD_RES (1621)..(1669): Any amino acid
  MOD_RES (1698)..(1708): Any amino acid
  MOD_RES (1758)..(1798): Any amino acid
  MOD_RES (1818)..(1825): Any amino acid
  MOD_RES (1839)..(1850): Any amino acid
  MOD_RES (1871)..(1877): Any amino acid
  MOD_RES (1890)..(1931): Any amino acid
  MOD_RES (1956)..(1961): Any amino acid
  MOD_RES (1978)..(1980): Any amino acid
  MOD_RES (2002)..(2019): Any amino acid
  MOD_RES (2034)..(2047): Any amino acid
  MOD_RES (2072)..(2097): Any amino acid
  MOD_RES (2113)..(2116): Any amino acid
  MOD_RES (2146)..(2154): Any amino acid
  MOD_RES (2210)..(2210): Any amino acid
  MOD_RES (2227)..(2256): Any amino acid
  MOD_RES (2287)..(2303): Any amino acid
  MOD_RES (2337)..(2346): Any amino acid
  MOD_RES (2363)..(2389): Any amino acid
  MOD_RES (2401)..(2436): Any amino acid
  MOD_RES (2467)..(2467): Any amino acid
  MOD_RES (2487)..(2504): Any amino acid
  MOD_RES (2519)..(2519): Any amino acid
  MOD_RES (2534)..(2536): Any amino acid
  MOD_RES (2571)..(2571): Any amino acid
  MOD_RES (2589)..(2596): Any amino acid
  MOD_RES (2614)..(2657): Any amino acid
  MOD_RES (2676)..(2685): Any amino acid
  MOD_RES (2702)..(2715): Any amino acid
  MOD_RES (2736)..(2745): Any amino acid
  MOD_RES (2769)..(2772): Any amino acid
  MOD_RES (2793)..(2795): Any amino acid
  MOD_RES (2810)..(2825): Any amino acid
  MOD_RES (2852)..(2891): Any amino acid
  MOD_RES (2903)..(2903): Any amino acid
  MOD_RES (2971)..(3057): Any amino acid
  MOD_RES (3072)..(3088): Any amino acid
  MOD_RES (3112)..(3112): Any amino acid
  MOD_RES (3129)..(3151): Any amino acid
  MOD_RES (3168)..(3170): Any amino acid
  MOD_RES (3193)..(3206): Any amino acid
  MOD_RES (3222)..(3309): Any amino acid
  MOD_RES (3356)..(3387): Any amino acid
  MOD_RES (3407)..(3410): Any amino acid
  MOD_RES (3426)..(3427): Any amino acid
XXXXXXXXXXXRAVNMQKRGKPRVMSLIGLKRAMLSLIDGKGPIRFVLALLVFFKFTAVAPTRALLERWRGVNKQTAXXXXXSFKKELGALTSAINRRSAKQKKRGGXXXXXXXXXXXXXXRAVTLSNFQGKLMMTINATDXXXIITIPIASGKNLCTVRAMDVGHLCDDTITYECSALAAGNDPEDVDCWCTKSAVYVRYGRCTKTRQSRRSRRSLTVQTHGKSTLSNKKGAWMDSTXXXXXXXXXXXXXXXXXXXXXXXXXXXXXXGSNTTQRVVFMILLLLVAPAYXXXXXXXXXXXXXXXXXXXXXXXXXXXGDSCVTIMSKNKPTIDVKMMNVEAXXXXXXXXXXXXXXVSELSPKAACPTMGEAHNDKRADSXYFCKQGVVDRGXXXXXXXXXXXXIDTCAKFTCSNKATGLTILKEBIKYEVAIXXXXXXXXXXXXXXXXXXGAAQAGRLSITPAAPSXXXNLGEYGEVTMDCEPXXGIDTSAYYVMTVGXXXXXXXXXXXMDLNLPWSSAGGNXWRNRGTLMEFEEPHAXXXXXXXXXXXXXXXQQALAGTIPVSFTSNTVKLTXXXXXXXXXXXXXXXXXXXXXXXXXXXXXXXXXXXXXXXXXXXXXXXXGKDGPCKVPISSXXXXXXXXXXXXLVTVNPFVSMAAANAKVLVELEPPXXXXXXXXXRGEQQINHHWYKSGSSIGKAFTATLKGAQRLAAXXXXXWDFGSVGGILTSVGQAVHQVFGGAFRLXXXXXXXXXXXXXGALLLWMGINSRDRSIALMFLAIGGILLFLSVNVHADTGCAIDVSRQELRCGSGVFIHNDVEAWTDRYKFYPETPQGLARIIQKAHXEGTCGIRSASRLEHQMWESIKDELNTLLKENGIDLSMVVEKQXXXXXXXXXXXXATSDKLEIGWKAWGKSIIFAPEIANNTFVVDGSETRECPXXSRAWNSMEVEDXXFGLTSTRIFLKXXXXXXXECDSKIIGTAIKNNXXXXSDLSYWIESGFNETWKLERAVXXXXXXXXXPETHTLWGEGVQESELIIPATLAGPRSNHNRRPGYKMQNXXXXXXXXXXXXXXXXXXXXXXXXXXCEHRGPSARTTTESGKLXXXXXXRSCTLPPLRFKTDNGCWYGMEIRPQKHDEKTLVQSRVNAHNADMIDPFQLGLLIVFLATKEVLRKRWTAKISLPAILIALLVLVFGGITYADVLRYVNLVGAAFAESNXXXXXXXXALMATFRVQPVFMVATFVKARWTNHENILLMLAAAFFQMAYIDSXXXXXXXXPDVLNSLAVAWMVLRAISFTTTSNVVVPALALLTPGLRCLNLDVYKILLLMIGIGSLIKERKNAAAKKKGASLICXXXXXXXXFNPMILVAGLLACDPNRKRGWXXXXXXXXXXXXXXXXXXLAELDVDSMAIPMTIAXXXXXXXXXXXXXXXXXIERTADISWESDVEITGSSERXXXRLDDGGNFQLMSDPGAXXXXXXXXMACLAVSAYTPWXVLPSVVGFWITXXXXXXXXXLWDTPSPKVYRKGDTATGVYRXXXXXXXXXXXXXXXXXXXXXXXXXXXXXXXXXXXXXXXXXXXXXXXXXXXXXCYGGPWKLQHRWNGHDEVQMIVVEPGEKTRNVQTKPGVXXXXXXXXXXXXXXXXXXXXXXXXXXXXXXXXXXXXXXXXXXXXXXXXXIVQGERMEEPVPSGFEPETLKKKQITVLXXXXXXXXXXXILPQIIKEAMDRRLRTAVLAPTRVVTAEMAEALRGLPIRYQTSAVAREHXXXXXXXXXXXXXXXXXXXXXXXXXXXXXXXXXXXXXXXXXSIAARGYIATRVELGEAAAXXXXXXXXGSSDPFPKSNSPIXXXXXXXXXXXXNSGYEWITEFVGKTVWFVPSXXXXXXXALCLQRAGKKIVXXXXXXXXXXXXXXXXXXXXXXXXXXXXXXXXXXXXXXXXXXRKSVKPTSITEGESRVVLGEPSAIXXXXXXQRRGRIGRNPTQVGDEXXXGGHTNEDDSNYAHWTEARIMLXXXXXXXXXXXXXXXXXXEKVHTMDGEYRLRGXXXXXXXXXXXXXXLPVWLAYKAAAAGISYHDRRWCFDXXXXXXXXXXXXXXXXXXXXXXXXXXRPWWTDARVYSDHQAXXXXKDFAAGKRSQIGFIEVLGRMPEHFMVKTWXXXXXXXXXATAEKGRRAHRMALEELPDALQTVALIALLGVMTMGVFLLLMQRKGIGKIGLGGIXLGAATLFCWMAEVPGTXXXXXXXXXXXXXXXXXXXXXXXXXXXXXXLAVFLICVMTPVSAVAANEMGWLDKTKNDMXXXXXXXXXXXXXXXXXAEFFLDLRPATAWSLYAVTTAVLTPLIKHLITSXXXXXXXXXXNVQASTLFTLARGFPFXXXXXXXXXXXXXXXXXXXXXXXXXXXVLLFCHYAYMVXXXXXXXXXXXXXXXXXXXXXXXXXXXXXXXXXXXXERATPVMQKKIGQIMLILVSLAALVVNPSVXTVREAGILITSASVTLWENXXXXXXXXXXXXXXXXXXRGGWLSCLSIAWTLXKNLEKPVLKRGGAKXXXLGEAWKERLNQLTREEFTRYRKEAIIEVDRSAAQXARREGNITGGHPVSRGSXXXXXXXXRKFVEPIGKVIDLGCGRXXXXXXXXXXXXXXXXXXXXXXXXXXXXXXXXXXXXXXXXXXXXKVDVFYRPSEVSDTLLCDXXXXXXXXXXEEHRTIRVLEIVEDWLXXXXXXXXXXXXXXYMPKVIEKMEILQRRYGGGLXXXXXXXXXXHEMYWVSRASRNIVHAVNMTSQVXXXXMEKKTWKGAQYEEDANLGSGXXXVGRPLLSSDTSKIKXXXXXXXXXXXXXXXXDGNHPYRTWNYHGSYEVNPLVSASSLXXXXXXXXXXXXXXXXXXXXXXXXXXXXXXXXXXXXXXXXTKAPEPPAGVKXVLKETTNWLWSHLERGKRPRMCTREEFISKVNSNAALGAMFEEQNQWSSAREAVEDLKFWEMVDEERXXXXXXXXXXXXXXXXXXXXXXXXXXXXXXXXXXXXXXXXXXXXXXXXXXXXXXXXXXXXXXXXXXXXXXXXXXXXXXXXXXXXXXXGGRTYADDTAGWDTXXXXXXXXXXXXXXXXXEGEHRRLARAIIELTYRHKVVKGXRPAADGKTVMSLISREXXXXXXXXXXXXXXXXXXXXXXXVRMREGEGVIGPEDVEXXXKRKGPKVRTWLFENGEERLGRMXXXXXXXXXXXXXXRFASSLHFLNAMPKVXXXXXXXXXXXXXXXXXXXXXXXXXXXXXXXXXXXXXXXXXXXXXXXXXXXXXXXXXXXXXXXXXXXXXXXXXXXXXXXXXXXXXXXXANAICSAVPVDWVPTGRTTWSIHVRGEWMTTEDMLSVWNRVWIEENXXXXXXXXXXXXXXXXXXXXXXXXXXXXXXXXRSRATWAENIQVAINQVKAXXXXGKYVDYMSSLRRYEEXX

SEQ ID NO: 265796 - protein, 3434 aa, West Nile virus
  MOD_RES (1)..(11): Any amino acid
  MOD_RES (35)..(62): Any amino acid
  MOD_RES (76)..(82): Any amino acid
  MOD_RES (108)..(121): Any amino acid
  MOD_RES (142)..(144): Any amino acid
  MOD_RES (177)..(185): Any amino acid
  MOD_RES (207)..(217): Any amino acid
  MOD_RES (239)..(272): Any amino acid
  MOD_RES (290)..(354): Any amino acid
  MOD_RES (379)..(405): Any amino acid
  MOD_RES (419)..(449): Any amino acid
  MOD_RES (466)..(468): Any amino acid
  MOD_RES (480)..(484): Any amino acid
  MOD_RES (498)..(510): Any amino acid
  MOD_RES (522)..(552): Any amino acid
  MOD_RES (564)..(645): Any amino acid
  MOD_RES (667)..(765): Any amino acid
  MOD_RES (789)..(789): Any amino acid
  MOD_RES (808)..(813): Any amino acid
  MOD_RES (837)..(851): Any amino acid
  MOD_RES (885)..(896): Any amino acid
  MOD_RES (910)..(915): Any amino acid
  MOD_RES (936)..(996): Any amino acid
  MOD_RES (1008)..(1017): Any amino acid
  MOD_RES (1047)..(1081): Any amino acid
  MOD_RES (1094)..(1106): Any amino acid
  MOD_RES (1118)..(1122): Any amino acid
  MOD_RES (1151)..(1153): Any amino acid
  MOD_RES (1204)..(1227): Any amino acid
  MOD_RES (1265)..(1279): Any amino acid
  MOD_RES (1303)..(1307): Any amino acid
  MOD_RES (1344)..(1355): Any amino acid
  MOD_RES (1377)..(1427): Any amino acid
  MOD_RES (1449)..(1451): Any amino acid
  MOD_RES (1463)..(1475): Any amino acid
  MOD_RES (1488)..(1508): Any amino acid
  MOD_RES (1528)..(1586): Any amino acid
  MOD_RES (1603)..(1671): Any amino acid
  MOD_RES (1697)..(1709): Any amino acid
  MOD_RES (1730)..(1743): Any amino acid
  MOD_RES (1758)..(1850): Any amino acid
  MOD_RES (1863)..(1878): Any amino acid
  MOD_RES (1890)..(1939): Any amino acid
  MOD_RES (1956)..(1990): Any amino acid
  MOD_RES (2002)..(2050): Any amino acid
  MOD_RES (2069)..(2118): Any amino acid
  MOD_RES (2138)..(2155): Any amino acid
  MOD_RES (2169)..(2185): Any amino acid
  MOD_RES (2210)..(2210): Any amino acid
  MOD_RES (2224)..(2256): Any amino acid
  MOD_RES (2269)..(2303): Any amino acid
  MOD_RES (2316)..(2319): Any amino acid
  MOD_RES (2336)..(2389): Any amino acid
  MOD_RES (2401)..(2440): Any amino acid
  MOD_RES (2465)..(2475): Any amino acid
  MOD_RES (2487)..(2504): Any amino acid
  MOD_RES (2517)..(2519): Any amino acid
  MOD_RES (2533)..(2536): Any amino acid
  MOD_RES (2571)..(2571): Any amino acid
  MOD_RES (2583)..(2657): Any amino acid
  MOD_RES (2676)..(2715): Any amino acid
  MOD_RES (2732)..(2747): Any amino acid
  MOD_RES (2761)..(2772): Any amino acid
  MOD_RES (2792)..(2796): Any amino acid
  MOD_RES (2810)..(2825): Any amino acid
  MOD_RES (2838)..(2917): Any amino acid
  MOD_RES (2937)..(2944): Any amino acid
  MOD_RES (2971)..(3057): Any amino acid
  MOD_RES (3071)..(3095): Any amino acid
  MOD_RES (3109)..(3113): Any amino acid
  MOD_RES (3128)..(3153): Any amino acid
  MOD_RES (3168)..(3208): Any amino acid
  MOD_RES (3220)..(3333): Any amino acid
  MOD_RES (3353)..(3434): Any amino acid
XXXXXXXXXXXRAVNMLKRGTPRVMSLIGLKRAMXXXXXXXXXXXXXXXXXXXXXXXXXXXXRAVLERWRGVNKQXXXXXXXSFKKELGILTNAINRRSSKEKKRGGXXXXXXXXXXXXXXGSVTLSNFQGKLMMTVNATDXXXVITIPPAAGKNLCTVRAMDVGFLCDDTITYECXXXXXXXXXEDIDCWCTKSPVYVRYGRCTKXXXXXXXXXXXTVQTHGKSTLVNKKGAWLDSTXXXXXXXXXXXXXXXXXXXXXXXXXXXXXXXXXXMQRVVFIVLLLLVAPAYXXXXXXXXXXXXXXXXXXXXXXXXXXXXXXXXXXXXXXXXXXXXXXXXXXXXXXXXXXXXXXXXXVSELSTKAACPTMGDAHNDKRADPXXXXXXXXXXXXXXXXXXXXXXXXXXXCAKFACTSKATGWXXXXXXXXXXXXXXXXXXXXXXXXXXXXXXXGATQAGRFTVSPSAPTXXXKLGGYGEVTVDXXXXXGIDTNAYYVMSVGXXXXXXXXXXXXXLNMPWSSAAGTXXXXXXXXXXXXXXXXXXXXXXXXXXXXXXXHQALAGAIPLEXXXXXXXXXXXXXXXXXXXXXXXXXXXXXXXXXXXXXXXXXXXXXXXXXXXXXXXXXXXXXXXXXXXXXXXXXXXXXXXXXXVTVNPFVSVATADAKVLIELEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARDKSIAMTFLAVGGILLFLSANXHADTGCAIDVSRQELRCGXXXXXXNDVKAWMDRYKYYPETPQGLARIXXXXXXXXXXXXXXXSRLEHQMWDSVKDELNTLLKENGVDLTVVVEKQXXXXXXXXXXXXATTEKFEIGWKAWXXXXXXASELANHTFVVDGPETEECPXXXXXXXXXXXXXXXXXXXXXXXXXXXXXXXXXXXXXXXXXXXXXXXXXXXXXXXXXXXXXLNHTWKLERAVXXXXXXXXXXETHTLWGDGVIESDLIIPVTLAGPRSNYNXXXXXXXXXXXXXXXXXXXXXXXXXXXXXXXXXXXCGHRGPSARTTTXXXXXXXXXXXXXCTLPPLRYTTEXXXXXGMEIRPLRHDGKTLVQSRVSAYKSDMIDXXXLGLLVVFLVTQEVLRRRWTAKISMPAILLALLVLVFGGITYTDVLRYIILXXXXXXXXXXXXXXXXXXXXXXXXIQPVFVVASFLKARWTNQENTLLMLAAAFFQMAYHDAXXXXXXXXXXXXXXXAIAWMILRAITFPTTSNVVVPLLXXXXXRLRCLNLDVSRILLLMIGIGSLIREKKNSAAKKKGAXXXXXXXXXXXXFSPLVLAAGLVACDPNRKRGWXXXXXXXXXXXXXXXXXXXXXXXXXXXXXXXXXXXXXXXXXXXXXXXXXXXIERTADISWENDAEITGSSERXXXRLDDDGDFQLMXXXXXXXXXXXXXMFCLAISAYTPWXXXXXXXXXXXXXXXXXXXXXLWDTPSPKEYRKGDTATGVXXXXXXXXXXXXXXXXXXXXXXXXXXXXXXXXXXXXXXXXXXXXXXXXXXXXXXXXXXXPWKLQCKWNGQDEVQMXXXXXXXXXXXXXXXXXXXXXXXXXXXXXXXXXXXXXXXXXXXXXXXXXXXXXXXXXXXXXXXXXXXXXQGERMEEPPPVGFESEMLRKKQITVXXXXXXXXXXXXXLPQIIKEAINRRLRTAILAPXXXXXXXXXXXXXXLPIRYQTSAVNREHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNAGYEWITEFVGXXXXXXXXXXXXXXXXLCLQRAGKRVIXXXXXXXXXXXXXXXXXXXXXXXXXXXXXXXXXXXXXXXXXXXXXXXXXXITDGEGKVVLSEPSAIXXXXXXXXXXXXXXXXXXXXXXXXXXXXXXXXXXXFAHWTEARIMPXXXXXXXXXXXXXXXXXXXXXXXXXXXXXXXXXXXXXXXXXXXXXXXXXWLAYKAAAAGVSYHDRKWXXXXXXXXXXXXXXXXXXXXXXXXXXXXXXXXXXXXXXXXXXXXXXXXXXFASGKRSQMGLIEVLGKMPXXXXXXXXXXXXXXXXXXTAEKGRRAHRMALXXXXXXXXXXXXXXXXXVMSMGVFFLLMQRKGVSKIGLAGVXIGVATLFCWMAEVXXXXXXXXXXXXXXXXXXXXXXXXXXXXXXXXXLAVFMICVMTLVXXXXXXXXXXXXXXXXXXXXXXXXXXXXXXXXXXXGDLLLDLKPATAXXXXAVTTAFLTPLLKHLITXXXXXXXXXXXXXXXXXXXXXXXXXXXXXXXXXXXXXXXXXXXXXXXXXXXXXXILLFCHYAYMVXXXXXXXXXXXXXXXXXXXXXXXXXXXXXXXXXXXXXXXXPIMQKKIGQIMLIWVSLAAVVVNPXXXXXXXXXXXITAAAVTLWEKXXXXXXXXXXXXXXXXXXRGGWLSCFSITWXXXKNMEKPVLKRGGAXXXXLGEVWKEKLNQMTKEEFARYRKEAIIEVDRSTAKXARKEGNVTGGYXXXXXXXXXXXXXXXXXXXXXXXXXXXXXXXXXXXXXXXXXXXXXXXXXXXXXXXXXXXXXXXXXXXXXXXXXXXGVDVFYRPSESCDTLLCDXXXXXXXXXXXXXXXXXXXXXXXXXXXXXXXXXXXXXXXXYMPRVIEKMELLQLRYXXXXXXXXXXXXXXXXMYWVSQASGNIVHXXXXXXXXXXXXMEKKTWKGPHYEEDVNLGSXXXXXGKPLLNSDTSRIKXXXXXXXXXXXXXXXXDVNHPYRTWNYHXXXXXXXXXXXXXXXXXXXXXXXXXXXXXXXXXXXXXXXXXXXXXXXXXXXXXXXXXXXXXXXXXXXXXXXXXXXXXXXXREKKPRLCSREEFKRKVNSXXXXXXXXEEQNQWRSAREAVEDSTFWEMVDEERXXXXXXXXXXXXXXXXXXXXXXXXXXXXXXXXXXXXXXXXXXXXXXXXXXXXXXXXXXXXXXXXXXXXXXXXXXXXXXXXXXXXXXXGGKIFADDTAGWDXXXXXXXXXXXXXXXXXXXXXXXXXARSIIQLTYRHKVXXXXXPAADGKTVMDIISRXXXXXXXXXXXXXXXXXXXXXXXXXXRREGEGVIGPDDIEXXXXXXXXXXXXXXXXXXXXXXXXXXXXXXXXXXXXXXXXXATSLHFLNDMSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGEWMTTADMLGVWNKVWIXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 265797 - protein, 3412 aa, Yellow fever virus
  MOD_RES (2275)..(2276): Any amino acid
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTAGEIHAVPFGLVSMMIAMEVVLRKRQGPKQMLVGGVVLLGAMLVGQVTLLDLLKLTVAVGLHFHEMNNGGDAMYMALIAAFSIRPGLLIGFGLRTLWSPRERLVLTLGAAMVEIALGGVMGGLWKYLNAVSLCILTINAVASRKASNTILPLMALLTPVTMAEVRLAAMFFCAVVIIGVLHQNFKDTSMQKTIPLVALTLTSYLGLTQPFLGLCAFLATRIFGRRSIPVNEALAAAGLVGVLAGLAFQEMENFLGPIAVGGLLMMLVSVAGRVDGLELKKLGEVSWEEEAEISGSSARYDVALSEQGEFKLLSEEKVPWDQVVMTSLALVGAALHPFALLLVLAGWLFHVRGARRSGDVLWDIPTPKIIEECEHLEDGIYGIFQSTFLGASQRGVGVAQGGVFHTMWHVTRGAFLVRNGKKLIPSWASVKEDLVAYGGSWKLEGRWDGEEEVQLIAAVPGKNVVNVQTKPSLFKVRNGGEIGAVALDYPSGTSGSPIVNRNGEVIGLYGNGILVGDNSFVSAISQTEVKEEGKEELQEIPTMLKKGMTTILDFHPGAGKTRRFLPQILAECARRRLRTLVLAPTRVVLSEMKEAFHGLDVKFHTQAFSAHGSGREVIDAMCHATLTYRMLEPTRVVNWEVIIMDEAHFLDPASIAARGWAAHRARANESATILMTATPPGTSDEFPHSNGEIEDVQTDIPSEPWNTGHDWILADKRPTAWFLPSIRAANVMAASLRKAGKSVVVLNRKTFEREYPTIKQKKPDFILATDIAEMGANLCVERVLDCRTAFKPVLVDEGRKVAIKGPLRISASSAAQRRGRIGRNPNRDGDSYYYSEPTSENNAHHVCWLEASMLLDNMEVRGGMVAPLYGVEGTKTPVSPGEMRLRDDQRKVFRELVRNCDLPVWLSWQVAKAGLKTNDRKWCFEGPEEHEILNDSGETVKCRAPGGAKKPLRPRWCDERVSSDQSALSEFIKFAEGRRGAAEVLVVLSELPDFLAKKGGEAMDTISVFLHSEEGSRAYRNALSMMPEAMTIVMLFILAGLLTSGMVIFFMSPKGISRMSMAMGTMAGCGYLMFLGGVKPTHISYIMLIFFVLMVVVIPEPGQQRSIQDNQVAYLIIGILTLVSAVAANELGMLEKTKEDLFGKKNXXIPSSASPWSWPDLDLKPGAAWTVYVGIVTMLSPMLHHWIKVEYGNLSLSGIAQSASVLSFMDKGIPFMKMNISVIMLLVSGWNSITVMPLLCGIGCAMLHWSLILPGIKAQQSKLAQRRVFHGVAKNPVVDGNPTVDIEEAPEMPALYEKKLALYLLLALSLASVAMCRTPFSLAEGIVLASAALGPLIEGNTSLLWNGPMAVSMTGVMRGNHYAFVGVMYNLWKMKTGRRGSANGKTLGEVWKRELNLLDKQQFELYKRTDIVEVDRDTARRHLAEGKVDTGVAVSRGTAKLRWFHERGYVKLEGRVIDLGCGRGGWCYYAAAQKEVSGVKGFTLGRDGHEKPMNVQSLGWNIITFKDKTDIHRLEPVKCDTLLCDIGESSSSSVTEGERTVRVLDTVEKWLACGVDNFCVKVLAPYMPDVLEKLELLQRRFGGTVIRNPLSRNSTHEMYYVSGARSNVTFTVNQTSRLLMRRMRRPTGKVTLEADVILPIGTRSVETDKGPLDKEAIEERVERIKSEYMTSWFYDNDNPYRTWHYCGSYVTKTSGSAASMVNGVIKILTYPWDRIEEVTRMAMTDTTPFGQQRVFKEKVDTRAKDPPAGTRKIMKVVNRWLFRHLAREKNPRLCTKEEFIAKVRSHAAIGAYLEEQEQWKTANEAVQDPKFWELVDEERKLHQQGRCRTCVYNMMGKREKKLSEFGKAKGSRAIWYMWLGARYLEFEALGFLNEDHWASRENSGGGVEGIGLQYLGYVIRDLAAMDGGGFYADDTAGWDTRITEADLDDEQEILNYMSPHHKKLAQAVMEMTYKNKVVKVLRPAPGGKAYMDVISRRDQRGSGQVVTYALNTITNLKVQLIRMAEAEMVIHHQHVQDCDESVLTRLEAWLTEHGCNRLKRMAVSGDDCVVRPIDDRFGLALSHLNAMSKVRKDISEWQPSKGWNDWENVPFCSHHFHELQLKDGRRIVVPCREQDELIGRGRVSPGNGWMIKETACLSKAYANMWSLMYFHKRDMRLLSLAVSSAVPTSWVPQGRTTWSIHGKGEWMTTEDMLEVWNRVWITNNPHMQDKTMVKKWRDVPYLTKRQDKLCGSLIGMTNRATWASHIHLVIHRIRTLIGQEKYTDYLTVMDRYSVDADLQLGELI

SEQ ID NO: 265798 - protein, 3412 aa, Yellow fever virus
  MOD_RES (1)..(12): Any amino acid
  MOD_RES (28)..(32): Any amino acid
  MOD_RES (156)..(187): Any amino acid
  MOD_RES (214)..(223): Any amino acid
  MOD_RES (275)..(283): Any amino acid
  MOD_RES (300)..(301): Any amino acid
  MOD_RES (321)..(323): Any amino acid
  MOD_RES (364)..(364): Any amino acid
  MOD_RES (380)..(417): Any amino acid
  MOD_RES (476)..(477): Any amino acid
  MOD_RES (494)..(501): Any amino acid
  MOD_RES (542)..(545): Any amino acid
  MOD_RES (561)..(576): Any amino acid
  MOD_RES (637)..(655): Any amino acid
  MOD_RES (673)..(684): Any amino acid
  MOD_RES (727)..(727): Any amino acid
  MOD_RES (772)..(776): Any amino acid
  MOD_RES (816)..(816): Any amino acid
  MOD_RES (882)..(891): Any amino acid
  MOD_RES (909)..(930): Any amino acid
  MOD_RES (968)..(983): Any amino acid
  MOD_RES (1026)..(1026): Any amino acid
  MOD_RES (1042)..(1046): Any amino acid
  MOD_RES (1093)..(1096): Any amino acid
  MOD_RES (1226)..(1226): Any amino acid
  MOD_RES (1489)..(1489): Any amino acid
  MOD_RES (1517)..(1537): Any amino acid
  MOD_RES (1560)..(1564): Any amino acid
  MOD_RES (1613)..(1622): Any amino acid
  MOD_RES (1642)..(1649): Any amino acid
  MOD_RES (1690)..(1717): Any amino acid
  MOD_RES (1733)..(1735): Any amino acid
  MOD_RES (1756)..(1756): Any amino acid
  MOD_RES (1772)..(1826): Any amino acid
  MOD_RES (1846)..(1862): Any amino acid
  MOD_RES (1898)..(1901): Any amino acid
  MOD_RES (1935)..(1961): Any amino acid
  MOD_RES (1977)..(1991): Any amino acid
  MOD_RES (2010)..(2011): Any amino acid
  MOD_RES (2087)..(2089): Any amino acid
  MOD_RES (2125)..(2129): Any amino acid
  MOD_RES (2145)..(2153): Any amino acid
  MOD_RES (2275)..(2276): Any amino acid
  MOD_RES (2290)..(2298): Any amino acid
  MOD_RES (2314)..(2333): Any amino acid
  MOD_RES (2430)..(2431): Any amino acid
  MOD_RES (2469)..(2481): Any amino acid
  MOD_RES (2519)..(2520): Any amino acid
  MOD_RES (2554)..(2577): Any amino acid
  MOD_RES (2593)..(2602): Any amino acid
  MOD_RES (2721)..(2728): Any amino acid
  MOD_RES (2744)..(2754): Any amino acid
  MOD_RES (2773)..(2773): Any amino acid
  MOD_RES (2810)..(2810): Any amino acid
  MOD_RES (2850)..(2875): Any amino acid
  MOD_RES (2906)..(2909): Any amino acid
  MOD_RES (2933)..(2934): Any amino acid
  MOD_RES (2965)..(2983): Any amino acid
  MOD_RES (2999)..(3010): Any amino acid
  MOD_RES (3046)..(3054): Any amino acid
  MOD_RES (3084)..(3084): Any amino acid
  MOD_RES (3119)..(3128): Any amino acid
  MOD_RES (3195)..(3202): Any amino acid
  MOD_RES (3249)..(3280): Any amino acid
  MOD_RES (3351)..(3365): Any amino acid
  MOD_RES (3398)..(3400): Any amino acid
XXXXXXXXXXXXVNMVRRGARSLSNKIXXXXXQIGNRPGLSRGVQGFISFFSFNILTGKKLTTHLKRLWRMLDPRQGLAALRKVKRVVAGLMIGLSSRKRRSNEMAMMPLLILSMVLMAGGVTLMRKNRWLLLNVTAEDLGKTFSVGAGNCTTNIXXXXXXXXXXXXXXXXXXXXXXXXXXXXXXXXGVENVRVAYGRCDAVGRSKRSRRAIDXXXXXXXXXXTRQEKWMAGRMGERQLQKIERWLVRNPFFAVTALAIAYLVGNNTTQRVVIAXXXXXXXXXYSAHCIGVADRDFIEGXXGGTWVSASLEQGKCVTVMAXXXPSLDISLETVAIDGPAEARKVCYSAVLTHVKIDDKCPSTGXAHLAEENDGDNACKRXXXXXXXXXXXXXXXXXXXXXXXXXXXXXXXXXXXXXXTKIQYVIRARLHVGAKQENWTTSIKTLKFDALSGSQEAEFTGYGKATLECRVQTAVDFXXSYIAEMEKDSWIVDRQXXXXXXXXWQSGSGGIWRGMHHLVEFEPPHAVTIRVLALGDQEGSLKTXXXXAMRVTKDENDNNLYKXXXXXXXXXXXXXXXXLKGTSYKMCTDKMSFVKNPTDTDHGTVVMQVKVPKGAPCKIPVIVADDLTAAVNKGILVTXXXXXXXXXXXXXXXXXXXFGDSYIIVGTGDSRLTYXXXXXXXXXXXXFTQTMKGAERLAVMGDAAWDFSSAGGLLTSIGKGSHTVFGSAXQGLFGGLSWITKVIIGVVLIWVGFNTRNMTMSMSMIMVGVIMMFXXXXXGADQGCAVNFAKRELKCGDGIFVFRDSDDWLTKYSYYPEXPVKLASIIKASHEEGKCGLNSVDSLDHEMWRSRADEINAILEENEVDISIVVQDPKNIYQRGTHPXXXXXXXXXXGWKTWGKNLIFSPGRKNXXXXXXXXXXXXXXXXXXXXXXFQIEEFGMGVFTTRVFMDAVFDYSVDCDGAILGAAVNXXXXXXXXXXXXXXXXEVNGTWMIHTLETLDYKECEWPPTHTIGTSVEESDMFMPRSIXGPVSSHNRIPGYKVQXXXXXMQVPLEVRREPCPGTSVVVDTGCDGRGKSARSTTDSGKIIPEWCCRXXXXPPVSFHGNDGCWYPMEIRPMKASDSHLVRSWVTAGEVHAVPFGLVSMMIAMEVVLRKRQGPKQMLVGGIILLGAMLVGQVTVLDLVKLIMAVGLHFHEINNGGDAMYMALIASFSVRPGLLMGFGLRTLXSPRERLVMAFGAAMVEIALGGMMGGLWQYLNAVSLCVLTINAISSRKASNAVLPLMALLTPVTMAEVRLATMLFCTVVIIGVLHQNSKDTSMQKTIPIVALTLTSYMGLTQPFLGLCAYMSTQVFGRRSIPVNEALAATGLVGVLAGLAFQDMENFLGPIAVGGILMMLVSVAGKVDGLELRKLGEIAWEEEAEISGSSSRYDVALNEQGEFKLLSEDKVPWDQIVMTSLALVGAAIHPFALLLVLAGWLLHIKRARRSGDVXWDIPTPKVIEECEHLEDGISGIFQSTFXXXXXXXXXXXXXXXXXXXXXVTRGAFLLRNGKKLVPSWASVKXXXXXYGGSWKLDGKWDGEEEVQLIAAVPGKAVVNVQTKPSVFRVKNGGEIGAXXXXXXXXXXGSPIVNRSGEVVGLYGNGIXXXXXXXXSAISQTEVKEEGKEELREIPTMLKKGMTTVLDYHPGAGKTXXXXXXXXXXXXXXXXXXXXXXXXXXXXSEMKEAFQGLDVKFHXXXFSAHGSGKEVIDVMCHATLTXRMLEPTRIVNWEVIIXXXXXXXXXXXXXXXXXXXXXXXXXXXXXXXXXXXXXXXXXXXXXXXXXXXXXXXDIPSEPWTSGHEWILADKRXXXXXXXXXXXXXXXXXSLRKAGKNVVVLNRKTFEKEYPTIKQKRPDFILATXXXXMGANLCVDRVLDCRTAYKPVLVDEGKKVAIKGPXXXXXXXXXXXXXXXXXXXXXXXXXXXYSEPTSEDNAHHVCWXXXXXXXXXXXXXXXMVAPLYGIEGIKTPVSPGXXRLRDDQRRVFRELVRGCDLPVWLSWQVAKPGLKTNDRKWCFDGPKEHEILNDNGETVKCRSPGGAKKALRPRWCDXXXSSDQSALADFIKFAEGRRGAAEMLVVLTELPDFLAXXXXXAMDTISVLLHSEEGSXXXXXXXXXMPEAMTIVMLFLLAGLLTSGAVIFFMSPKGMSRMSMAMGTMAGSGYLMFLGGVKPTHISYVMLIFFVLMVVIIPEPGQQRTIQDNQVAFLIIGILTLVSVVAANELGMLEKTKEDLFGKKDXXTSGGTIPWSWPDLXXXXXXXXXVYVGIVTILSPMLHHXXXXXXXXXXXXXXXXXXXXLSFMDKGVPFMKMNISVIILLISGWNSITVIPLLCGVGGAMLHWTLILPGIKAQQSKLAQKRVFHGVAENPVVDGNPTADIEEAPEMPVLYEKKLAXXLLLALSLMSVAMCRTPFSLAEGIVLASAASGPLIEGNXXXXXXXXXXXXXTGVMRGNYYAFVGVMYNLWKMETGRRGRASGKTLGEVXXRELNLLDKRQFELYKRTDITEVDRDMARRHLAEXXXXXXXXXXXXXXXXXXXXXXXXVKLEGRVTDLGCGRGXXXXXXXXXXEVSGVKGYTLGREGHEKPMNVQSLGWNIVTFKDKTDVHRLEPAKCETLLCDIGESSPSSVTEGERTMRVLETIEKWLACGVDNFCIKVLAPYMPDVIEKLELLQRRFGGTIIRNPLSRXXXXXXXXVSGARSNITFTVNQTXXXXXXXXXXXTGKVTLEPDVTLPIGTRSXETDKGPLDRDAIKERVERIKSEYMTTWFHDNDNPYRXWHYCGSYITKTSGSAASMINGVIKILTFPWDKIEEVTRMXXXXXXXXXXXXXXXXXXXXXXXXXXAGTRKIMRVVNRWLFRHLAREKSPRLCTKEXXXXKVRSHAAVGAFLEEQDQWKTANEXXQDPKFWEMVDAERRLHQQGRCQSCVYNMMGXXXXXXXXXXXXXXXXXXXYMWLGARFLEFEALGXXXXXXXXXXXXSGGGVEGTGLQYLGYVIKDLSTKEGGGLYADDTAGXXXXXXXXXLDDEQEIMSYMNAEQRKLAWAIMEMTYKNXVVKVLRPAPGGKAFMDIISRRDQRGSRQVVTYALXXXXXXXXXXIRMAEAEMVINHQHVQECDESALARLDAWLTEHGCDRLARMAVSGDDCVVRPVDDRFGMALSHLNAXXXXXXXXSEWQPSKEWTDWESVPFCSHHFHELVLKDGRKVVVPCRDQDELIGRXXXXXXXXXXXXXXXXXXXXXXXXXXXXXXXXRDMRLLSFAVSSAVPTAWVPSGRTTWSVHGKGEWMTTEDMLDVWNRVWVLNNPHMQDKTMVKEWRDVPYLXXXXXXXXXXXXXXXNRATWASNIHLVIHRIRTLVGQEKFTDYLTVMXXXSVDADLQPGELI

SEQ ID NO: 265799 - protein, 3412 aa, Yellow fever virus
  MOD_RES (1)..(55): Any amino acid
  MOD_RES (127)..(138): Any amino acid
  MOD_RES (154)..(190): Any amino acid
  MOD_RES (203)..(250): Any amino acid
  MOD_RES (275)..(305): Any amino acid
  MOD_RES (317)..(329): Any amino acid
  MOD_RES (349)..(419): Any amino acid
  MOD_RES (446)..(447): Any amino acid
  MOD_RES (471)..(478): Any amino acid
  MOD_RES (493)..(504): Any amino acid
  MOD_RES (517)..(608): Any amino acid
  MOD_RES (618)..(657): Any amino acid
  MOD_RES (671)..(693): Any amino acid
  MOD_RES (720)..(734): Any amino acid
  MOD_RES (752)..(779): Any amino acid
  MOD_RES (792)..(820): Any amino acid
  MOD_RES (836)..(893): Any amino acid
  MOD_RES (907)..(942): Any amino acid
  MOD_RES (958)..(983): Any amino acid
  MOD_RES (999)..(1049): Any amino acid
  MOD_RES (1076)..(1110): Any amino acid
  MOD_RES (1126)..(1145): Any amino acid
  MOD_RES (1193)..(1204): Any amino acid
  MOD_RES (1226)..(1227): Any amino acid
  MOD_RES (1256)..(1269): Any amino acid
  MOD_RES (1321)..(1342): Any amino acid
  MOD_RES (1358)..(1400): Any amino acid
  MOD_RES (1421)..(1425): Any amino acid
  MOD_RES (1434)..(1458): Any amino acid
  MOD_RES (1488)..(1495): Any amino acid
  MOD_RES (1511)..(1538): Any amino acid
  MOD_RES (1554)..(1566): Any amino acid
  MOD_RES (1580)..(1583): Any amino acid
  MOD_RES (1609)..(1626): Any amino acid
  MOD_RES (1638)..(1653): Any amino acid
  MOD_RES (1687)..(1740): Any amino acid
  MOD_RES (1751)..(1756): Any amino acid
  MOD_RES (1772)..(1827): Any amino acid
  MOD_RES (1843)..(1994): Any amino acid
  MOD_RES (2007)..(2013): Any amino acid
  MOD_RES (2043)..(2048): Any amino acid
  MOD_RES (2064)..(2064): Any amino acid
  MOD_RES (2086)..(2104): Any amino acid
  MOD_RES (2123)..(2157): Any amino acid
  MOD_RES (2169)..(2183): Any amino acid
  MOD_RES (2199)..(2199): Any amino acid
  MOD_RES (2215)..(2245): Any amino acid
  MOD_RES (2261)..(2261): Any amino acid
  MOD_RES (2275)..(2276): Any amino acid
  MOD_RES (2289)..(2344): Any amino acid
  MOD_RES (2360)..(2362): Any amino acid
  MOD_RES (2382)..(2386): Any amino acid
  MOD_RES (2400)..(2431): Any amino acid
  MOD_RES (2447)..(2449): Any amino acid
  MOD_RES (2465)..(2488): Any amino acid
  MOD_RES (2517)..(2521): Any amino acid
  MOD_RES (2548)..(2577): Any amino acid
  MOD_RES (2593)..(2607): Any amino acid
  MOD_RES (2618)..(2623): Any amino acid
  MOD_RES (2632)..(2633): Any amino acid
  MOD_RES (2653)..(2654): Any amino acid
  MOD_RES (2681)..(2691): Any amino acid
  MOD_RES (2704)..(2757): Any amino acid
  MOD_RES (2770)..(2774): Any amino acid
  MOD_RES (2807)..(2827): Any amino acid
  MOD_RES (2846)..(2890): Any amino acid
  MOD_RES (2906)..(2912): Any amino acid
  MOD_RES (2928)..(2940): Any amino acid
  MOD_RES (2953)..(3023): Any amino acid
  MOD_RES (3042)..(3058): Any amino acid
  MOD_RES (3082)..(3090): Any amino acid
  MOD_RES (3100)..(3131): Any amino acid
  MOD_RES (3189)..(3204): Any amino acid
  MOD_RES (3243)..(3289): Any amino acid
  MOD_RES (3349)..(3377): Any amino acid
  MOD_RES (3393)..(3412): Any amino acid
XXXXXXXXXXXXXXXXXXXXXXXXXXXXXXXXXXXXXXXXXXXXXXXXXXXXXXXLTGKKITAHLKKLWRMLDPRQGLTVLRKVKRVVASLMIGLSSRKRRSHDALAFQLLILGMIILSGGVTLVRXXXXXXXXXXXXDLGKTFSLGTGNCTTXXXXXXXXXXXXXXXXXXXXXXXXXXXXXXXXXXXXXNVRVTYGKCDSAXXXXXXXXXXXXXXXXXXXXXXXXXXXXXXXXXXXXXXXXXXXXXXXXFFAITALAIAYLVGNNKTQRVVIAXXXXXXXXXXXXXXXXXXXXXXXXXXXXXXXVSATLEQGKCVXXXXXXXXXXXXXLQTVAIDRPVEARKVCYSAXXXXXXXXXXXXXXXXXXXXXXXXXXXXXXXXXXXXXXXXXXXXXXXXXXXXXXXXXXXXXXXXXXXXXXXIQYVIKAQLHVGAKQENWNTSIKTLKXXVLSGSQEVEFTGYGKVTLECQVQXXXXXXXXYIAEMEKDSWIVDRXXXXXXXXXXXXGSGGVWRGMHHLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPKGAPCRIXXXXXXXXXXXXXXXXXXXXXXXXXXXXXXXXXXXXXXXXDSYIIIGTGDSRLXXXXXXXXXXXXXXXXXXXXXXXRLAVMGDVAWDFSSAGGFFTSIGKGSXXXXXXXXXXXXXXXNWITKVIMGAVLIWVGFXXXXXXXXXXXXXXXXXXXXXXXXXXXXQGCAINFAKRELXXXXXXXXXXXXXXXXXXXXXXXXXXXXXASIIKASYEEGKCGLXXXXXXXXXXXXXXXXXXXXXXXXXXXXXXXXXXXXXXXXXXXXXXXXXXXXXXXXXXKTWGKSLVFSPGRXXXXXXXXXXXXXXXXXXXXXXXXXXXXXXXXXXXXTRVFMDATFDYSVDCXXXXXXXXXXXXXXXXXXXXXXXXXXEVNGTWMMHTLETLDXXXXXXXXXXXXXXXXXXXXXXXXXXXXXXXXXXXXXXXXXXXXXXXXXXXPLEVRREVCPGTSVVLDSSCDGRGKSXXXXXXXXXXXXXXXXXXXXXXXXXXXXXXXXXXXMEIRPMKTSDSHLVRXXXXXXXXXXXXXXXXXXXXALEVVLRRRQGPKQVLVGGMVLLGAMLVGQVTMLDLVKFVVAVGLHFXXXXXXXXXXXXALIAAFSIRPGLLVGFGLRTLXXPRERLVLAFGAAMVEVALGGMMGGLWQYXXXXXXXXXXXXXXASRKASNMILPLMALLTPVTMHEVRLAAMLFCTVVIIGVLHQNAKDTSMQKXXXXXXXXXXXXXXXXXXXXXXCAFLATRLFGRRSIPXXXXXXXXXXXXXXXXXXXXXXXXXXXXXXXXXXXXXXXXXXXRVDGLELKKLGEVAWEEEAEXXXXXARYDVALNXXXXXXXXXXXXXXXXXXXXXXXXXVGAAIHPSALLLVLGGWVFHVRRARRSGDXXXXXXXXKVIEECEYLEDGIYGXXXXXXXXXXXXXXXXXXXXXXXXXXXXTRGAFLVWNGKKLIPXXXXXXXXXXXXXGSWKLDGRWDGEEXXXXIAAAPGKSVVNVQTKPSLFRVKNGGXXXXXXXXXXXXXXXXXXVNRNGEVVGLYXXXXXXXXXXXXXXXXQTELKEESKEELQEISTMLKKGKTTILDYHPGAXXXXXXXXXXXXXXXXXXXXXXXXXXXXXXXXXXXXXXXXXXXXXXXXXXXXXXSGREVIDVMCXXXXXXRMLEPTRAVNWEVIIXXXXXXXXXXXXXXXXXXXXXXXXXXXXXXXXXXXXXXXXXXXXXXXXXXXXXXXXIPSEPWTAGHEWILAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPLYGVEGIKTPVXXXXXXXRDDQRRVSRELVRNCDQPVWLAWQVAKAGXXXXXXKWCFEGPDEHEILNDXGETVKCRTPGGAKRALRPRWCXXXXXXXXXXXXXXXXXXXGRRGAAEMLVILTELPDFXXXXXXXXXXXXXXXXXXXXXXXXXXXXXXXXXXXMTIAMLFILAGXXXXXXXXXXXXXXXISRMSMAKGTMAGCGXLMFLGGAEPTHISYIXXXXXXXXXXXXXXXXXXXXXXXXXXXXXXXGILTLLSIVAANELGXLERTKEDFFGKRDXXTPSGAIPWSWPDXXXXXXXXXXXXXXXXXXXXXXXXXXXXXXXXXXXXXXXXXXXXXXXXXXXXXXXXKMNISVVMLLISGWNXXXVIPLLCGIGCATLHWSLILXXXXXQQSKLPQRRVFHGXXXXXXXXXXXXXXXXXXXXXXXXXXXXXXXXLLLALSLSSVAMCRTXXXLDEGIVLSSAALGPLXXXXXXXXXXXXXXXXXXXXXXXXYYAFVGVAYNLWKMKTERRGTANGKTLGXXXXXELNLLDRQQFEMYKRTDIIEVDRDMAXXXXXXXXXXXXXXXXXXXXXXXXXXXXXXVKLEGRVMDLGCGRGXXXXXXXXXXXXXXXKGFTLGREGHXXXXXXRSLGWNIIXXKDKTDIHRLEPLKCETLLCXXGESSPSSVTEGERTLRVLETVEKWLAXXXXXXXXXXXAPYMRDVLEKLEXXXXXXXXXXXXXXXXXXXXXXXXXXXXXXXXXXXXXXXXXXXXXXXXXXXXXXVTLEADVTLPIGXXXXXTDKGPLNREAIKERVERIKTEYAATWFHDNDNXXXXXXXXXXXXXXXXXXXXXMVNGVIKILTYPWDKIEEXXXXXXXXXXXXXXXXXXXXXXXXXXXXXXXXXXXXXXXXXXXXXRHLAREKKPRLCTKEXXXXXXXSHAAIGAYLEEQDQWXXXXXXXXXXXXXELVDEERRLHQQXXXXXXXXXXXXXXXXXXXXXXXXXXXXXXXXXXXXXXXXXXXXXXXXXXXXXXXXXXXXXXXXXXXXXXXGYVIRDLSAMDGGGLYADXXXXXXXXXXXXXXXXXQEIMSYMSPEQRKLAWAIMEMTYXXXXXXXXXPTPGGKAYMXXXXXXXXXXXXXXXXXXXXXXXXXXXXXXXXAEAENVINHQHVQDCDDSTLARLEAWLAENGCDRLRRMAVNGDDCVVKPIDDRFGMAXXXXXXXXXXXXXXXXWQPSKGWTDWENVPFCSHHFHELHLKDGRKIVVPCRDQXXXXXXXXXXXXXXXXXXXXXXXXXXXXXXXXXXXXXXXXXXXXXXXVSSAVPMAWVPSGRTTWSVHGRGEWMTTEDMLGVWNRVWVLNNPHMQDKTVIKEWRDVPXXXXXXXXXXXXXXXXXXXXXXXXXXXXXIHRIRTLIGQEKFTDXXXXXXXXXXXXXXXXXXXX

SEQ ID NO: 265800 - protein, 3412 aa, Yellow fever virus
  MOD_RES (1)..(56): Any amino acid
  MOD_RES (72)..(97): Any amino acid
  MOD_RES (127)..(138): Any amino acid
  MOD_RES (154)..(259): Any amino acid
  MOD_RES (273)..(333): Any amino acid
  MOD_RES (345)..(430): Any amino acid
  MOD_RES (446)..(988): Any amino acid
  MOD_RES (999)..(1049): Any amino acid
  MOD_RES (1075)..(1111): Any amino acid
  MOD_RES (1124)..(1157): Any amino acid
  MOD_RES (1168)..(1175): Any amino acid
  MOD_RES (1193)..(1210): Any amino acid
  MOD_RES (1220)..(1269): Any amino acid
  MOD_RES (1318)..(1406): Any amino acid
  MOD_RES (1416)..(1472): Any amino acid
  MOD_RES (1487)..(1583): Any amino acid
  MOD_RES (1595)..(1674): Any amino acid
  MOD_RES (1684)..(2070): Any amino acid
  MOD_RES (2086)..(2104): Any amino acid
  MOD_RES (2120)..(2245): Any amino acid
  MOD_RES (2259)..(2266): Any amino acid
  MOD_RES (2275)..(2276): Any amino acid
  MOD_RES (2288)..(2347): Any amino acid
  MOD_RES (2359)..(2366): Any amino acid
  MOD_RES (2380)..(2497): Any amino acid
  MOD_RES (2517)..(2525): Any amino acid
  MOD_RES (2536)..(2633): Any amino acid
  MOD_RES (2653)..(2654): Any amino acid
  MOD_RES (2677)..(2782): Any amino acid
  MOD_RES (2791)..(2791): Any amino acid
  MOD_RES (2806)..(2834): Any amino acid
  MOD_RES (2843)..(2890): Any amino acid
  MOD_RES (2902)..(3030): Any amino acid
  MOD_RES (3040)..(3059): Any amino acid
  MOD_RES (3075)..(3133): Any amino acid
  MOD_RES (3175)..(3208): Any amino acid
  MOD_RES (3218)..(3220): Any amino acid
  MOD_RES (3236)..(3314): Any amino acid
  MOD_RES (3328)..(3332): Any amino acid
  MOD_RES (3348)..(3382): Any amino acid
  MOD_RES (3391)..(3412): Any amino acid
XXXXXXXXXXXXXXXXXXXXXXXXXXXXXXXXXXXXXXXXXXXXXXXXXXXXXXXXTGKKLTAQLKRLWKMXXXXXXXXXXXXXXXXXXXXXXXXXXRKRRSSEMTTVPLLLLGLLILGGGVTLVRXXXXXXXXXXXXDLGKTFSIGTGNCTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAYLVGNNMTQRVVXXXXXXXXXXXXXXXXXXXXXXXXXXXXXXXXXXXXXXXXXXXXXXXXXXXXXXXXXXXXXAIDGPVEARKVXXXXXXXXXXXXXXXXXXXXXXXXXXXXXXXXXXXXXXXXXXXXXXXXXXXXXXXXXXXXXXXXXXXXXXXXXXXXXXXXXXXXXXGAKQENWKTDIKTLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWMVHTLETLDXXXXXXXXXXXXXXXXXXXXXXXXXXXXXXXXXXXXXXXXXXXXXXXXXXXPLEVKREVCPGTSVVVDTGCDGRGKXXXXXXXXXXXXXXXXXXXXXXXXXXXXXXXXXXXXXEIRPRKAHESHLXXXXXXXXXXXXXXXXXXXXXXXXXXXXXXXXXXKQMLVGGMVLXXXXXXXXVTLLDLLEFTMAVGLHFXXXXXXXXXXXXXXXXXXSIRPGLLVGXXXXXXXXXXXXXXXXXXXXXXXXXXXXXXXXXXXXXXXXXXXXXXXXXXSSRKASNAVLPLMALMTPMTMYEVRMAAMLLCAVVIVGVLYQNSKDTSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKKLGEVAWXXXXXXXXXXXXXXXXXXXXXXXXXXXXXXXXXXXXXXXXXXXXXXXXXXXXXXXXXGGWLFHVRRARRSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAAVPGKSVVNXXXXXXXXXXXXXXXXXXXXXXXXXXXXXXXXXXXXXXXXXXXXXXXXXXXXXXXXXXXXXXXXXXXXXXXXXXXXXXXXGMTTILDYHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAPGGAKRPLRPRWCXXXXXXXXXXXXXXXXXXXGRRGAADILVVLSELXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGILTLLSIVAANEXXXXXXXXEDFFGRRNXXISSGASPWSWPXXXXXXXXXXXXXXXXXXXXXXXXXXXXXXXXXXXXXXXXXXXXXXXXXXXXXXXXXXXXISVIMLLISGWXXXXXXXXLCGIGCATLHWSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNLWKMKTARRGSASGKTLGXXXXXXXXXLDKQQFEMYKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKDKTDIHHLEPMKCDTLLCXXGESSSSSATEGERTLRVLDTVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIEERVEXIKNEYAATWFHDNDXXXXXXXXXXXXXXXXXXXXXXXXXXXXXLLTYPWDKXXXXXXXXXXXXXXXXXXXXXXXXXXXXXXXXXXXXXXXXXXXXXXXXRHLSREKNPRLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAAMDGGGLYXXXXXXXXXXXXXXXXXXXXEILNYMSSHHKKLAQXXXXXXXXXXXXXXXXXXXXXXXXXXXXXXXXXXXXXXXXXXXXXXXXXXXXXXXXXXXAEMVIHHHHVNECGENVLERLETWLIEHGCDRLNRMAVNGDXXXXXXXXXXXXXXXXXXXXXXXXXXXXXXXXXXKGWTDWESVXXXSHRFHELVLKDGRKIXXXXXXXXXXXXXXXXXXXXXXXXXXXXXXXXXXXXXXXXXXXXXXXXXXXXXXXXXXXXXXXXXXXXXXXXXXXXXXXMTTQDRLEVWNRVXXXXXPHMKDKTTVKEWRDVXXXXXXXXXXXXXXXXXXXXXXXXXXXXXXXXXXXNLIGQEKYXXXXXXXXXXXXXXXXXXXXXX

SEQ ID NO: 265801 - protein, 3412 aa, Yellow fever virus
  MOD_RES (1)..(106): Any amino acid
  MOD_RES (115)..(116): Any amino acid
  MOD_RES (127)..(140): Any amino acid
  MOD_RES (154)..(432): Any amino acid
  MOD_RES (444)..(1183): Any amino acid
  MOD_RES (1192)..(1269): Any amino acid
  MOD_RES (1278)..(1292): Any amino acid
  MOD_RES (1314)..(1473): Any amino acid
  MOD_RES (1484)..(2070): Any amino acid
  MOD_RES (2080)..(2107): Any amino acid
  MOD_RES (2119)..(2266): Any amino acid
  MOD_RES (2275)..(2276): Any amino acid
  MOD_RES (2286)..(2636): Any amino acid
  MOD_RES (2652)..(2661): Any amino acid
  MOD_RES (2677)..(2794): Any amino acid
  MOD_RES (2805)..(3141): Any amino acid
  MOD_RES (3160)..(3164): Any amino acid
  MOD_RES (3175)..(3314): Any amino acid
  MOD_RES (3326)..(3335): Any amino acid
  MOD_RES (3348)..(3412): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLFPLLLLGXXALTGGVTLMRXXXXXXXXXXXXXXGKTFSMGTGNCTTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKQEDWKTDIKTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTMAVGLHXXXXXXXXXXXXXXXXXXXXXXXXXXXXXXXXXXXXXXXXXXXXXXXXXXXXXXXXXXXXXXXXXXXXXXXXXXXXXXSSRKASNAXXXXXXXXXXXXXXXVRLATMLLCAVVIVGVLHQNAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGWILHIKGARXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRSPGGAKRAXXXXXXXXXXXXXXXXXXXXXXXXXXXXGAAEMLVILTEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEDFFGKRNXXIPSGAIPWSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTDVHPLESVKCDTLLXXXXXXXXXXITEGERTLRVLETVEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYAATWFHDNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHVNECDEGVLVRLEAWLIXXXXXRLSRMAVSGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMTTEDRLEVWNXXXXXXXXXXTDKTTIKEWRDVXXXXXXXXXXXXXXXXXXXXXXXXXXXXXXXXXXXXXXXXXXXXXXXXXXXXXXXXXXXXXXXXX

SEQ ID NO: 265802 - protein, 3412 aa, Yellow fever virus; identical to SEQ ID NO: 265797
  MOD_RES (2275)..(2276): Any amino acid

SEQ ID NO: 265803 - protein, 3412 aa, Yellow fever virus
  MOD_RES (1)..(11): Any amino acid
  MOD_RES (29)..(31): Any amino acid
  MOD_RES (157)..(186): Any amino acid
  MOD_RES (215)..(222): Any amino acid
  MOD_RES (276)..(282): Any amino acid
  MOD_RES (322)..(322): Any amino acid
  MOD_RES (381)..(416): Any amino acid
  MOD_RES (495)..(500): Any amino acid
  MOD_RES (543)..(544): Any amino acid
  MOD_RES (562)..(575): Any amino acid
  MOD_RES (638)..(654): Any amino acid
  MOD_RES (674)..(683): Any amino acid
  MOD_RES (773)..(775): Any amino acid
  MOD_RES (883)..(890): Any amino acid
  MOD_RES (910)..(929): Any amino acid
  MOD_RES (969)..(982): Any amino acid
  MOD_RES (1043)..(1045): Any amino acid
  MOD_RES (1094)..(1095): Any amino acid
  MOD_RES (1518)..(1536): Any amino acid
  MOD_RES (1561)..(1563): Any amino acid
  MOD_RES (1614)..(1621): Any amino acid
  MOD_RES (1643)..(1648): Any amino acid
  MOD_RES (1691)..(1716): Any amino acid
  MOD_RES (1734)..(1734): Any amino acid
  MOD_RES (1773)..(1825): Any amino acid
  MOD_RES (1847)..(1861): Any amino acid
  MOD_RES (1899)..(1900): Any amino acid
  MOD_RES (1936)..(1960): Any amino acid
  MOD_RES (1978)..(1990): Any amino acid
  MOD_RES (2088)..(2088): Any amino acid
  MOD_RES (2126)..(2128): Any amino acid
  MOD_RES (2146)..(2152): Any amino acid
  MOD_RES (2275)..(2276): Any amino acid
  MOD_RES (2291)..(2297): Any amino acid
  MOD_RES (2315)..(2332): Any amino acid
  MOD_RES (2470)..(2480): Any amino acid
  MOD_RES (2555)..(2576): Any amino acid
  MOD_RES (2594)..(2601): Any amino acid
  MOD_RES (2722)..(2727): Any amino acid
  MOD_RES (2745)..(2753): Any amino acid
  MOD_RES (2851)..(2874): Any amino acid
  MOD_RES (2907)..(2908): Any amino acid
  MOD_RES (2966)..(2982): Any amino acid
  MOD_RES (3000)..(3009): Any amino acid
  MOD_RES (3047)..(3053): Any amino acid
  MOD_RES (3120)..(3127): Any amino acid
  MOD_RES (3196)..(3201): Any amino acid
  MOD_RES (3250)..(3279): Any amino acid
  MOD_RES (3352)..(3364): Any amino acid
  MOD_RES (3399)..(3399): Any amino acid
XXXXXXXXXXXGVNMVRRGARSLSNKIKXXXKQIGNRPGLSRGVQGFISFFSFNILTGKKLTTHLKRLWRMLDPRQGLAALRKVKRVVAGLMIGLSSRKRRSNEMAMMPLLILSMVILAGGVTLMRKNRWLLLNVTAEDLGKTFSVGAGNCTTNILXXXXXXXXXXXXXXXXXXXXXXXXXXXXXXYGVENVRVAYGRCDAVGRSKRSRRAIDLXXXXXXXXKTRQEKWMAGRMGERQLQKIERWLVRNPFFAVTALAIAYLVGNNTTQRVVIALXXXXXXXAYSAHCIGVADRDFIEGVHGGTWVSASLEQGKCVTVMAPXKPSLDISLETVAIDGPAEARKVCYSAVLTHVKIDDKCPSTGEAHLAEENDGDNACKRTXXXXXXXXXXXXXXXXXXXXXXXXXXXXXXXXXXXXQTKIQYVIRARLHVGAKQENWTTSIKTLKFDALSGSQEAEFTGYGKATLECRVQTAVDFGNSYIAEMEKDSWIVDRQWXXXXXXPWQSGSGGIWRGMHHLVEFEPPHAVTIRVLALGDQEGSLKTAXXGAMRVTKDENDNNLYKLXXXXXXXXXXXXXXTLKGTSYKMCTDKMSFVKNPTDTDHGTVVMQVKVPKGAPCKIPVIVADDLTAAVNKGILVTVXXXXXXXXXXXXXXXXXPFGDSYIIVGTGDSRLTYQXXXXXXXXXXLFTQTMKGAERLAVMGDAAWDFSSAGGLFTSIGKGSHTVFGSAFQGLFGGLSWITKVIMGAVLIWVGFNTRNMTMSMSMIMVGVIMMFLXXXVGADQGCAVNFAKRELKCGDGIFVFRDSDDWLTKYSYYPEDPVKLASIIKASHEEGKCGLNSVDSLDHEMWRSRADEINAILEENEVDISVVVQDPKNIYQRGTHPFXXXXXXXXYGWKTWGKNLIFSPGRKNGXXXXXXXXXXXXXXXXXXXXSFQIEEFGMGVFTTRVFMDAVFDYSVDCDGAILGAAVNGXXXXXXXXXXXXXXHEVNGTWMIHTLETLDYKECEWPPTHTIGTSVEESDMFMPRSIGGPVSSHNRIPGYKVQTXXXWMQVPLEVRREVCPGTSVVLDTSCDGRGKSARSTTDSGKIIPEWCCRSXXMPPVSFHGNDGCWYPMEIRPMKTSDSHLVRSWVTAGEVHAVPFGLVSMMIALEVVLRKRQGPKQMLVGGIILLGAMLVGQVTVLDLVKLIMAVGLHFHEINNGGDAMYMALIASFSVRPGLLMGFGLRTLWSPRERLVMAFGAAMVEIALGGMMGGLWQYLNAVSLCVLTINAVSSRKASNAILPLMALLTPVTMAEVRLATMLFCTVVIIGVLHQNSKDTSMQKTIPIVALTLTSYMGLTQPFLGLCAYMSTQVFGRRSIPVNEALAATGLVGVLAGLAFQDMENFLGPIAVGGILMMLVSVAGRVDGLELRKLGEIAWEEEAEISGSSSRYDVALNEQGEFKLLSEDKVPWDQIVMTSLALVGAAIHPFALLLVLAGWLFHIKRARRSGDVLWDIPTPKVIEECEHLEDGISGIFQSTFLXXXXXXXXXXXXXXXXXXXHVTRGAFLLRNGKKLVPSWASVKEXXXAYGGSWKLDGKWDGEEEVQLIAAVPGKAVVNVQTKPSVFRVKNGGEIGAVXXXXXXXXSGSPIVNRSGEVVGLYGNGILXXXXXXVSAISQTEVKEEGKEELREIPTMLKKGMTTVLDYHPGAGKTRXXXXXXXXXXXXXXXXXXXXXXXXXXLSEMKEAFQGLDVKFHTXAFSAHGSGKEVIDVMCHATLTYRMLEPTRIVNWEVIIMXXXXXXXXXXXXXXXXXXXXXXXXXXXXXXXXXXXXXXXXXXXXXXXXXXXXXTDIPSEPWTSGHEWILADKRPXXXXXXXXXXXXXXXASLRKAGKNVVVLNRKTFEKEYPTIKQKRPDFILATDXXEMGANLCVDRVLDCRTAYKPVLVDEGKKVAIKGPLXXXXXXXXXXXXXXXXXXXXXXXXXYYSEPTSEDNAHHVCWLXXXXXXXXXXXXXGMVAPLYGIEGIKTPVSPGEMRLRDDQRRVFRELVRGCDQPVWLSWQVAKPGLKTNDRKWCFEGPEEHEILNDNGETVKCRSPGGAKKALRPRWCDEXVSSDQSALADFIKFAEGRRGAAEMLVVLTELPDFLAKXXXEAMDTISVLLHSEEGSRXXXXXXXMMPEAMTIVMLFLLAGLLTSGAVIFFMSPKGMSRMSMAMGTMAGSGYLMFLGGVKPTHISYVMLIFFVLMVVIIPEPGQQRTIQDNQVAFLIIGILTLVSVVAANELGMLEKTKEDLFGKKDXXTSGGTIPWSWPDLDXXXXXXXTVYVGIVTILSPMLHHWXXXXXXXXXXXXXXXXXXVLSFMDKGVPFMKMNISVIILLISGWNSITVIPLLCGVGGAMLHWTLILPGIKAQQSKLAQKRVFHGVAENPVVDGNPTADIEEAPEMPVLYEKKLALYLLLALSLMSVAMCRTPFSLAEGIVLASAASGPLIEGNTXXXXXXXXXXXMTGVMRGNYYAFVGVMYNLWKMETGRRGRASGKTLGEVWKRELNLLDKRQFELYKRTDITEVDRDMARRHLAEGXXXXXXXXXXXXXXXXXXXXXXYVKLEGRVTDLGCGRGGXXXXXXXXKEVSGVKGYTLGREGHEKPMNVQSLGWNIVTFKDKTDVHPLEPAKCETLLCDIGESSPSSVTEGERTMRVLETIEKWLACGVDNFCVKVLAPYMPDVIEKLELLQRRFGGTIIRNPLSRNXXXXXXYVSGARSNITFTVNQTSXXXXXXXXXPTGKVTLEADVTLPIGTRSVETDKGPLDRDAIEERVERIKSEYMTTWFHDNDNPYRTWHYCGSYITKTSGSAASMINGVIKILTFPWDKIEEVTRMAXXXXXXXXXXXXXXXXXXXXXXXXPAGTRKIMRVVNRWLFRHLAREKSPRLCTKEEXXAKVRSHAAVGAFLEEQDQWKTANEAVQDPKFWEMVDAERKLHQQGRCQSCVYNMMGKXXXXXXXXXXXXXXXXXWYMWLGARFLEFEALGFXXXXXXXXXXNSGGGVEGTGLQYLGYVIKDLSTKEGGGLYADDTAGWXXXXXXXDLDDEQEIMSYMNAEQRKLAWAIMEMTYKNKVVKVLRPAPGGKAFMDIISRRDQRGSRQVVTYALNXXXXXXXXLIRMAEAEMVINHQHVNECDESALARLDAWLTEHGCDRLRRMAVSGDDCVVRPVDDRFGMALSHLNAMXXXXXXISEWQPSKEWTDWESVPFCSHHFHELHLKDGRKVVVPCRDQDELIGRGXXXXXXXXXXXXXXXXXXXXXXXXXXXXXXKRDMRLLSFAVSSAVPTAWVPSGRTTWSVHGRGEWMTTEDMLDVWNRVWVLNNPHMQDKTMVKEWRDVPYLTXXXXXXXXXXXXXTNRATWASNIHLVIHRIRTLVGQEKFTDYLTVMDXYSVDADLQPGELI

SEQ ID NO: 265804 - protein, 3412 aa, Yellow fever virus
  MOD_RES (1)..(54): Any amino acid
  MOD_RES (128)..(137): Any amino acid
  MOD_RES (155)..(189): Any amino acid
  MOD_RES (204)..(245): Any amino acid
  MOD_RES (276)..(304): Any amino acid
  MOD_RES (318)..(328): Any amino acid
  MOD_RES (350)..(418): Any amino acid
  MOD_RES (472)..(477): Any amino acid
  MOD_RES (494)..(503): Any amino acid
  MOD_RES (518)..(607): Any amino acid
  MOD_RES (619)..(656): Any amino acid
  MOD_RES (672)..(692): Any amino acid
  MOD_RES (721)..(733): Any amino acid
  MOD_RES (753)..(778): Any amino acid
  MOD_RES (793)..(819): Any amino acid
  MOD_RES (837)..(865): Any amino acid
  MOD_RES (875)..(892): Any amino acid
  MOD_RES (908)..(941): Any amino acid
  MOD_RES (959)..(982): Any amino acid
  MOD_RES (1000)..(1048): Any amino acid
  MOD_RES (1077)..(1109): Any amino acid
  MOD_RES (1127)..(1144): Any amino acid
  MOD_RES (1194)..(1203): Any amino acid
  MOD_RES (1257)..(1268): Any amino acid
  MOD_RES (1322)..(1341): Any amino acid
  MOD_RES (1359)..(1399): Any amino acid
  MOD_RES (1422)..(1424): Any amino acid
  MOD_RES (1435)..(1457): Any amino acid
  MOD_RES (1489)..(1494): Any amino acid
  MOD_RES (1512)..(1537): Any amino acid
  MOD_RES (1555)..(1565): Any amino acid
  MOD_RES (1581)..(1582): Any amino acid
  MOD_RES (1610)..(1625): Any amino acid
  MOD_RES (1639)..(1652): Any amino acid
  MOD_RES (1688)..(1739): Any amino acid
  MOD_RES (1752)..(1755): Any amino acid
  MOD_RES (1773)..(1826): Any amino acid
  MOD_RES (1844)..(1993): Any amino acid
  MOD_RES (2008)..(2012): Any amino acid
  MOD_RES (2044)..(2047): Any amino acid
  MOD_RES (2087)..(2103): Any amino acid
  MOD_RES (2124)..(2156): Any amino acid
  MOD_RES (2170)..(2182): Any amino acid
  MOD_RES (2216)..(2233): Any amino acid
  MOD_RES (2243)..(2244): Any amino acid
  MOD_RES (2275)..(2276): Any amino acid
  MOD_RES (2290)..(2343): Any amino acid
  MOD_RES (2361)..(2361): Any amino acid
  MOD_RES (2383)..(2385): Any amino acid
  MOD_RES (2403)..(2430): Any amino acid
  MOD_RES (2448)..(2448): Any amino acid
  MOD_RES (2466)..(2487): Any amino acid
  MOD_RES (2518)..(2520): Any amino acid
  MOD_RES (2549)..(2576): Any amino acid
  MOD_RES (2594)..(2606): Any amino acid
  MOD_RES (2619)..(2622): Any amino acid
  MOD_RES (2682)..(2687): Any amino acid
  MOD_RES (2705)..(2756): Any amino acid
  MOD_RES (2771)..(2773): Any amino acid
  MOD_RES (2808)..(2826): Any amino acid
  MOD_RES (2847)..(2889): Any amino acid
  MOD_RES (2907)..(2911): Any amino acid
  MOD_RES (2929)..(2939): Any amino acid
  MOD_RES (2957)..(3022): Any amino acid
  MOD_RES (3043)..(3057): Any amino acid
  MOD_RES (3083)..(3089): Any amino acid
  MOD_RES (3101)..(3130): Any amino acid
  MOD_RES (3190)..(3203): Any amino acid
  MOD_RES (3244)..(3287): Any amino acid
  MOD_RES (3350)..(3376): Any amino acid
  MOD_RES (3394)..(3412): Any amino acid
XXXXXXXXXXXXXXXXXXXXXXXXXXXXXXXXXXXXXXXXXXXXXXXXXXXXXXILTGKKLTAQLKKLWRMLDPRQGLTVLRKVKRVVASLMIGLSSRKRRSHDALLVPLLLLGLLALSGGVTLVRKXXXXXXXXXXEDLGKTFSLGTGNCTTNXXXXXXXXXXXXXXXXXXXXXXXXXXXXXXXXXXXENVRVTYGKCDSAGXXXXXXXXXXXXXXXXXXXXXXXXXXXXXXXXXXXXXXXXXXLVRNPFFAITALAIAYLVGNNKTQRVVIALXXXXXXXXXXXXXXXXXXXXXXXXXXXXXWVSATLEQGKCVTXXXXXXXXXXXSLQTVAIDRPAEARKVCYSAVXXXXXXXXXXXXXXXXXXXXXXXXXXXXXXXXXXXXXXXXXXXXXXXXXXXXXXXXXXXXXXXXXXXXXKIQYVIKAQLHVGAKQENWNTDIKTLKFDVLSGSQEAEFTGYGKVTLECQVQTXXXXXXSYIAEMEKDSWIVDRQXXXXXXXXXXSGSGGVWRGMHHLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVPKGAPCRIPXXXXXXXXXXXXXXXXXXXXXXXXXXXXXXXXXXXXXXGDSYIIIGTGDSRLTXXXXXXXXXXXXXXXXXXXXXERLAVMGDVAWDFSSAGGFLTSVGKGIHXXXXXXXXXXXXXLNWITKVIIGVVLIWVGINXXXXXXXXXXXXXXXXXXXXXXXXXXDQGCAINFAKRELKXXXXXXXXXXXXXXXXXXXXXXXXXXXLASIIKASYEEGKCGLNXXXXXXXXXXXXXXXXXXXXXXXXXXXXXIVVQDPKNIXXXXXXXXXXXXXXXXXXWKTWGKSLVFSPGRKXXXXXXXXXXXXXXXXXXXXXXXXXXXXXXXXXXTTRVFMDATFDYSVDCDXXXXXXXXXXXXXXXXXXXXXXXXHEVNGTWMVHTLETLDYXXXXXXXXXXXXXXXXXXXXXXXXXXXXXXXXXXXXXXXXXXXXXXXXXVPLEVRREPCPGTSVVVDSNCDGRGKSAXXXXXXXXXXXXXXXXXXXXXXXXXXXXXXXXXPMEIRPMKAHESHLVRSXXXXXXXXXXXXXXXXXXIAMEVVLRRRQGPKQMLVGGMVLLGAMLVGQVTMLDLVKLVVAVGLHFHXXXXXXXXXXMALIAAFSIRPGLLVGFGLRTLWSPRERLVLAFGAAMVEVALGGMMGGLWQYLXXXXXXXXXXXXIASRKASNAVLPLMALMTPVTMAEVRLAAMLFCTVVIIGVLHQNAKDTSMQKTXXXXXXXXXXXXXXXXXXXXLCAFLATRLFGRRSIPVXXXXXXXXXXXXXXXXXXXXXXXXXXXXXXXXXXXXXXXXXGKVDGLELKKLGEVAWEEEAEIXXXSARYDVALNEXXXXXXXXXXXXXXXXXXXXXXXLVGAAIHPSALLLVLAGWVLHVRRARRSGDVXXXXXXPKVIEECEYLEDGIYGIXXXXXXXXXXXXXXXXXXXXXXXXXXVTRGAFLVWNGKKLIPSXXXXXXXXXXXGGSWKLDGRWDGEEEXXLIAAVPGKSVVNVQTKPSLFRVKNGGEXXXXXXXXXXXXXXXXIVNRNGEVVGLYGXXXXXXXXXXXXXXSQTELKEESKEELQEISTMLKKGKTTILDYHPGAGXXXXXXXXXXXXXXXXXXXXXXXXXXXXXXXXXXXXXXXXXXXXXXXXXXXXGSGREVIDVMCHXXXXYRMLEPTRAVNWEVIIMXXXXXXXXXXXXXXXXXXXXXXXXXXXXXXXXXXXXXXXXXXXXXXXXXXXXXXDIPSEPWTAGHEWILADXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAPLYGVEGIKTPVSXXXXXLRDDQRRVSRELVRGCDLPVWLAWQVAKAGLXXXXRKWCFDGPKEHEILNDSGETVKCRAPGGAKRALRPRWCDXXXXXXXXXXXXXXXXXEGRRGAAEMLVILTELPDFLXXXXXXXXXXXXXXXXXXXXXXXXXXXXXXXXXAMTIAMLFILAGLXXXXXXXXXXXXXGISRMSMAKGTMAGCGYLMFLGGVEPTHISYIMXXXXXXXXXXXXXXXXXXSIQDNQVAFXXIGILTLLSIVAANELGMLEKTKEDFFGRRNXXTPSGAIPWSWPDLXXXXXXXXXXXXXXXXXXXXXXXXXXXXXXXXXXXXXXXXXXXXXXXXXXXXXXMKMNISVVMLLISGWNSXTVIPLLCGIGCATLHWSLILPXXXAQQSKLPQRRVFHGVAEXXXXXXXXXXXXXXXXXXXXXXXXXXXXYLLLALSLSSVAMCRTPXSLDEGIVLSSAALGPLIXXXXXXXXXXXXXXXXXXXXXXNYYAFVGVAYNLWKMKTARRGSASGKTLGEXXXRELNLLDRQQFEMYKRTDIIEVDRDMARXXXXXXXXXXXXXXXXXXXXXXXXXXXXYVKLEGRVMDLGCGRGGXXXXXXXXXXXXXVKGFTLGREGHEXXXXVRSLGWNIITFKDKTDVHRLESMKCDTLLCDIGESSPSSVTEGERTLRVLETVEKWLACXXXXXXIKVLAPYMRDVLEKLELXXXXXXXXXXXXXXXXXXXXXXXXXXXXXXXXXXXXXXXXXXXXXXXXXXXXKVTLEPDVILPIGTXXXETDKGPLNREAIKERVERIKTEYAATWFHDNDNPXXXXXXXXXXXXXXXXXXXSMVNGVIKILTYPWDKIEEVXXXXXXXXXXXXXXXXXXXXXXXXXXXXXXXXXXXXXXXXXXXFRHLSREKKPRLCTKEEXXXXXRSHAAIGAYLEEQDQWKXXXXXXXXXXXWELVDEERRLHQQGRCRXXXXXXXXXXXXXXXXXXXXXXXXXXXXXXXXXXXXXXXXXXXXXXXXXXXXXXXXXXXXXXXXXXLGYVIRDLSAMDGGGLYADDXXXXXXXXXXXXXXXEQEIMSYMSSEQRKLAWAIMEMTYKXXXXXXXRPTPGGKAYMDXXXXXXXXXXXXXXXXXXXXXXXXXXXXXXMAEAEMVIHHQHVQECDDSTLARLEAWLAENGCDRLARMAVNGDDCVVRPIDDRFGMALXXXXXXXXXXXXXXEWQPSKGWTDWENVPFCSHHFHELVLKDGRKIVVPCRDQDXXXXXXXXXXXXXXXXXXXXXXXXXXXXXXXXXXXXXXXXXXXXFAVSSAVPMAWVPSGRTTWSVHGKGEWMTTEDMLGVWNRVWVLNNPHMQDKTVIKEWRDVPYXXXXXXXXXXXXXXXXXXXXXXXXXXXVIHRIRTLIGQEKFTDYXXXXXXXXXXXXXXXXXXX

SEQ ID NO: 265805 - protein, 3412 aa, Yellow fever virus
  MOD_RES (1)..(55): Any amino acid
  MOD_RES (73)..(96): Any amino acid
  MOD_RES (128)..(137): Any amino acid
  MOD_RES (155)..(258): Any amino acid
  MOD_RES (274)..(330): Any amino acid
  MOD_RES (348)..(429): Any amino acid
  MOD_RES (447)..(454): Any amino acid
  MOD_RES (464)..(987): Any amino acid
  MOD_RES (1000)..(1048): Any amino acid
  MOD_RES (1077)..(1110): Any amino acid
  MOD_RES (1125)..(1156): Any amino acid
  MOD_RES (1169)..(1174): Any amino acid
  MOD_RES (1194)..(1209): Any amino acid
  MOD_RES (1221)..(1234): Any amino acid
  MOD_RES (1244)..(1268): Any amino acid
  MOD_RES (1319)..(1405): Any amino acid
  MOD_RES (1417)..(1471): Any amino acid
  MOD_RES (1488)..(1582): Any amino acid
  MOD_RES (1596)..(1660): Any amino acid
  MOD_RES (1670)..(1673): Any amino acid
  MOD_RES (1685)..(2026): Any amino acid
  MOD_RES (2036)..(2055): Any amino acid
  MOD_RES (2065)..(2069): Any amino acid
  MOD_RES (2087)..(2103): Any amino acid
  MOD_RES (2121)..(2205): Any amino acid
  MOD_RES (2215)..(2244): Any amino acid
  MOD_RES (2260)..(2263): Any amino acid
  MOD_RES (2275)..(2276): Any amino acid
  MOD_RES (2289)..(2346): Any amino acid
  MOD_RES (2360)..(2365): Any amino acid
  MOD_RES (2381)..(2496): Any amino acid
  MOD_RES (2518)..(2524): Any amino acid
  MOD_RES (2537)..(2630): Any amino acid
  MOD_RES (2678)..(2782): Any amino acid
  MOD_RES (2807)..(2833): Any amino acid
  MOD_RES (2844)..(2889): Any amino acid
  MOD_RES (2903)..(2916): Any amino acid
  MOD_RES (2926)..(3029): Any amino acid
  MOD_RES (3041)..(3058): Any amino acid
  MOD_RES (3076)..(3132): Any amino acid
  MOD_RES (3176)..(3178): Any amino acid
  MOD_RES (3188)..(3207): Any amino acid
  MOD_RES (3219)..(3219): Any amino acid
  MOD_RES (3237)..(3313): Any amino acid
  MOD_RES (3329)..(3331): Any amino acid
  MOD_RES (3349)..(3381): Any amino acid
  MOD_RES (3392)..(3412): Any amino acid
XXXXXXXXXXXXXXXXXXXXXXXXXXXXXXXXXXXXXXXXXXXXXXXXXXXXXXXLTGKKITAHLKKLWRMLXXXXXXXXXXXXXXXXXXXXXXXXSRKRRSSEMTAFQLLILGMILMGGGVTLVRKXXXXXXXXXXEDLGKTFSIGTGNCTTNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIAYLVGNNKTQRVVIXXXXXXXXXXXXXXXXXXXXXXXXXXXXXXXXXXXXXXXXXXXXXXXXXXXXXXXXXETVAIDGPVEARKVCYNXXXXXXXXXXXXXXXXXXXXXXXXXXXXXXXXXXXXXXXXXXXXXXXXXXXXXXXXXXXXXXXXXXXXXXXXXXXXXXXXXXVGAKQEDWKTDIKTLKFXXXXXXXXVEFTGYGKAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTWMMHTLETLDYXXXXXXXXXXXXXXXXXXXXXXXXXXXXXXXXXXXXXXXXXXXXXXXXXVPLEVKREPCPGTSVVVDTGCDGRGKSTXXXXXXXXXXXXXXXXXXXXXXXXXXXXXXXXXXMEIRPRKAHESHLVXXXXXXXXXXXXXXXXXXXXXXXXXXXXXXXXPKQVLVGGVVLLXXXXXXQVTLLDLLEFTMAVGLHFHXXXXXXXXXXXXXXXXFSIRPGLLVGFXXXXXXXXXXXXXXAFGAAMVEIXXXXXXXXXXXXXXXXXXXXXXXXXISSRKASNMILPLMALLTPMTMHEVRMAAMLLCTVVIVGVLYQNSKDTSMXXXXXXXXXXXXXXXXXXXXXXXXXXXXXXXXXXXXXXXXXXXXXXXXXXXXXXXXXXXXXXXXXXXXXXXXXXXXXXXXXXXXXXXELKKLGEVAWEXXXXXXXXXXXXXXXXXXXXXXXXXXXXXXXXXXXXXXXXXXXXXXXXXXXXXXXLGGWLFHVRRARRSGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLIAAAPGKNVVNVXXXXXXXXXXXXXXXXXXXXXXXXXXXXXXXXXXXXXXXXXXXXXXXXXXXXXXXXXXXXXXXXXGKEELQEISXXXXKGMTTILDYHPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNCDQPVWLSXXXXXXXXXXXXXXXXXXXXDEHEILNDSXXXXXCRTPGGAKRPLRPRWCDXXXXXXXXXXXXXXXXXEGRRGAADILVVLSELPXXXXXXXXXXXXXXXXXXXXXXXXXXXXXXXXXXXXXXXXXXXXXXXXXXXXXXXXXXXXXXXXXXXXXXXXXXXXXXXXXXXXXAKPTHISYIXXXXXXXXXXXXXXXXXXXXXXXXXXXXXXIGILTLLSIVAANELXXXXRTKEDFFGKRNXXISSGASPWSWPDXXXXXXXXXXXXXXXXXXXXXXXXXXXXXXXXXXXXXXXXXXXXXXXXXXXXXXXXXXNISVIMLLISGWNXXXXXXLLCGIGCAMLHWTLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYNLWKMKTERRGTANGKTLGEXXXXXXXLLDKQQFEMYKRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVTFKDKTDIHRLEPLKCETLLCDIGESSSSSITEGERTLRVLETVEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIEERVERIKTEYAATWFHDNDNXXXXXXXXXXXXXXXXXXXXXXXXXXXKLLTYPWDKIXXXXXXXXXXXXXXXXXXXXXXXXXXXXXXXXXXXXXXXXXXXXXXFRHLAREKKPRLCXXXXXXXXXXXXXXIGAYLEEQDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAAMDGGGLYAXXXXXXXXXXXXXXXXXXQEILNYMSPEQRKLAWAXXXXXXXXXXXXXXXXXXXXXXXXXXXXXXXXXXXXXXXXXXXXXXXXXXXXXXXXXEAEMVINHQHVNECGENVLVRLEAWLIEHGCDRLSRMAVSGDDXXXKPVDDRFGLXXXXXXXXXXXXXXXXXXXXSKGWTDWENVPXCSHRFHELVLKDGRKIVXXXXXXXXXXXXXXXXXXXXXXXXXXXXXXXXXXXXXXXXXXXXXXXXXXXXXXXXXXXXXXXXXXXXXXXXXXXXXWMTTEDRLEVWNRVWXXXNPHMKDKTTVKEWRDVPXXXXXXXXXXXXXXXXXXXXXXXXXXXXXXXXXRNLIGQEKYTXXXXXXXXXXXXXXXXXXXXX

SEQ ID NO: 265806 - protein, 3412 aa, Yellow fever virus
  MOD_RES (1)..(106): Any amino acid
  MOD_RES (116)..(118): Any amino acid
  MOD_RES (128)..(139): Any amino acid
  MOD_RES (155)..(431): Any amino acid
  MOD_RES (445)..(1183): Any amino acid
  MOD_RES (1193)..(1268): Any amino acid
  MOD_RES (1279)..(1290): Any amino acid
  MOD_RES (1315)..(1472): Any amino acid
  MOD_RES (1485)..(2069): Any amino acid
  MOD_RES (2081)..(2106): Any amino acid
  MOD_RES (2120)..(2265): Any amino acid
  MOD_RES (2275)..(2276): Any amino acid
  MOD_RES (2287)..(2369): Any amino acid
  MOD_RES (2379)..(2635): Any amino acid
  MOD_RES (2653)..(2660): Any amino acid
  MOD_RES (2678)..(2793): Any amino acid
  MOD_RES (2806)..(3135): Any amino acid
  MOD_RES (3176)..(3313): Any amino acid
  MOD_RES (3327)..(3334): Any amino acid
  MOD_RES (3349)..(3412): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVQLLILGMXXXTGGVTLMRKXXXXXXXXXXXXLGKTFSMGTGNCTTNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAKQENWKTDIKTLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTVAVGLHFXXXXXXXXXXXXXXXXXXXXXXXXXXXXXXXXXXXXXXXXXXXXXXXXXXXXXXXXXXXXXXXXXXXXXXXXXXXXISSRKASNTIXXXXXXXXXXXXYEVRLATMLLCAVVIVGVLHQNAKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGWILHIKGARRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCRSPGGAKRALXXXXXXXXXXXXXXXXXXXXXXXXXXRGAAEMLVILTELXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKEDFFGKRDXXIPSGASPWSWXXXXXXXXXXXXXXXXXXXXXXXXXXXXXXXXXXXXXXXXXXXXXXXXXXXXXXXXXXXXXXXXXXXXXXXXXXXXXXXXXXXIGCAMLHWTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTDIHHLEPMKCDTLLCXXXXXXXXSATEGERTLRVLETIEKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEYATTWFYDNDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNVIHHHHVQDCDEGVLERLETWLAENGCDRLNRMAVNGDDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWMTTQDMLDVWNRXXXXXXXXMTDKTTIKEWRDVPXXXXXXXXXXXXXXXXXXXXXXXXXXXXXXXXXXXXXXXXXXXXXXXXXXXXXXXXXXXXXXXX

SEQ ID NO: 265807 - protein, 3412 aa, Yellow fever virus
  MOD_RES (2275)..(2276): Any amino acid
  MOD_RES (3150)..(3150): Any amino acid
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTAGEIHAVPFGLVSMMIAMEVVLRKRQGPKQMLVGGVVLLGAMLVGQVTLLDLLKLTVAVGLHFHEMNNGGDAMYMALIAAFSIRPGLLIGFGLRTLWSPRERLVLTLGAAMVEIALGGVMGGLWKYLNAVSLCILTINAVASRKASNTILPLMALLTPVTMAEVRLAAMFFCAVVIIGVLHQNFKDTSMQKTIPLVALTLTSYLGLTQPFLGLCAFLATRIFGRRSIPVNEALAAAGLVGVLAGLAFQEMENFLGPIAVGGLLMMLVSVAGRVDGLELKKLGEVSWEEEAEISGSSARYDVALSEQGEFKLLSEEKVPWDQVVMTSLALVGAALHPFALLLVLAGWLFHVRGARRSGDVLWDIPTPKIIEECEHLEDGIYGIFQSTFLGASQRGVGVAQGGVFHTMWHVTRGAFLVRNGKKLIPSWASVKEDLVAYGGSWKLEGRWDGEEEVQLIAAVPGKNVVNVQTKPSLFKVRNGGEIGAVALDYPSGTSGSPIVNRNGEVIGLYGNGILVGDNSFVSAISQTEVKEEGKEELQEIPTMLKKGMTTILDFHPGAGKTRRFLPQILAECARRRLRTLVLAPTRVVLSEMKEAFHGLDVKFHTQAFSAHGSGREVIDAMCHATLTYRMLEPTRVVNWEVIIMDEAHFLDPASIAARGWAAHRARANESATILMTATPPGTSDEFPHSNGEIEDVQTDIPSEPWNTGHDWILADKRPTAWFLPSIRAANVMAASLRKAGKSVVVLNRKTFEREYPTIKQKKPDFILATDIAEMGANLCVERVLDCRTAFKPVLVDEGRKVAIKGPLRISASSAAQRRGRIGRNPNRDGDSYYYSEPTSENNAHHVCWLEASMLLDNMEVRGGMVAPLYGVEGTKTPVSPGEMRLRDDQRKVFRELVRNCDLPVWLSWQVAKAGLKTNDRKWCFEGPEEHEILNDSGETVKCRAPGGAKKPLRPRWCDERVSSDQSALSEFIKFAEGRRGAAEVLVVLSELPDFLAKKGGEAMDTISVFLHSEEGSRAYRNALSMMPEAMTIVMLFILAGLLTSGMVIFFMSPKGISRMSMAMGTMAGCGYLMFLGGVKPTHISYIMLIFFVLMVVVIPEPGQQRSIQDNQVAYLIIGILTLVSAVAANELGMLEKTKEDLFGKKNXXIPSSASPWSWPDLDLKPGAAWTVYVGIVTMLSPMLHHWIKVEYGNLSLSGIAQSASVLSFMDKGIPFMKMNISVIMLLVSGWNSITVMPLLCGIGCAMLHWSLILPGIKAQQSKLAQRRVFHGVAKNPVVDGNPTVDIEEAPEMPALYEKKLALYLLLALSLASVAMCRTPFSLAEGIVLASAALGPLIEGNTSLLWNGPMAVSMTGVMRGNHYAFVGVMYNLWKMKTGRRGSANGKTLGEVWKRELNLLDKQQFELYKRTDIVEVDRDTARRHLAEGKVDTGVAVSRGTAKLRWFHERGYVKLEGRVIDLGCGRGGWCYYAAAQKEVSGVKGFTLGRDGHEKPMNVQSLGWNIITFKDKTDIHRLEPVKCDTLLCDIGESSSSSVTEGERTVRVLDTVEKWLACGVDNFCVKVLAPYMPDVLEKLELLQRRFGGTVIRNPLSRNSTHEMYYVSGARSNVTFTVNQTSRLLMRRMRRPTGKVTLEADVILPIGTRSVETDKGPLDKEAIEERVERIKSEYMTSWFYDNDNPYRTWHYCGSYVTKTSGSAASMVNGVIKILTYPWDRIEEVTRMAMTDTTPFGQQRVFKEKVDTRAKDPPAGTRKIMKVVNRWLFRHLAREKNPRLCTKEEFIAKVRSHAAIGAYLEEQEQWKTANEAVQDPKFWELVDEERKLHQQGRCRTCVYNMMGKREKKLSEFGKAKGSRAIWYMWLGARYLEFEALGFLNEDHWASRENSGGGVEGIGLQYLGYVIRDLAAMDGGGFYADDTAGWDTRITEADLDDEQEILNYMSPHHKKLAQAVMEMTYKNKVVKVLRPAPGGKAYMDVISRRDQRGSGQVVTYALNTITNLKVQLIRMAEAEMVIHHQHVQDCDESXLTRLEAWLTEHGCNRLKRMAVSGDDCVVRPIDDRFGLALSHLNAMSKVRKDISEWQPSKGWNDWENVPFCSHHFHELQLKDGRRIVVPCREQDELIGRGRVSPGNGWMIKETACLSKAYANMWSLMYFHKRDMRLLSLAVSSAVPTSWVPQGRTTWSIHGKGEWMTTEDMLEVWNRVWITNNPHMQDKTMVKKWRDVPYLTKRQDKLCGSLIGMTNRATWASHIHLVIHRIRTLIGQEKYTDYLTVMDRYSVDADLQLGELI

SEQ ID NO: 265808 - protein, 3412 aa, Yellow fever virus
  MOD_RES (1)..(10): Any amino acid
  MOD_RES (30)..(30): Any amino acid
  MOD_RES (158)..(185): Any amino acid
  MOD_RES (216)..(221): Any amino acid
  MOD_RES (277)..(281): Any amino acid
  MOD_RES (382)..(415): Any amino acid
  MOD_RES (496)..(499): Any amino acid
  MOD_RES (563)..(574): Any amino acid
  MOD_RES (639)..(653): Any amino acid
  MOD_RES (675)..(682): Any amino acid
  MOD_RES (774)..(774): Any amino acid
  MOD_RES (884)..(889): Any amino acid
  MOD_RES (911)..(928): Any amino acid
  MOD_RES (970)..(981): Any amino acid
  MOD_RES (1044)..(1044): Any amino acid
  MOD_RES (1519)..(1535): Any amino acid
  MOD_RES (1562)..(1562): Any amino acid
  MOD_RES (1615)..(1620): Any amino acid
  MOD_RES (1644)..(1647): Any amino acid
  MOD_RES (1692)..(1715): Any amino acid
  MOD_RES (1774)..(1824): Any amino acid
  MOD_RES (1848)..(1860): Any amino acid
  MOD_RES (1937)..(1959): Any amino acid
  MOD_RES (1979)..(1989): Any amino acid
  MOD_RES (2127)..(2127): Any amino acid
  MOD_RES (2147)..(2151): Any amino acid
  MOD_RES (2275)..(2276): Any amino acid
  MOD_RES (2292)..(2296): Any amino acid
  MOD_RES (2316)..(2331): Any amino acid
  MOD_RES (2471)..(2479): Any amino acid
  MOD_RES (2556)..(2575): Any amino acid
  MOD_RES (2595)..(2600): Any amino acid
  MOD_RES (2723)..(2726): Any amino acid
  MOD_RES (2746)..(2752): Any amino acid
  MOD_RES (2852)..(2873): Any amino acid
  MOD_RES (2967)..(2981): Any amino acid
  MOD_RES (3001)..(3008): Any amino acid
  MOD_RES (3048)..(3052): Any amino acid
  MOD_RES (3121)..(3126): Any amino acid
  MOD_RES (3150)..(3150): Any amino acid
  MOD_RES (3197)..(3200): Any amino acid
  MOD_RES (3251)..(3278): Any amino acid
  MOD_RES (3353)..(3363): Any amino acid
XXXXXXXXXXLGVNMVRRGARSLSNKIKQXTKQIGNRPGLSRGVQGFISFFLFNILTGKKLTTHLKRLWRMLDPRQGLAALRKVKRVVAGLMIGLSSRKRRSNEMAMMPLLILSMVILAGGVTLMRKNRWLLLNVTAEDLGKTFSLGAGNCTTNILEXXXXXXXXXXXXXXXXXXXXXXXXXXXXCYGVENVRVAYGRCDAVGRSKRSRRAIDLPXXXXXXLKTRQEKWMAGRMGERQLQKIERWLVRNPFFAVTALAIAYLVGNNTTQRVVIALLXXXXXPAYSAHCIGVADRDFIEGVHGGTWVSASLEQGKCVTVMAPDKPSLDISLETVAIDGPAEARKVCYSAVLTHVKIDDKCPSTGEAHLAEENDGDNACKRTYXXXXXXXXXXXXXXXXXXXXXXXXXXXXXXXXXXDQTKIQYVIKARLHVGAKQENWTTSIKTLKFDALSGSQEAEFTGYGKVTLECRVQTAVDFGNSYIAEMEKDSWIVDRQWAXXXXLPWQSGSGGIWRGMHHLVEFEPPHAATIRVLALGDQEGSLKTALTGAMRVTKDENDNNLYKLHXXXXXXXXXXXXLTLKGTSYKMCTDKMSFVKNPTDTDHGTVVMQVKVPKGAPCKIPVIVADDLTAAVNKGILVTVNXXXXXXXXXXXXXXXPPFGDSYIIVGTGDSRLTYQWXXXXXXXXKLFTQTMKGAERLAVMGDAAWDFSSAGGLFTSIGKGSHTVFGSAFQGLFGGLSWITKVIMGAVLIWVGFNTRNMTMSMSMIMVGVIMMFLSXGVGADQGCAVNFAKRELKCGDGIFVFRDSDDWLTKYSYYPEDPVKLASIIKASHEEGKCGLNSVDSLDHEMWRSRADEINAILEENEVDISVVVQDPKNIYQRGTHPFSXXXXXXQYGWKTWGKNLIFSPGRKNGSXXXXXXXXXXXXXXXXXXNSFQIEEFGMGVFTTRVFMDAVFDYSVDCDGAILGAAVNGKXXXXXXXXXXXXSHEVNGTWMIHTLETLDYKECEWPPTHTIGTSVEESDMFMPRSIGGPVSSHNRIPGYKVQTNXPWMQVPLEVRREPCPGTSVVLDSGCDGRGKSTRSTTDSGKIIPEWCCRSCTMPPVSFHGNDGCWYPMEIRPMKASDSHLVRSWVTAGEVHAVPFGLVSMMIALEVVLRKRQGPKQMLVGGIILLGAMLVGQVTVLDLVKLIVAVGLHFHEINNGGDAMYMALIAAFSVRPGLLVGFGLRTLWSPRERLVLAFGAAMVEIALGGMMGGLWQYLNAVSLCVLTINAVASRKASNAILPLMALMTPVTMAEVRLATMLFCTVVIIGVLHQNSKDTSMQKTIPIVALTLTSYMGLTQPFLGLCAYMSTQVFGRRSIPVNEALAATGLVGVLAGLAFQDMENFLGPIAVGGILMMLVSVAGRVDGLELRKLGEIAWEEEAEISGSSSRYDVALNEQGEFKLLSEDKVPWDQIVMTSLALVGAAIHPFALLLVLAGWLLHVKRARRSGDVLWDIPTPKVIEECEHLEDGISGIFQSTFLGXXXXXXXXXXXXXXXXXWHVTRGAFLLRNGKKLVPSWASVKEDXVAYGGSWKLDGKWDGEEEVQLIAAVPGKAVVNVQTKPSVFRVKNGGEIGAVAXXXXXXTSGSPIVNRSGEVVGLYGNGILVXXXXFVSAISQTEVKEEGKEELREIPTMLKKGMTTVLDYHPGAGKTRRXXXXXXXXXXXXXXXXXXXXXXXXVLSEMKEAFQGLDVKFHTQAFSAHGSGKEVIDVMCHATLTYRMLEPTRIVNWEVIIMDXXXXXXXXXXXXXXXXXXXXXXXXXXXXXXXXXXXXXXXXXXXXXXXXXXXQTDIPSEPWTSGHEWILADKRPTXXXXXXXXXXXXXAASLRKAGKNVVVLNRKTFEKEYPTIKQKRPDFILATDIAEMGANLCVERVLDCRTAYKPVLVDEGKKVAIKGPLRXXXXXXXXXXXXXXXXXXXXXXXYYYSEPTSEDNAHHVCWLEXXXXXXXXXXXGGMVAPLYGIEGIKTPVSPGEMRLRDDQRRVFRELVRGCDQPVWLAWQVAKPGLKTNDRKWCFDGPEEHEILNDNGETVKCRSPGGAKKALRPRWCDERVSSDQSALADFIKFAEGRRGAAEMLVVLTELPDFLAKKXGEAMDTISVLLHSEEGSRAXXXXXSMMPEAMTIVMLFLLAGLLTSGAVIFFMSPKGMSRMSMAMGTMAGSGYLMFLGGVKPTHISYVMLIFFVLMVVVIPEPGQQRTIQDNQVAYLIIGILTLVSVVAANELGMLEKTKEDLFGKKDXXTSGGTIPWSWPDLDLXXXXXWTVYVGIVTILSPMLHHWIXXXXXXXXXXXXXXXXSVLSFMDKGVPFMKMNISVIILLVSGWNSITVIPLLCGVGGAMLHWTLILPGIKAQQSKLAQKRVFHGVAENPVVDGNPTADIEEAPEMPVLYEKKLALYLLLALSLMSVAMCRTPFSLAEGIVLASAASGPLIEGNTSXXXXXXXXXSMTGVMRGNYYAFVGVMYNLWKMETGRRGRASGKTLGEVWKRELNLLDKRQFELYKRTDITEVDRDMARRHLAEGKXXXXXXXXXXXXXXXXXXXXGYVKLEGRVTDLGCGRGGWXXXXXXQKEVSGVKGYTLGREGHEKPMNVQSLGWNIVTFKDKTDIHHLEPAKCETLLCDIGESSPSSVTEGERTMRVLETIEKWLACGVDNFCVKVLAPYMPDVIEKLELLQRRFGGTIIRNPLSRNSXXXXYYVSGARSNITFTVNQTSRXXXXXXXRPTGKVTLEADVTLPIGTRSVETDKGPLDRDAIEERVERIKSEYMTTWFHDNDNPYRTWHYCGSYITKTSGSAASMINGVIKILTFPWDKIEEVTRMAMXXXXXXXXXXXXXXXXXXXXXXPPAGTRKIMRVVNRWLFRHLAREKSPRLCTKEEFIAKVRSHAAVGAFLEEQDQWKTANEAVQDPKFWEMVDAERKLHQQGRCQSCVYNMMGKRXXXXXXXXXXXXXXXIWYMWLGARFLEFEALGFLXXXXXXXXENSGGGVEGTGLQYLGYVIKDLSTKEGGGLYADDTAGWDXXXXXADLDDEQEIMSYMNAEQRKLAWAIMEMTYKNKVVKVLRPAPGGKAFMDIISRRDQRGSRQVVTYALNTXXXXXXQLIRMAEAEMVINHQHVNECDEGXLARLEAWLTEHGCDRLARMAVSGDDCVVRPVDDRFGMALSHLNAMSXXXXDISEWQPSKGWTDWENVPFCSHHFHELHLKDGRKVVVPCRDQDELIGRGRXXXXXXXXXXXXXXXXXXXXXXXXXXXXHKRDMRLLSFAVSSAVPTAWVPSGRTTWSVHGKGEWMTTEDMLDVWNRVWVLNNPHMQDKTMVKEWRDVPYLTKXXXXXXXXXXXMTNRATWASNIHLVIHRIRTLVGQEKFTDYLTVMDRYSVDADLQPGELI

SEQ ID NO: 265809 - protein, 3412 aa, Yellow fever virus
  MOD_RES (1)..(39): Any amino acid
  MOD_RES (50)..(51): Any amino acid
  MOD_RES (129)..(136): Any amino acid
  MOD_RES (156)..(188): Any amino acid
  MOD_RES (205)..(244): Any amino acid
  MOD_RES (277)..(303): Any amino acid
  MOD_RES (319)..(327): Any amino acid
  MOD_RES (357)..(417): Any amino acid
  MOD_RES (473)..(476): Any amino acid
  MOD_RES (495)..(502): Any amino acid
  MOD_RES (519)..(524): Any amino acid
  MOD_RES (535)..(589): Any amino acid
  MOD_RES (600)..(606): Any amino acid
  MOD_RES (620)..(655): Any amino acid
  MOD_RES (673)..(691): Any amino acid
  MOD_RES (722)..(732): Any amino acid
  MOD_RES (754)..(777): Any amino acid
  MOD_RES (794)..(818): Any amino acid
  MOD_RES (838)..(856): Any amino acid
  MOD_RES (876)..(891): Any amino acid
  MOD_RES (909)..(940): Any amino acid
  MOD_RES (960)..(981): Any amino acid
  MOD_RES (1001)..(1047): Any amino acid
  MOD_RES (1086)..(1108): Any amino acid
  MOD_RES (1128)..(1143): Any amino acid
  MOD_RES (1196)..(1202): Any amino acid
  MOD_RES (1258)..(1267): Any amino acid
  MOD_RES (1323)..(1340): Any amino acid
  MOD_RES (1360)..(1398): Any amino acid
  MOD_RES (1423)..(1423): Any amino acid
  MOD_RES (1436)..(1456): Any amino acid
  MOD_RES (1490)..(1493): Any amino acid
  MOD_RES (1513)..(1536): Any amino acid
  MOD_RES (1556)..(1564): Any amino acid
  MOD_RES (1611)..(1624): Any amino acid
  MOD_RES (1640)..(1651): Any amino acid
  MOD_RES (1689)..(1738): Any amino acid
  MOD_RES (1753)..(1754): Any amino acid
  MOD_RES (1774)..(1825): Any amino acid
  MOD_RES (1845)..(1880): Any amino acid
  MOD_RES (1891)..(1908): Any amino acid
  MOD_RES (1928)..(1992): Any amino acid
  MOD_RES (2009)..(2011): Any amino acid
  MOD_RES (2045)..(2046): Any amino acid
  MOD_RES (2088)..(2102): Any amino acid
  MOD_RES (2125)..(2155): Any amino acid
  MOD_RES (2175)..(2181): Any amino acid
  MOD_RES (2217)..(2224): Any amino acid
  MOD_RES (2275)..(2276): Any amino acid
  MOD_RES (2291)..(2342): Any amino acid
  MOD_RES (2384)..(2384): Any amino acid
  MOD_RES (2404)..(2429): Any amino acid
  MOD_RES (2467)..(2486): Any amino acid
  MOD_RES (2519)..(2519): Any amino acid
  MOD_RES (2550)..(2575): Any amino acid
  MOD_RES (2595)..(2605): Any amino acid
  MOD_RES (2620)..(2621): Any amino acid
  MOD_RES (2683)..(2686): Any amino acid
  MOD_RES (2706)..(2755): Any amino acid
  MOD_RES (2772)..(2772): Any amino acid
  MOD_RES (2809)..(2825): Any amino acid
  MOD_RES (2848)..(2888): Any amino acid
  MOD_RES (2908)..(2910): Any amino acid
  MOD_RES (2930)..(2938): Any amino acid
  MOD_RES (2958)..(3021): Any amino acid
  MOD_RES (3044)..(3056): Any amino acid
  MOD_RES (3084)..(3088): Any amino acid
  MOD_RES (3102)..(3129): Any amino acid
  MOD_RES (3150)..(3150): Any amino acid
  MOD_RES (3191)..(3202): Any amino acid
  MOD_RES (3245)..(3286): Any amino acid
  MOD_RES (3351)..(3375): Any amino acid
  MOD_RES (3395)..(3412): Any amino acid
XXXXXXXXXXXXXXXXXXXXXXXXXXXXXXXXXXXXXXXPSRGVQGFISXXSFNILTGKKLTAHLKKLWRMLDPRQGLTVLRKVKRVVASLMIGLSSRKRRSHDALTFPLLLLGLLALSGGVTLVRKNXXXXXXXXSEDLGKTFSMGTGNCTTNIXXXXXXXXXXXXXXXXXXXXXXXXXXXXXXXXXVENVRVTYGKCDSAGRXXXXXXXXXXXXXXXXXXXXXXXXXXXXXXXXXXXXXXXXWLVRNPFFAITALAIAYLVGNNKTQRVVIALLXXXXXXXXXXXXXXXXXXXXXXXXXXXTWVSATLEQGKCVTVXXXXXXXXXISLQTVAIDRPAEARKVCYNAVLTHVKIDXXXXXXXXXXXXXXXXXXXXXXXXXXXXXXXXXXXXXXXXXXXXXXXXXXXXXXXXXXXXXTKIQYVIRAQLHVGAKQENWNTDIKTLKFDVLSGSQEAEFTGYGKATLECRVQTAXXXXNSYIAEMEKDSWIVDRQWXXXXXXXXQSGSGGVWRGMHHLVEXXXXXXVTIRVLALGNXXXXXXXXXXXXXXXXXXXXXXXXXXXXXXXXXXXXXXXXXXXXXXXXXXXXXXXSFVKNPTDTDXXXXXXXVKVPKGAPCRIPVXXXXXXXXXXXXXXXXXXXXXXXXXXXXXXXXXXXXFGDSYIIIGTGDSRLTYXXXXXXXXXXXXXXXXXXXVERLAVMGDVAWDFSSAGGFLTSVGKGIHTXXXXXXXXXXXGLNWITKVIMGVVLIWVGINTXXXXXXXXXXXXXXXXXXXXXXXXADQGCAINFAKRELKCXXXXXXXXXXXXXXXXXXXXXXXXXKLASIIKASYEEGKCGLNSXXXXXXXXXXXXXXXXXXXFEENEVDISIVVQDPKNIYXXXXXXXXXXXXXXXXGWKTWGKSLVFSPGRKNXXXXXXXXXXXXXXXXXXXXXXXXXXXXXXXXFTTRVFMDATFDYSVDCDGXXXXXXXXXXXXXXXXXXXXXXSHEVNGTWMMHTLETLDYKXXXXXXXXXXXXXXXXXXXXXXXXXXXXXXXXXXXXXXXXXXXXXXXQVPLEVRREVCPGTSVVVDTNCDGRGKSARSTTDSGKIXXXXXXXXXXXXXXXXXXXXXXXYPMEIRPRKTSDSHLVRSWXXXXXXXXXXXXXXXXMIAMEVVLRRRQGPKQVLVGGMVLLGAMLVGQVTMLDLVKFTMAVGLHFHEMXXXXXXXYMALIASFSIRPGLLMGFGLRTLWSPRERLVMAFGAAMVEVALGGMMGGLWQYLNXXXXXXXXXXAISSRKASNAVLPLMALLTPVTMAEVRLAAMLFCTVVIVGVLHQNAKDTSMQKTIXXXXXXXXXXXXXXXXXXGLCAFLATRLFGRRSIPVNXXXXXXXXXXXXXXXXXXXXXXXXXXXXXXXXXXXXXXXAGKVDGLELKKLGEVAWEEEAEISXSSARYDVALNEQXXXXXXXXXXXXXXXXXXXXXALVGAAIHPSALLLVLAGWVFHIRRARRSGDVLXXXXTPKVIEECEYLEDGIYGIFXXXXXXXXXXXXXXXXXXXXXXXXHVTRGAFLVWNGKKLIPSWXXXXXXXXXYGGSWKLDGRWDGEEEVQLIAAVPGKSVVNVQTKPSLFRVKNGGEIXXXXXXXXXXXXXXPIVNRNGEVVGLYGNXXXXXXXXXXXXISQTEVKEESKEELQEISTMLKKGKTTILDYHPGAGKXXXXXXXXXXXXXXXXXXXXXXXXXXXXXXXXXXXXXXXXXXXXXXXXXXHGSGREVIDVMCHAXXTYRMLEPTRAVNWEVIIMDXXXXXXXXXXXXXXXXXXXXXXXXXXXXXXXXXXXXXXXXXXXXXXXXXXXXTDIPSEPWTAGHEWILADKXXXXXXXXXXXXXXXXXXXXXXXXXXXXXXXXXXXXKEYPTIKQKKXXXXXXXXXXXXXXXXXXDRVLDCRTAYKPVLVDEGKXXXXXXXXXXXXXXXXXXXXXXXXXXXXXXXXXXXXXXXXXXXXXXXXXXXXXXXXXXXXXXXXXVAPLYGVEGIKTPVSPXXXRLRDDQRRVFRELVRNCDLPVWLSWQVAKPGLKXXDRKWCFEGPKEHEILNDSGETVKCRAPGGAKRPLRPRWCDEXXXXXXXXXXXXXXXAEGRRGAAEMLVILTELPDFLAXXXXXXXXXXXXXXXXXXXXXXXXXXXXXXXEAMTIAMLFLLAGLLTSGAXXXXXXXKGISRMSMAKGTMAGCGYLMFLGGVEPTHISYIMLXXXXXXXXIIPEPGQQRSIQDNQVAFLIIGILTLLSIVAANELGMLERTKEDFFGKRNXXIPSGAIPWSWPDLDXXXXXXXXXXXXXXXXXXXXXXXXXXXXXXXXXXXXXXXXXXXXXXXXXXXXFMKMNISVVMLLISGWNSITVIPLLCGIGCATLHWSLILPGXKAQQSKLPQRRVFHGVAENXXXXXXXXXXXXXXXXXXXXXXXXXXLYLLLALSLSSVAMCRTPFSLDEGIVLSSAALGPLIEXXXXXXXXXXXXXXXXXXXXGNYYAFVGVAYNLWKMKTARRGSASGKTLGEVXKRELNLLDRQQFEMYKRTDIIEVDRDMARRXXXXXXXXXXXXXXXXXXXXXXXXXXGYVKLEGRVMDLGCGRGGWXXXXXXXXXXXGVKGFTLGREGHEKXXNVRSLGWNIITFKDKTDVHPLEPMKCDTLLCDIGESSSSSVTEGERTLRVLETVEKWLACGXXXXCIKVLAPYMRDVLEKLELLXXXXXXXXXXXXXXXXXXXXXXXXXXXXXXXXXXXXXXXXXXXXXXXXXXGKVTLEPDVILPIGTRXVETDKGPLNREAIKERVERIKTEYAATWFHDNDNPYXXXXXXXXXXXXXXXXXASMVNGVIKILTYPWDKIEEVTXXXXXXXXXXXXXXXXXXXXXXXXXXXXXXXXXXXXXXXXXLFRHLSREKKPRLCTKEEFXXXVRSHAAIGAYLEEQDQWKTXXXXXXXXXFWELVDEERRLHQQGRCRTXXXXXXXXXXXXXXXXXXXXXXXXXXXXXXXXXXXXXXXXXXXXXXXXXXXXXXXXXXXXXXXXYLGYVIRDLAAMDGGGLYADDTXXXXXXXXXXXXXDEQEIMNYMSPEQRKLAWAIMEMTYKNXXXXXLRPTPGGKAYMDVXXXXXXXXXXXXXXXXXXXXXXXXXXXXRMAEAEMVINHQHVNECDESXLARLDAWLAENGCDRLRRMAVSGDDCVVRPIDDRFGMALSXXXXXXXXXXXXSEWQPSKGWTDWESVPFCSHHFHELVLKDGRKIVVPCRDQDEXXXXXXXXXXXXXXXXXXXXXXXXXXXXXXXXXXXXXXXXXXSFAVSSAVPMAWVPSGRTTWSVHGKGEWMTTEDMLGVWNRVWVLNNPHMQDKTVIKEWRDVPYLXXXXXXXXXXXXXXXXXXXXXXXXXLVIHRIRTLIGQEKFTDYLXXXXXXXXXXXXXXXXXX

SEQ ID NO: 265810 - protein, 3412 aa, Yellow fever virus
  MOD_RES (1)..(54): Any amino acid
  MOD_RES (74)..(95): Any amino acid
  MOD_RES (129)..(136): Any amino acid
  MOD_RES (156)..(257): Any amino acid
  MOD_RES (275)..(329): Any amino acid
  MOD_RES (349)..(428): Any amino acid
  MOD_RES (448)..(453): Any amino acid
  MOD_RES (465)..(691): Any amino acid
  MOD_RES (702)..(734): Any amino acid
  MOD_RES (752)..(986): Any amino acid
  MOD_RES (1001)..(1047): Any amino acid
  MOD_RES (1078)..(1109): Any amino acid
  MOD_RES (1126)..(1155): Any amino acid
  MOD_RES (1170)..(1173): Any amino acid
  MOD_RES (1195)..(1208): Any amino acid
  MOD_RES (1222)..(1233): Any amino acid
  MOD_RES (1245)..(1267): Any amino acid
  MOD_RES (1320)..(1404): Any amino acid
  MOD_RES (1418)..(1470): Any amino acid
  MOD_RES (1489)..(1581): Any amino acid
  MOD_RES (1597)..(1656): Any amino acid
  MOD_RES (1671)..(1672): Any amino acid
  MOD_RES (1686)..(2020): Any amino acid
  MOD_RES (2037)..(2054): Any amino acid
  MOD_RES (2066)..(2068): Any amino acid
  MOD_RES (2088)..(2102): Any amino acid
  MOD_RES (2122)..(2204): Any amino acid
  MOD_RES (2216)..(2224): Any amino acid
  MOD_RES (2235)..(2243): Any amino acid
  MOD_RES (2261)..(2262): Any amino acid
  MOD_RES (2275)..(2276): Any amino acid
  MOD_RES (2290)..(2345): Any amino acid
  MOD_RES (2361)..(2364): Any amino acid
  MOD_RES (2382)..(2495): Any amino acid
  MOD_RES (2519)..(2523): Any amino acid
  MOD_RES (2538)..(2629): Any amino acid
  MOD_RES (2679)..(2782): Any amino acid
  MOD_RES (2808)..(2832): Any amino acid
  MOD_RES (2845)..(2888): Any amino acid
  MOD_RES (2904)..(2915): Any amino acid
  MOD_RES (2927)..(3028): Any amino acid
  MOD_RES (3042)..(3057): Any amino acid
  MOD_RES (3077)..(3131): Any amino acid
  MOD_RES (3150)..(3150): Any amino acid
  MOD_RES (3189)..(3206): Any amino acid
  MOD_RES (3238)..(3310): Any amino acid
  MOD_RES (3330)..(3330): Any amino acid
  MOD_RES (3350)..(3380): Any amino acid
  MOD_RES (3393)..(3412): Any amino acid
XXXXXXXXXXXXXXXXXXXXXXXXXXXXXXXXXXXXXXXXXXXXXXXXXXXXXXILTGKKITAQLKRLWKMLDXXXXXXXXXXXXXXXXXXXXXXSSRKRRSSEMTLVQLLILGMILMGGGVTLVRKNXXXXXXXXSEDLGKTFSVGAGNCTTNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAYLVGNNKTQRVVIAXXXXXXXXXXXXXXXXXXXXXXXXXXXXXXXXXXXXXXXXXXXXXXXXXXXXXXXLETVAIDGPVEARKVCYNAXXXXXXXXXXXXXXXXXXXXXXXXXXXXXXXXXXXXXXXXXXXXXXXXXXXXXXXXXXXXXXXXXXXXXXXXXXXXXXXXHVGAKQEDWKTDIKTLKFDXXXXXXEVEFTGYGKATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVERLAVMGDAXXXXXXXXXXXXXXXXXXXXXXXXXXXXXXXXXNWITKVIIGAVLIWVGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTWMVHTLETLDYKXXXXXXXXXXXXXXXXXXXXXXXXXXXXXXXXXXXXXXXXXXXXXXXQVPLEVKREPCPGTSVVVDTSCDGRGKSTRXXXXXXXXXXXXXXXXXXXXXXXXXXXXXXXXPMEIRPMKTSDSHLVRXXXXXXXXXXXXXXXXXXXXXXXXXXXXXXGPKQMLVGGMVLLGXXXXGQVTLLDLLELVVAVGLHFHEXXXXXXXXXXXXXXSFSIRPGLLMGFGXXXXXXXXXXXXMAFGAAMVEIAXXXXXXXXXXXXXXXXXXXXXXXAISSRKASNMILPLMALLTPVTMHEVRMATMLLCTVVIVGVLYQNSKDTSMQXXXXXXXXXXXXXXXXXXXXXXXXXXXXXXXXXXXXXXXXXXXXXXXXXXXXXXXXXXXXXXXXXXXXXXXXXXXXXXXXXXXXXLELKKLGEISWEEXXXXXXXXXXXXXXXXXXXXXXXXXXXXXXXXXXXXXXXXXXXXXXXXXXXXXVLGGWLFHVRRARRSGDVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQLIAAAPGKNVVNVQXXXXXXXXXXXXXXXXXXXXXXXXXXXXXXXXXXXXXXXXXXXXXXXXXXXXXXXXXXXXLKEEGKEELQEISTXXKKGMTTILDYHPGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSRELVRGCDLPVWLAWXXXXXXXXXXXXXXXXXXPDEHEILNDSGXXXKCRTPGGAKRALRPRWCDEXXXXXXXXXXXXXXXAEGRRGAAEILVVLSELPDXXXXXXXXXXXXXXXXXXXXXXXXXXXXXXXXXXXXXXXXXXXXXXXXXXXXXXXXXXXXXXXXXXXXXXXXXXXXXXXXXXXGAKPTHISYIMXXXXXXXXXIIPEPGQQRSXXXXXXXXXIIGILTLLSIVAANELGXXEKTKEDFFGRRNXXIPSGASPWSWPDLXXXXXXXXXXXXXXXXXXXXXXXXXXXXXXXXXXXXXXXXXXXXXXXXXXXXXXXXMNISVIMLLISGWNSXXXXPLLCGIGCAMLHWTLILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMYNLWKMKTERRGTANGKTLGEVXXXXXNLLDKQQFEMYKRTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVTFKDKTDIHRLEPLKCETLLCDIGESSPSSITEGERTLRVLETIEKWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIEERVERIKNEYAATWFYDNDNPXXXXXXXXXXXXXXXXXXXXXXXXXIKLLTYPWDKIEXXXXXXXXXXXXXXXXXXXXXXXXXXXXXXXXXXXXXXXXXXXXLFRHLAREKKPRLCTXXXXXXXXXXXXAIGAFLEEQEQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLSAKEGGGFYADXXXXXXXXXXXXXXXXEQEILSYMSSHHKKLAQAVXXXXXXXXXXXXXXXXXXXXXXXXXXXXXXXXXXXXXXXXXXXXXXXXXXXXXXXAEAENVIHHQHVQECGENXLVRLETWLIEHGCDRLSRMAVNGDDCVVKPVDDRFGLAXXXXXXXXXXXXXXXXXXPSKEWTDWENVPFCSHRFHELVLKDGRKIVVXXXXXXXXXXXXXXXXXXXXXXXXXXXXXXXXXXXXXXXXXXXXXXXXXXXXXXXXXXXXXXXXXXXXXXXXXRGEWMTTEDRLEVWNRVWIXNNPHMKDKTTVKEWRDVPYXXXXXXXXXXXXXXXXXXXXXXXXXXXXXXXIRNLIGQEKYTDXXXXXXXXXXXXXXXXXXXX

SEQ ID NO: 265811 - protein, 3412 aa, Yellow fever virus
  MOD_RES (1)..(106): Any amino acid
  MOD_RES (117)..(118): Any amino acid
  MOD_RES (129)..(136): Any amino acid
  MOD_RES (156)..(257): Any amino acid
  MOD_RES (268)..(430): Any amino acid
  MOD_RES (446)..(1066): Any amino acid
  MOD_RES (1077)..(1183): Any amino acid
  MOD_RES (1194)..(1208): Any amino acid
  MOD_RES (1219)..(1267): Any amino acid
  MOD_RES (1280)..(1287): Any amino acid
  MOD_RES (1316)..(1471): Any amino acid
  MOD_RES (1486)..(2068): Any amino acid
  MOD_RES (2082)..(2105): Any amino acid
  MOD_RES (2121)..(2264): Any amino acid
  MOD_RES (2275)..(2276): Any amino acid
  MOD_RES (2288)..(2368): Any amino acid
  MOD_RES (2380)..(2634): Any amino acid
  MOD_RES (2654)..(2659): Any amino acid
  MOD_RES (2679)..(2792): Any amino acid
  MOD_RES (2807)..(3134): Any amino acid
  MOD_RES (3150)..(3150): Any amino acid
  MOD_RES (3177)..(3312): Any amino acid
  MOD_RES (3328)..(3333): Any amino acid
  MOD_RES (3350)..(3412): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAVQFLILGMLXXTGGVTLMRKNXXXXXXXXAEDLGKTFSIGTGNCTTNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAIAYLVGNNTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAKQENWKTDIKTLKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGNCDGRGKSAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTVAVGLHFHXXXXXXXXXXXXXXXSFSIRPGLLIXXXXXXXXXXXXXXXXXXXXXXXXXXXXXXXXXXXXXXXXXXXXXXXXXAISSRKASNAVLXXXXXXXXMTMYEVRLAAMLLCAVVIIGVLYQNSKDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGGWILHIKGARRSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKCRSPGGAKRALRXXXXXXXXXXXXXXXXXXXXXXXXRRGAADVLVVLSELPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTKEDFFGKRDXXTSSSASPWSWPXXXXXXXXXXXXXXXXXXXXXXXXXXXXXXXXXXXXXXXXXXXXXXXXXXXXXXXXXXXXXXXXXXXXXXXXXXXXXXXXXGIGCATLHWSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDKTDVHRLESVKCDTLLCDXXXXXXSSATEGERTLRVLETVEKWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKTEYAATWFYDNDNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMVINHHHVQDCDDSXLERLEAWLIEHGCDRLNRMAVNGDDCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEWMTTQDMLDVWNRVXXXXXXHMTDKTTIKEWRDVPYXXXXXXXXXXXXXXXXXXXXXXXXXXXXXXXXXXXXXXXXXXXXXXXXXXXXXXXXXXXXXXX

SEQ ID NO: 265812 - protein, 3412 aa, Yellow fever virus
  MOD_RES (2274)..(2276): Any amino acid
  MOD_RES (3150)..(3150): Any amino acid
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTAGEIHAVPFGLVSMMIAMEVVLRKRQGPKQMLVGGVVLLGAMLVGQVTLLDLLKLTVAVGLHFHEMNNGGDAMYMALIAAFSIRPGLLIGFGLRTLWSPRERLVLTLGAAMVEIALGGVMGGLWKYLNAVSLCILTINAVASRKASNTILPLMALLTPVTMAEVRLAAMFFCAVVIIGVLHQNFKDTSMQKTIPLVALTLTSYLGLTQPFLGLCAFLATRIFGRRSIPVNEALAAAGLVGVLAGLAFQEMENFLGPIAVGGLLMMLVSVAGRVDGLELKKLGEVSWEEEAEISGSSARYDVALSEQGEFKLLSEEKVPWDQVVMTSLALVGAALHPFALLLVLAGWLFHVRGARRSGDVLWDIPTPKIIEECEHLEDGIYGIFQSTFLGASQRGVGVAQGGVFHTMWHVTRGAFLVRNGKKLIPSWASVKEDLVAYGGSWKLEGRWDGEEEVQLIAAVPGKNVVNVQTKPSLFKVRNGGEIGAVALDYPSGTSGSPIVNRNGEVIGLYGNGILVGDNSFVSAISQTEVKEEGKEELQEIPTMLKKGMTTILDFHPGAGKTRRFLPQILAECARRRLRTLVLAPTRVVLSEMKEAFHGLDVKFHTQAFSAHGSGREVIDAMCHATLTYRMLEPTRVVNWEVIIMDEAHFLDPASIAARGWAAHRARANESATILMTATPPGTSDEFPHSNGEIEDVQTDIPSEPWNTGHDWILADKRPTAWFLPSIRAANVMAASLRKAGKSVVVLNRKTFEREYPTIKQKKPDFILATDIAEMGANLCVERVLDCRTAFKPVLVDEGRKVAIKGPLRISASSAAQRRGRIGRNPNRDGDSYYYSEPTSENNAHHVCWLEASMLLDNMEVRGGMVAPLYGVEGTKTPVSPGEMRLRDDQRKVFRELVRNCDLPVWLSWQVAKAGLKTNDRKWCFEGPEEHEILNDSGETVKCRAPGGAKKPLRPRWCDERVSSDQSALSEFIKFAEGRRGAAEVLVVLSELPDFLAKKGGEAMDTISVFLHSEEGSRAYRNALSMMPEAMTIVMLFILAGLLTSGMVIFFMSPKGISRMSMAMGTMAGCGYLMFLGGVKPTHISYIMLIFFVLMVVVIPEPGQQRSIQDNQVAYLIIGILTLVSAVAANELGMLEKTKEDLFGKKXXXIPSSASPWSWPDLDLKPGAAWTVYVGIVTMLSPMLHHWIKVEYGNLSLSGIAQSASVLSFMDKGIPFMKMNISVIMLLVSGWNSITVMPLLCGIGCAMLHWSLILPGIKAQQSKLAQRRVFHGVAKNPVVDGNPTVDIEEAPEMPALYEKKLALYLLLALSLASVAMCRTPFSLAEGIVLASAALGPLIEGNTSLLWNGPMAVSMTGVMRGNHYAFVGVMYNLWKMKTGRRGSANGKTLGEVWKRELNLLDKQQFELYKRTDIVEVDRDTARRHLAEGKVDTGVAVSRGTAKLRWFHERGYVKLEGRVIDLGCGRGGWCYYAAAQKEVSGVKGFTLGRDGHEKPMNVQSLGWNIITFKDKTDIHRLEPVKCDTLLCDIGESSSSSVTEGERTVRVLDTVEKWLACGVDNFCVKVLAPYMPDVLEKLELLQRRFGGTVIRNPLSRNSTHEMYYVSGARSNVTFTVNQTSRLLMRRMRRPTGKVTLEADVILPIGTRSVETDKGPLDKEAIEERVERIKSEYMTSWFYDNDNPYRTWHYCGSYVTKTSGSAASMVNGVIKILTYPWDRIEEVTRMAMTDTTPFGQQRVFKEKVDTRAKDPPAGTRKIMKVVNRWLFRHLAREKNPRLCTKEEFIAKVRSHAAIGAYLEEQEQWKTANEAVQDPKFWELVDEERKLHQQGRCRTCVYNMMGKREKKLSEFGKAKGSRAIWYMWLGARYLEFEALGFLNEDHWASRENSGGGVEGIGLQYLGYVIRDLAAMDGGGFYADDTAGWDTRITEADLDDEQEILNYMSPHHKKLAQAVMEMTYKNKVVKVLRPAPGGKAYMDVISRRDQRGSGQVVTYALNTITNLKVQLIRMAEAEMVIHHQHVQDCDESXLTRLEAWLTEHGCNRLKRMAVSGDDCVVRPIDDRFGLALSHLNAMSKVRKDISEWQPSKGWNDWENVPFCSHHFHELQLKDGRRIVVPCREQDELIGRGRVSPGNGWMIKETACLSKAYANMWSLMYFHKRDMRLLSLAVSSAVPTSWVPQGRTTWSIHGKGEWMTTEDMLEVWNRVWITNNPHMQDKTMVKKWRDVPYLTKRQDKLCGSLIGMTNRATWASHIHLVIHRIRTLIGQEKYTDYLTVMDRYSVDADLQLGELI

SEQ ID NO: 265813 - protein, 3412 aa, Yellow fever virus
  MOD_RES (1)..(9): Any amino acid
  MOD_RES (159)..(184): Any amino acid
  MOD_RES (217)..(220): Any amino acid
  MOD_RES (278)..(280): Any amino acid
  MOD_RES (383)..(414): Any amino acid
  MOD_RES (497)..(498): Any amino acid
  MOD_RES (564)..(573): Any amino acid
  MOD_RES (640)..(652): Any amino acid
  MOD_RES (676)..(681): Any amino acid
  MOD_RES (885)..(888): Any amino acid
  MOD_RES (912)..(927): Any amino acid
  MOD_RES (971)..(980): Any amino acid
  MOD_RES (1520)..(1534): Any amino acid
  MOD_RES (1616)..(1619): Any amino acid
  MOD_RES (1645)..(1646): Any amino acid
  MOD_RES (1693)..(1714): Any amino acid
  MOD_RES (1775)..(1823): Any amino acid
  MOD_RES (1849)..(1859): Any amino acid
  MOD_RES (1938)..(1958): Any amino acid
  MOD_RES (1980)..(1988): Any amino acid
  MOD_RES (2148)..(2150): Any amino acid
  MOD_RES (2274)..(2276): Any amino acid
  MOD_RES (2293)..(2295): Any amino acid
  MOD_RES (2317)..(2330): Any amino acid
  MOD_RES (2472)..(2478): Any amino acid
  MOD_RES (2557)..(2574): Any amino acid
  MOD_RES (2596)..(2599): Any amino acid
  MOD_RES (2724)..(2725): Any amino acid
  MOD_RES (2747)..(2751): Any amino acid
  MOD_RES (2853)..(2872): Any amino acid
  MOD_RES (2968)..(2980): Any amino acid
  MOD_RES (3002)..(3007): Any amino acid
  MOD_RES (3049)..(3051): Any amino acid
  MOD_RES (3122)..(3125): Any amino acid
  MOD_RES (3150)..(3150): Any amino acid
  MOD_RES (3198)..(3199): Any amino acid
  MOD_RES (3252)..(3277): Any amino acid
  MOD_RES (3354)..(3362): Any amino acid
XXXXXXXXXTLGVNMVRRGARSLSNKIKQKTKQIGNRPGLSRGVQGFISFFLFNILTGKKLTTHLKRLWRMLDPRQGLAALRKVKRVVAGLMRGLSSRKRRSNEMAMMPLLILSMVILAGGVTLMRKNRWLLLNVTAEDLGKTFSIGAGNCTTNILEAXXXXXXXXXXXXXXXXXXXXXXXXXXWCYGVENVRVAYGRCDAVGRSKRSRRAIDLPTXXXXGLKTRQEKWMAGRMGERQLQKIERWLVRNPFFAVTALAIAYLVGNNKTQRVVIALLVXXXGPAYSAHCIGVADRDFIEGVHGGTWVSASLEQGKCVTVMAPDKPSLDISLETVAIDGPAEARKVCYSAVLTHVKIDDKCPSTGEAHLAEENDGDNACKRTYSXXXXXXXXXXXXXXXXXXXXXXXXXXXXXXXXVDQTKIQYVIRARLHVGAKQENWTTSIKTLKFDALSGSQEAEFTGYGKVTLECRVQTAVDFGNSYIAEMEKDSWIVDRQWAQXXTLPWQSGSGGIWRGMHHLVEFEPPHAATIRVLALGDQEGSLKTALTGAMRVTKDENDNNLYKLHGXXXXXXXXXXALTLKGTSYKMCTDKMSFVKNPTDTDHGTVVMQVKVPKGAPCKIPVIVADDLTAAVNKGILVTVNPXXXXXXXXXXXXXNPPFGDSYIIVGTGDSRLTYQWHXXXXXXGKLFTQTMKGAERLAVMGDAAWDFSSAGGLFTSIGKGSHTVFGSAFQGLFGGLSWITKVIIGAVLIWVGFNTRNMTMSMSMIMVGVIMMFLSLGVGADQGCAVNFAKRELKCGDGIFVFRDSDDWLTKYSYYPEDPVKLASIIKASHEEGKCGLNSVDSLDHEMWRSRADEINAILEENEVDISVVVQDPKNIYQRGTHPFSRXXXXLQYGWKTWGKNLIFSPGRKNGSFXXXXXXXXXXXXXXXXWNSFQIEEFGMGVFTTRVFMDAVFDYSVDCDGAILGAAVNGKKXXXXXXXXXXGSHEVNGTWMIHTLETLDYKECEWPPTHTIGTSVEESDMFMPRSIGGPVSSHNRIPGYKVQTNGPWMQVPLEVRREPCPGTSVVVDSNCDGRGKSTRSTTDSGKIIPEWCCRSCTMPPVSFHGNDGCWYPMEIRPMKTSDSHLVRSWVTAGEVHAVPFGLVSMMIALEVVLRKRQGPKQMLVGGIILLGAMLVGQVTVLDLVKLIVAVGLHFHEINNGGDAMYMALIAAFSVRPGLLMGFGLRTLWSPRERLVLAFGAAMVEIALGGMMGGLWQYLNAVSLCVLTINAVSSRKASNAVLPLMALLTPVTMAEVRLATMLFCTVVIIGVLHQNSKDTSMQKTIPIVALTLTSYMGLTQPFLGLCAYMSTQVFGRRSIPVNEALAATGLVGVLAGLAFQDMENFLGPIAVGGILMMLVSVAGKVDGLELRKLGEVAWEEEAEISGSSSRYDVALNEQGEFKLLSEDKVPWDQIVMTSLALVGAAIHPFALLLVLAGWLLHIKRARRSGDVLWDIPTPKVIEECEYLEDGISGIFQSTFLGAXXXXXXXXXXXXXXXMWHVTRGAFLLRNGKKLVPSWASVKEDLVAYGGSWKLDGKWDGEEEVQLIAAVPGKSVVNVQTKPSLFRVKNGGEIGAVALXXXXGTSGSPIVNRSGEVVGLYGNGILVGXXSFVSAISQTEVKEESKEELREIPTMLKKGMTTVLDYHPGAGKTRRFXXXXXXXXXXXXXXXXXXXXXXVVLSEMKEAFQGLDVKFHTQAFSAHGSGKEVIDVMCHATLTYRMLEPTRIVNWEVIIMDEXXXXXXXXXXXXXXXXXXXXXXXXXXXXXXXXXXXXXXXXXXXXXXXXXVQTDIPSEPWTSGHEWILADKRPTAXXXXXXXXXXXMAASLRKAGKNVVVLNRKTFEKEYPTIKQKRPDFILATDIAEMGANLCVERVLDCRTAYKPVLVDEGKKVAIKGPLRIXXXXXXXXXXXXXXXXXXXXXSYYYSEPTSEDNAHHVCWLEAXXXXXXXXXRGGMVAPLYGIEGIKTPVSPGEMRLRDDQRRVFRELVRGCDQPVWLSWQVAKPGLKTNDRKWCFDGPEEHEILNDNGETVKCRSPGGAKKALRPRWCDERVSSDQSALADFIKFAEGRRGAAEMLVVLTELPDFLAKKGGEAMDTISVLLHSEEGSRAYXXXLSMMPEAMTIVMLFLLAGLLTSGMVIFFMSPKGMSRMSMAMGTMAGSGYLMFLGGVKPTHISYVMLIFFVLMVVIIPEPGQQRSIQDNQVAYLIIGILTLVSVVAANELGMLEKTKEDFFGKRXXXTSGGTIPWSWPDLDLKXXXAWTVYVGIVTILSPMLHHWIKXXXXXXXXXXXXXXASVLSFMDKGIPFMKMNISVIILLVSGWNSITVIPLLCGVGGAMLHWTLILPGIKAQQSKLAQKRVFHGVAKNPVVDGNPTADIEEAPEMPVLYEKKLALYLLLALSLMSVAMCRTPFSLAEGIVLASAASGPLIEGNTSLXXXXXXXVSMTGVMRGNYYAFVGVMYNLWKMETGRRGRASGKTLGEVWKRELNLLDKRQFELYKRTDITEVDRDMARRHLAEGKVXXXXXXXXXXXXXXXXXXRGYVKLEGRVTDLGCGRGGWCXXXXAQKEVSGVKGYTLGREGHEKPMNVQSLGWNIVTFKDKTDIHHLEPAKCETLLCDIGESSSSSVTEGERTMRVLETIEKWLACGVDNFCIKVLAPYMPDVIEKLELLQRRFGGTIIRNPLSRNSTXXMYYVSGARSNITFTVNQTSRLXXXXXRRPTGKVTLEPDVTLPIGTRSVETDKGPLDRDAIEERVERIKSEYMTTWFHDNDNPYRTWHYCGSYITKTSGSAASMINGVIKILTFPWDKIEEVTRMAMTXXXXXXXXXXXXXXXXXXXXDPPAGTRKIMRVVNRWLFRHLAREKSPRLCTKEEFIAKVRSHAAVGAFLEEQDQWKTANEAVQDPKFWEMVDAERKLHQQGRCQSCVYNMMGKREXXXXXXXXXXXXXAIWYMWLGARFLEFEALGFLNXXXXXXRENSGGGVEGIGLQYLGYVIKDLSTKEGGGLYADDTAGWDTXXXEADLDDEQEIMSYMNAEQRKLAWAIMEMTYKNKVVKVLRPAPGGKAFMDIISRRDQRGSRQVVTYALNTIXXXXVQLIRMAEAEMVINHQHVNECDESXLARLEAWLTEHGCDRLRRMAVSGDDCVVRPVDDRFGMALSHLNAMSKXXKDISEWQPSKGWTDWESVPFCSHHFHELHLKDGRKVVVPCRDQDELIGRGRVXXXXXXXXXXXXXXXXXXXXXXXXXXFHKRDMRLLSFAVSSAVPTAWVPSGRTTWSVHGKGEWMTTEDMLDVWNRVWVTNNPHMQDKTMVKEWRDVPYLTKRXXXXXXXXXGMTNRATWASHIHLVIHRIRTLVGQEKFTDYLTVMDRYSVDADLQPGELI

SEQ ID NO: 265814 - protein, 3412 aa, Yellow fever virus
  MOD_RES (1)..(38): Any amino acid
  MOD_RES (130)..(135): Any amino acid
  MOD_RES (157)..(187): Any amino acid
  MOD_RES (206)..(243): Any amino acid
  MOD_RES (278)..(302): Any amino acid
  MOD_RES (320)..(326): Any amino acid
  MOD_RES (358)..(416): Any amino acid
  MOD_RES (474)..(475): Any amino acid
  MOD_RES (496)..(501): Any amino acid
  MOD_RES (520)..(523): Any amino acid
  MOD_RES (536)..(588): Any amino acid
  MOD_RES (601)..(605): Any amino acid
  MOD_RES (621)..(654): Any amino acid
  MOD_RES (674)..(690): Any amino acid
  MOD_RES (723)..(731): Any amino acid
  MOD_RES (755)..(776): Any amino acid
  MOD_RES (795)..(817): Any amino acid
  MOD_RES (839)..(855): Any amino acid
  MOD_RES (877)..(890): Any amino acid
  MOD_RES (910)..(939): Any amino acid
  MOD_RES (961)..(980): Any amino acid
  MOD_RES (1007)..(1046): Any amino acid
  MOD_RES (1087)..(1107): Any amino acid
  MOD_RES (1129)..(1142): Any amino acid
  MOD_RES (1197)..(1201): Any amino acid
  MOD_RES (1259)..(1266): Any amino acid
  MOD_RES (1324)..(1339): Any amino acid
  MOD_RES (1361)..(1390): Any amino acid
  MOD_RES (1437)..(1455): Any amino acid
  MOD_RES (1491)..(1492): Any amino acid
  MOD_RES (1514)..(1535): Any amino acid
  MOD_RES (1557)..(1563): Any amino acid
  MOD_RES (1612)..(1623): Any amino acid
  MOD_RES (1641)..(1650): Any amino acid
  MOD_RES (1690)..(1737): Any amino acid
  MOD_RES (1775)..(1824): Any amino acid
  MOD_RES (1846)..(1879): Any amino acid
  MOD_RES (1892)..(1907): Any amino acid
  MOD_RES (1929)..(1991): Any amino acid
  MOD_RES (2010)..(2010): Any amino acid
  MOD_RES (2089)..(2101): Any amino acid
  MOD_RES (2126)..(2154): Any amino acid
  MOD_RES (2218)..(2223): Any amino acid
  MOD_RES (2274)..(2276): Any amino acid
  MOD_RES (2292)..(2340): Any amino acid
  MOD_RES (2423)..(2428): Any amino acid
  MOD_RES (2468)..(2485): Any amino acid
  MOD_RES (2551)..(2574): Any amino acid
  MOD_RES (2596)..(2604): Any amino acid
  MOD_RES (2684)..(2685): Any amino acid
  MOD_RES (2707)..(2754): Any amino acid
  MOD_RES (2810)..(2824): Any amino acid
  MOD_RES (2849)..(2887): Any amino acid
  MOD_RES (2909)..(2909): Any amino acid
  MOD_RES (2931)..(2937): Any amino acid
  MOD_RES (2959)..(3017): Any amino acid
  MOD_RES (3045)..(3055): Any amino acid
  MOD_RES (3085)..(3087): Any amino acid
  MOD_RES (3112)..(3128): Any amino acid
  MOD_RES (3150)..(3150): Any amino acid
  MOD_RES (3192)..(3201): Any amino acid
  MOD_RES (3246)..(3285): Any amino acid
  MOD_RES (3352)..(3372): Any amino acid
  MOD_RES (3396)..(3412): Any amino acid
XXXXXXXXXXXXXXXXXXXXXXXXXXXXXXXXXXXXXXGPSRGVQGFISFFSFNILTGKKLTAQLKKLWKMLDPRQGLTVLRKVKRVVASLMRGLSSRKRRSHDALAVQLLILGMILMTGGVTLMRKNRXXXXXXTSEDLGKTFSLGTGNCTTNILXXXXXXXXXXXXXXXXXXXXXXXXXXXXXXXGVENVRVTYGKCDSAGRSXXXXXXXXXXXXXXXXXXXXXXXXXXXXXXXXXXXXXXRWLVRNPFFAITALAIAYLVGNNTTQRVVIALLVXXXXXXXXXXXXXXXXXXXXXXXXXGTWVSATLEQGKCVTVMXXXXXXXDISLETVAIDRPAEARKVCYNAVLTHVKIDDXXXXXXXXXXXXXXXXXXXXXXXXXXXXXXXXXXXXXXXXXXXXXXXXXXXXXXXXXXXQTKIQYVIKAQLHVGAKQENWNTDIKTLKFDALSGSQEAEFTGYGKATLECRVQTAVXXGNSYIAEMEKDSWIVDRQWAXXXXXXWQSGSGGVWRGMHHLVEFXXXXAVTIRVLALGNQXXXXXXXXXXXXXXXXXXXXXXXXXXXXXXXXXXXXXXXXXXXXXXXXXXXXXMSFVKNPTDTDHXXXXXQVKVPKGAPCRIPVIXXXXXXXXXXXXXXXXXXXXXXXXXXXXXXXXXXPFGDSYIIIGTGDSRLTYQXXXXXXXXXXXXXXXXXGVERLAVMGDVAWDFSSAGGFLTSVGKGIHTVXXXXXXXXXGGLNWITKVIMGVVLIWVGINTRXXXXXXXXXXXXXXXXXXXXXXGADQGCAINFAKRELKCGXXXXXXXXXXXXXXXXXXXXXXXVKLASIIKASYEEGKCGLNSVXXXXXXXXXXXXXXXXXIFEENEVDISIVVQDPKNIYQXXXXXXXXXXXXXXYGWKTWGKSLVFSPGRKNGXXXXXXXXXXXXXXXXXXXXXXXXXXXXXXVFTTRVFMDATFDYSVDCDGAXXXXXXXXXXXXXXXXXXXXGSHEVNGTWMMHTLEALDYKECEWPPXXXXXXXXXXXXXXXXXXXXXXXXXXXXXXXXXXXXXXXXMQVPLEVRREVCPGTSVVLDTGCDGRGKSARSTTDSGKIIXXXXXXXXXXXXXXXXXXXXXWYPMEIRPRKAHESHLVRSWVXXXXXXXXXXXXXXMMIAMEVVLRRRQGPKQMLVGGMVLLGAMLVGQVTMLDLVKLVMAVGLHFHEMNXXXXXMYMALIASFSIRPGLLVGFGLRTLWSPRERLVMAFGAAMVEVALGGMMGGLWQYLNAXXXXXXXXNAISSRKASNAILPLMALLTPVTMAEVRLAAMLFCTVVIIGVLHQNAKDTSMQKTIPXXXXXXXXXXXXXXXXLGLCAFLATRLFGRRSIPVNEXXXXXXXXXXXXXXXXXXXXXXXXXXXXXXILMMLVSVAGRVDGLELKKLGEISWEEEAEISGSSARYDVALNEQGXXXXXXXXXXXXXXXXXXXLALVGAAIHPSALLLVLGGWLFHVRRARRSGDVLWXXPTPKVIEECEHLEDGISGIFQXXXXXXXXXXXXXXXXXXXXXXWHVTRGAFLVWNGKKLIPSWAXXXXXXXAYGGSWKLDGRWDGEEEVQLIAAAPGKAVVNVQTKPSVFKVRNGGEIGXXXXXXXXXXXXSPIVNRNGEVVGLYGNGXXXXXXXXXXAISQTEVKEEGKEELQEIPTMLKKGKTTILDYHPGAGKTXXXXXXXXXXXXXXXXXXXXXXXXXXXXXXXXXXXXXXXXXXXXXXXXAHGSGREVIDVMCHATLTYRMLEPTRAVNWEVIIMDEXXXXXXXXXXXXXXXXXXXXXXXXXXXXXXXXXXXXXXXXXXXXXXXXXXQTDIPSEPWTAGHEWILADKRXXXXXXXXXXXXXXXXXXXXXXXXXXXXXXXXXXEKEYPTIKQKKPXXXXXXXXXXXXXXXXVDRVLDCRTAYKPVLVDEGKKXXXXXXXXXXXXXXXXXXXXXXXXXXXXXXXXXXXXXXXXXXXXXXXXXXXXXXXXXXXXXXXMVAPLYGVEGIKTPVSPGXMRLRDDQRRVSRELVRNCDLPVWLAWQVAKAGLKTNDRKWCFEGPKEHEILNDSGETVKCRSPGGAKRPLRPRWCDERXXXXXXXXXXXXXFAEGRRGAAEMLVILTELPDFLAKXXXXXXXXXXXXXXXXXXXXXXXXXXXXXPEAMTIAMLFLLAGLLTSGAVIFFMSPKGISRMSMAKGTMAGCGYLMFLGGVEPTHISYIMLIXXXXXXVVIPEPGQQRTIQDNQVAFLIIGILTLLSIVAANELGMLEKTKEDFFGRRXXXIPSGAIPWSWPDLDLXXXXXXXXXXXXXXXXXXXXXXXXXXXXXXXXXXXXXXXXXXXXXXXXXVPFMKMNISVVMLLISGWNSITVMPLLCGIGCATLHWSLILPGIKAQQSKLAQRRVFHGVAENPVVDGNPTVDIEEAPEMPVXXXXXXALYLLLALSLSSVAMCRTPFSLAEGIVLSSAALGPLIEGXXXXXXXXXXXXXXXXXXRGNYYAFVGVMYNLWKMKTARRGSASGKTLGEVWKRELNLLDRQQFEMYKRTDIIEVDRDMARRHXXXXXXXXXXXXXXXXXXXXXXXXRGYVKLEGRVMDLGCGRGGWCXXXXXXXXXSGVKGFTLGREGHEKPMNVRSLGWNIITFKDKTDIHRLEPLKCETLLCDIGESSPSSVTEGERTLRVLETVEKWLACGVXXFCVKVLAPYMRDVLEKLELLQXXXXXXXXXXXXXXXXXXXXXXXXXXXXXXXXXXXXXXXXXXXXXXXXTGKVTLEADVTLPIGTRSVETDKGPLNREAIKERVERIKTEYAATWFHDNDNPYRXXXXXXXXXXXXXXXAASMVNGVIKLLTYPWDKIEEVTRXXXXXXXXXXXXXXXXXXXXXXXXXXXXXXXXXXXXXXXWLFRHLSREKKPRLCTKEEFIXKVRSHAAIGAYLEEQDQWKTAXXXXXXXKFWELVDEERRLHQQGRCRTCXXXXXXXXXXXXXXXXXXXXXXXXXXXXXXXXXXXXXXXXXXXXXXXXXXXXXXXXXXXTGLQYLGYVIRDLSAMDGGGLYADDTAXXXXXXXXXXXDDEQEIMSYMSSEQRKLAWAIMEMTYKNKXXXVLRPTPGGKAYMDVISRRDQRGSRXXXXXXXXXXXXXXXXXIRMAEAENVINHQHVNECDEGXLARLDAWLAENGCDRLARMAVNGDDCVVRPIDDRFGMALSHXXXXXXXXXXISEWQPSKGWTDWENVPFCSHHFHELVLKDGRKIVVPCRDQDELXXXXXXXXXXXXXXXXXXXXXXXXXXXXXXXXXXXXXXXXLSFAVSSAVPMAWVPSGRTTWSVHGRGEWMTTEDMLGVWNRVWVLNNPHMQDKTVIKEWRDVPYLTXXXXXXXXXXXXXXXXXXXXXNIHLVIHRIRTLIGQEKFTDYLTXXXXXXXXXXXXXXXXX

SEQ ID NO: 265815 - protein, 3412 aa, Yellow fever virus
  MOD_RES (1)..(53): Any amino acid
  MOD_RES (81)..(92): Any amino acid
  MOD_RES (130)..(135): Any amino acid
  MOD_RES (157)..(256): Any amino acid
  MOD_RES (276)..(328): Any amino acid
  MOD_RES (350)..(427): Any amino acid
  MOD_RES (469)..(690): Any amino acid
  MOD_RES (712)..(733): Any amino acid
  MOD_RES (753)..(985): Any amino acid
  MOD_RES (1002)..(1046): Any amino acid
  MOD_RES (1079)..(1108): Any amino acid
  MOD_RES (1127)..(1154): Any amino acid
  MOD_RES (1171)..(1172): Any amino acid
  MOD_RES (1196)..(1207): Any amino acid
  MOD_RES (1223)..(1232): Any amino acid
  MOD_RES (1246)..(1266): Any amino acid
  MOD_RES (1321)..(1403): Any amino acid
  MOD_RES (1419)..(1462): Any amino acid
  MOD_RES (1490)..(1580): Any amino acid
  MOD_RES (1602)..(1655): Any amino acid
  MOD_RES (1687)..(2019): Any amino acid
  MOD_RES (2038)..(2053): Any amino acid
  MOD_RES (2067)..(2067): Any amino acid
  MOD_RES (2089)..(2101): Any amino acid
  MOD_RES (2123)..(2196): Any amino acid
  MOD_RES (2217)..(2223): Any amino acid
  MOD_RES (2236)..(2242): Any amino acid
  MOD_RES (2274)..(2276): Any amino acid
  MOD_RES (2291)..(2344): Any amino acid
  MOD_RES (2362)..(2363): Any amino acid
  MOD_RES (2383)..(2391): Any amino acid
  MOD_RES (2403)..(2450): Any amino acid
  MOD_RES (2462)..(2494): Any amino acid
  MOD_RES (2520)..(2522): Any amino acid
  MOD_RES (2539)..(2628): Any amino acid
  MOD_RES (2680)..(2782): Any amino acid
  MOD_RES (2809)..(2831): Any amino acid
  MOD_RES (2846)..(2887): Any amino acid
  MOD_RES (2905)..(2914): Any amino acid
  MOD_RES (2928)..(3027): Any amino acid
  MOD_RES (3043)..(3056): Any amino acid
  MOD_RES (3078)..(3130): Any amino acid
  MOD_RES (3150)..(3150): Any amino acid
  MOD_RES (3190)..(3205): Any amino acid
  MOD_RES (3239)..(3307): Any amino acid
  MOD_RES (3351)..(3379): Any amino acid
  MOD_RES (3394)..(3412): Any amino acid
XXXXXXXXXXXXXXXXXXXXXXXXXXXXXXXXXXXXXXXXXXXXXXXXXXXXXNILTGKKITAHLKKLWRMLDPRQGLTVXXXXXXXXXXXXIGLSSRKRRSSEMTLFPLLLLGLLALSGGVTLVRKNRXXXXXXTSEDLGKTFSVGAGNCTTNILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAIAYLVGNNTTQRVVIALXXXXXXXXXXXXXXXXXXXXXXXXXXXXXXXXXXXXXXXXXXXXXXXXXXXXXSLQTVAIDGPVEARKVCYNAVXXXXXXXXXXXXXXXXXXXXXXXXXXXXXXXXXXXXXXXXXXXXXXXXXXXXXXXXXXXXXXXXXXXXXXXXXXXXXXLHVGAKQENWKTDIKTLKFDVLSGSQEVEFTGYGKVTLECQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGVERLAVMGDAAWDFSSAGGLXXXXXXXXXXXXXXXXXXXXXXLNWITKVIMGAVLIWVGFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNGTWMVHTLETLDYKEXXXXXXXXXXXXXXXXXXXXXXXXXXXXXXXXXXXXXXXXXXXXXMQVPLEVKREPCPGTSVVVDGSCDGRGKSTRSXXXXXXXXXXXXXXXXXXXXXXXXXXXXXXYPMEIRPMKTSDSHLVRSXXXXXXXXXXXXXXXXXXXXXXXXXXXXQGPKQVLVGGVVLLGAXXVGQVTLLDLLEFIVAVGLHFHEMXXXXXXXXXXXXASFSIRPGLLVGFGLXXXXXXXXXXVMAFGAAMVEIALXXXXXXXXXXXXXXXXXXXXXNAISSRKASNMILPLMALMTPMTMHEVRMATMLFCTVVIVGVLYQNSKDTSMQKXXXXXXXXXXXXXXXXXXXXXXXXXXXXXXXXXXXXXXXXXXXXXXXXXXXXXXXXXXXXXXXXXXXXXXXXXXXXXXXXXXXGLELKKLGEVAWEEEXXXXXXXXXXXXXXXXXXXXXXXXXXXXXXXXXXXXXXXXXXXXIHPFALLLVLAGWVFHVRRARRSGDVLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVQLIAAVPGKAVVNVQTKPSVXXXXXXXXXXXXXXXXXXXXXXXXXXXXXXXXXXXXXXXXXXXXXXXXXXXXXXELKEEGKEELQEISTMLKKGMTTILDYHPGAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVFRELVRGCDLPVWLAWQXXXXXXXXXXXXXXXXGPDEHEILNDSGEXVKCRTPGGAKRALRPRWCDERXXXXXXXXXXXXXFAEGRRGAAEILVVLSELPDFXXXXXXXXXXXXXXXXXXXXXXXXXXXXXXXXXXXXXXXXXXXXXXXXXXXXXXXXXXXXXXXXXXXXXXXXXXCGYLMFLGGAKPTHISYIMLXXXXXXXVIIPEPGQQRSIXXXXXXXLIIGILTLLSIVAANELGMLERTKEDLFGKKXXXIPSGAIPWSWPDLDXXXXXXXXXXXXXXXXXXXXXXXXXXXXXXXXXXXXXXXXXXXXXXXXXXXXXXKMNISVIMLLISGWNSIXXIPLLCGIGCAMLHWTLILPXXXXXXXXXPQRRVFHGVAKXXXXXXXXXXXXXXXXXXXXXXXXXXXXXXXXXXXXXXXXXXXXXXXXDEGIVLASAALXXXXXXXXXXXXXXXXXXXXXXXXXXXXXXXXXVAYNLWKMKTERRGTANGKTLGEVWXXXLNLLDKQQFEMYKRTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNIVTFKDKTDVHRLESMKCDTLLCDIGESSSSSITEGERTLRVLETVEKWLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGAIEERVERIKTEYAATWFHDNDNPYXXXXXXXXXXXXXXXXXXXXXXXVIKILTYPWDKIEEXXXXXXXXXXXXXXXXXXXXXXXXXXXXXXXXXXXXXXXXXXWLFRHLAREKKPRLCTKXXXXXXXXXXAAIGAFLEEQEQWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRDLAAMDGGGLYADDXXXXXXXXXXXXXXDEQEILNYMSPEQRKLAWAIMXXXXXXXXXXXXXXXXXXXXXXXXXXXXXXXXXXXXXXXXXXXXXXXXXXXXXMAEAEMVIHHHHVQDCDDSXLVRLEAWLIEHGCDRLNRMAVSGDDCVVKPVDDRFGLALXXXXXXXXXXXXXXXXQPSKEWTDWENVPFCSHRFHELVLKDGRKIVVPXXXXXXXXXXXXXXXXXXXXXXXXXXXXXXXXXXXXXXXXXXXXXXXXXXXXXXXXXXXXXXXXXXXXXVHGKGEWMTTQDRLEVWNRVWILNNPHMKDKTTVKEWRDVPYLXXXXXXXXXXXXXXXXXXXXXXXXXXXXXRIRNLIGQEKYTDYXXXXXXXXXXXXXXXXXXX

SEQ ID NO: 265816 - protein, 3412 aa, Yellow fever virus
  MOD_RES (1)..(106): Any amino acid
  MOD_RES (118)..(118): Any amino acid
  MOD_RES (130)..(135): Any amino acid
  MOD_RES (157)..(256): Any amino acid
  MOD_RES (269)..(330): Any amino acid
  MOD_RES (348)..(429): Any amino acid
  MOD_RES (449)..(1065): Any amino acid
  MOD_RES (1078)..(1183): Any amino acid
  MOD_RES (1196)..(1207): Any amino acid
  MOD_RES (1220)..(1266): Any amino acid
  MOD_RES (1281)..(1286): Any amino acid
  MOD_RES (1317)..(1470): Any amino acid
  MOD_RES (1487)..(2067): Any amino acid
  MOD_RES (2083)..(2104): Any amino acid
  MOD_RES (2122)..(2276): Any amino acid
  MOD_RES (2289)..(2367): Any amino acid
  MOD_RES (2381)..(2630): Any amino acid
  MOD_RES (2655)..(2658): Any amino acid
  MOD_RES (2680)..(2791): Any amino acid
  MOD_RES (2808)..(3133): Any amino acid
  MOD_RES (3150)..(3150): Any amino acid
  MOD_RES (3178)..(3311): Any amino acid
  MOD_RES (3329)..(3332): Any amino acid
  MOD_RES (3351)..(3412): Any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTVQLLILGMILXGGGVTLVRKNRXXXXXXTAEDLGKTFSMGTGNCTTNILXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAIAYLVGNNKTXXXXXXXXXXXXXXXXXXXXXXXXXXXXXXXXXXXXXXXXXXXXXXXXXXXXXXXXXXXXXXETVAIDGPVEARKVCYNXXXXXXXXXXXXXXXXXXXXXXXXXXXXXXXXXXXXXXXXXXXXXXXXXXXXXXXXXXXXXXXXXXXXXXXXXXXXXXXXXXVGAKQEDWKTDIKTLKFDAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDTGCDGRGKSTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFTMAVGLHFHEMXXXXXXXXXXXXASFSIRPGLLMGXXXXXXXXXXXXXXXXXXXXXXXXXXXXXXXXXXXXXXXXXXXXXXXNAIASRKASNAILPXXXXXXPVTMYEVRMATMLLCAVVIVGVLHQNSKDTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVLGGWILHIKGARRSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVKCRAPGGAKRPLRPXXXXXXXXXXXXXXXXXXXXXXGRRGAADVLVVLSELPDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTSSSASPWSWPDXXXXXXXXXXXXXXXXXXXXXXXXXXXXXXXXXXXXXXXXXXXXXXXXXXXXXXXXXXXXXXXXXXXXXXXXXXXXXXXCGIGCAMLHWTLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXITFKDKTDVHPLEPLKCETLLCDIXXXXPSSATEGERTLRVLDTVEKWLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIKNEYAATWFYDNDNPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAEMVINHQHVQECGENXLERLETWLAENGCDRLSRMAVSGDDCVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGEWMTTEDRLEVWNRVWXXXXPHMTDKTTIKEWRDVPYLXXXXXXXXXXXXXXXXXXXXXXXXXXXXXXXXXXXXXXXXXXXXXXXXXXXXXXXXXXXXXX

SEQ ID NO: 265817 - protein, 3414 aa, Tick-borne encephalitis virus
  MOD_RES (99)..(99): Any amino acid
  MOD_RES (108)..(113): Any amino acid
  MOD_RES (246)..(253): Any amino acid
  MOD_RES (267)..(268): Any amino acid
  MOD_RES (1251)..(1255): Any amino acid
  MOD_RES (1294)..(1296): Any amino acid
  MOD_RES (1307)..(1313): Any amino acid
  MOD_RES (1353)..(1353): Any amino acid
  MOD_RES (1615)..(1615): Any amino acid
  MOD_RES (1673)..(1673): Any amino acid
  MOD_RES (2279)..(2281): Any amino acid
  MOD_RES (2806)..(2806): Any amino acid
  MOD_RES (3342)..(3343): Any amino acid
  MOD_RES (3388)..(3389): Any amino acid
MAGKAILKGKGGGPPRRVSKETAKKTRQSRVQMPNGLVLMRMMGILWHAVAGTARSPVLKSFWNSVPLKQATAALRKIKKAVSTLMVGLQRRGKRRSAXDWTGWLLVXXXXXXTLAATVRKERDGTTVIRAEGKDAATQVRVENGTCVILATDMGSWCDDSLTYECVTIDQGEEPVDVDCFCRNVDGVYLEYGRCGKQEGSRTRRSVLIPSHAQGDLTGRGHKWLEGDSLRTHLTRVEGWVWKNKXXXXXXXXVVWLTVESVVTRVXXVVVLLCLAPVYASRCTHLENRDFVTGTQGTTRVTLVLELGGCVTITAEGKPSMDVWLDSIYQENPAKTREYCLHAKLSDTKVAARCPTMGPATLAEEHQSGTVCKRDQSDRGWGNHCGLFGKGSIVTCVKASCEAKKKATGHVYDANKIVYTVKVEPHTGDYVAANETHSGRKTASFTVSSEKTILTMGDYGDVSLLCRVASGVDLAQTVILELDKTSEHLPTAWQVHRDWFNDLALPWKHEGAQNWNNAERLVEFGAPHAVKMDVYNLGDQTGVLLKSLAGVPVAHIDGTKYHLKSGHVTCEVGLEKLKMKGLTYTMCDKTKFTWKRIPTDSGHDTVVMEVAFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSLFGGVGFLPKILVGVALAWLGLNMRNPTMSMSFLLAGGLVLAMTLGVGADVGCAVDTERMELRCGEGLVVWREVSEWYDNYAYYPETPGALASAIKETFEEGTCGIVPQNRLEMAMWRSSATELNLALAEGDANLTVVVDKLDPTDYRGGIPGLLKKGKDIKVSWKSWGHSMIWSVPEAPRRFMVGTEGGSECPLERRKTGVFTVAEFGVGLRTKVFLDFRQESTHECDTGVMGAAVKNGMAVHTDQSLWMKSVRNDTGTYIVELLVTDLRNCSWPASHTIDNAEVVDSELFLPASLAGPRSWYNRIPGYSEQVKGPWKYSPIRVTREECPGTRVTINADCDKRGASVRSTTESGKVIPEWCCRTCTLPPVTFRTGTDCWYAMEIRPVHDQGGLVRSMVVADNGELLSEGGIPGIVALFVVLEYVIRRRPATGTTAMWGGIVVLALLVTGLVRIESLVRYVVAVGITFHLELGPEIVALTLLQAVFELRVGLLSAFALRSNLTVREMVTIYFLLLVLELGLPSXXXXXLWKWGDALAMGALIFRACTAEEKTGVGLLLMALMTQQDXXXAHYGLMLFLGXXXXXXXWKLIRGHREQKGLTWIVPLAGLLGGEGSGVRLLAFWELAXHGGRRSFSEPLTVVGVMLTLASGMMRHTSQEALCALAVASFLLLMLVLGTRKMQLVAEWSGCVEWHPELMNEGGEVSLRVRQDSMGNFHLTELEKEERVMAFWLLAGLAASAFHWSGILGVMGLWTLSEMLRTARRSDLVFSGQGGRERGDRPFEVKDGVYRIFSPGLLWGQRQVGVGYGSKGVLHTMWHVTRGAALSIDDAVAGPYWADVKEDVVCYGGAWSLEEKWKGETVQVHAFPPGRAHEVHQCQPGELLLDTGRRXGAVPIDLAKGTSGSPILNSQGVVVGLYGNGLKTNETYVSSIAQGEAEKSRPNLPPAVXGTGWTAKGQITVLDMHPGSGKTHRVLPELIRQCIDRRLRTLVLAPTRVVLKEMERALNGKRVRFHSPAVGDQQVGGAIVDVMCHATYVNRRLLPQGRQNWEVAIMDEAHWTDPHSIAARGHLYTLAKENKCALVLMTATPPGKSEPFPESNGAISSEEKQIPDGEWRDGFDWITEYEGRTAWFVPSIAKGGIIARTLRQKGKSVICLNSKTFEKDYSRVRDEKPDFVVTTDISEMGANLDVSRVIDGRTNIKPEEVDGRVELTGTRRVTTASAAQRRGRVGRQEGRTDEYIYSGQCDDDDSGLVQWKEAQILLDNITTLRGPVATFYGPEQDKMPEVAGHFRLTEEKRKHFRHLLTHCDFTPWLAWHVAANVSSVTSRNWTWEGPEENTVDEANGDLVTFRSPNGAERTLRPVWRDARMFREGRDIREFVAYASGRRSFGDVLSGMSGVPELLRHRCVSAMDVFYTLMHEEPGSRAMRMAERDAPEAFLTVVEMMVLGLATLGVVWCFVVRTSISRMMLGTLVLLASLALLWAGGVSYGNMAGVALIFYTLLTVLQPEAGKQRSSDDNKLAYFLLTLCSLAGLVAANEMGFLEKTKADLSTVLWSXXXELRSWEEWTNIDIQPARSWGTYVLVVSLFTPYIIHQLQTKIQQLVNSAVATGAQAMRDLGGGAPFFGVAGHVMALGVVSLVGATPTSLVVGVGLAAFHLAIVVSGLEAELTQRAHKVFFSAMVRNPMVDGDVINPFGEGEAKPALYERKMSLVLAIVLCLMSVVMNRTVPSITEASAVGLAAAGQLLRPEADTLWTMPVACGLSGVVRGSLWGFLPLGHRLWLRASGSRRGGSEGDTLGDLWKRKLNGCTKEEFFAYRRTGILETERDKARELLRRGETNMGLAVSRGTAKLAWLEERGYATLKGEVVDLGCGRGGWSYYAASRPAVMSVKAYTIGGKGHETPKMVTSLGWNLIKFRAGMDVFSMQPHRADTIMCDIGESNPDAVVEGERTRKVILLMEQWKNRNPTATCVFKVLAPYRPEVIEALHRFQLQWGGGLVRTPFSRNSTHEMYYSTAVTGNIVNSVNIQSRKLLARFGDQRGPTRVPELDLGVGTRCVVLAEDKVKEKDVQERISALREQYGETWHXDREHPYRTWQYWGSYRTAPTGSAASLINGVVKLLSWPWNAREDVVRMAMTDTTAFGQQRVFKEKVDTKAQEPQPGTKVIMRAVNDWILERLARKSKPRMCSREEFIAKVKSNAALGAWSDEQNRWSSAKEAVEDPAFWQLVDEERERHLAGRCAHCVYNMMGKREKKLGEFGVAKGSRAIWYMWLGSRFLEFEALGFLNEDHWASRGSSGSGVEGISLNYLGWYLKGLSTLEGGLFYADDTAGWDTKVTNADLEDEEQLLRYMEGEHKQLAATIMQKAYHAKVVKVARPSRDGGCIMDVITRRDQRGSGQVVTYALNTLTNIKVQLIRMMEGEGVIEASDAHNPRLLRVERWLRDHGEERLGRMLVSGDDCVVRPVDDRFGKALYFLNDMAKTRKDIGEWEHSVGFSNWEEVPFCSHHFHELVMKDGRALIVPCRDQDELVGRARVSPGCGWSVRETACLSKAYGQMWLLSYFHRRDLRTLGLAICSAVPVDWVPTGRTTWSIHASGAWMTTEDMLDVWNRVWILDNPFMHSKEKXXEWRDVPYLPKSHDMLCSSLVGRKERAEWAKNIWGAVEKVRKMIGXXKFKDYLSCMDRHDLHWELKLESSII

SEQ ID NO: 265818 - protein, 3414 aa, Tick-borne encephalitis virus
  MOD_RES (99)..(99): Any amino acid
  MOD_RES (108)..(113): Any amino acid
  MOD_RES (142)..(142): Any amino acid
  MOD_RES (171)..(179): Any amino acid
  MOD_RES (197)..(202): Any amino acid
  MOD_RES (230)..(237): Any amino acid
  MOD_RES (246)..(253): Any amino acid
  MOD_RES (267)..(268): Any amino acid
  MOD_RES (281)..(319): Any amino acid
  MOD_RES (376)..(387): Any amino acid
  MOD_RES (477)..(478): Any amino acid
  MOD_RES (534)..(539): Any amino acid
  MOD_RES (567)..(572): Any amino acid
  MOD_RES (619)..(621): Any amino acid
  MOD_RES (637)..(638): Any amino acid
  MOD_RES (654)..(662): Any amino acid
  MOD_RES (678)..(679): Any amino acid
  MOD_RES (696)..(698): Any amino acid
  MOD_RES (751)..(751): Any amino acid
  MOD_RES (788)..(802): Any amino acid
  MOD_RES (937)..(937): Any amino acid
  MOD_RES (959)..(962): Any amino acid
  MOD_RES (992)..(1003): Any amino acid
  MOD_RES (1026)..(1030): Any amino acid
  MOD_RES (1078)..(1084): Any amino acid
  MOD_RES (1108)..(1114): Any amino acid
  MOD_RES (1215)..(1219): Any amino acid
  MOD_RES (1251)..(1255): Any amino acid
  MOD_RES (1294)..(1296): Any amino acid
  MOD_RES (1307)..(1313): Any amino acid
  MOD_RES (1353)..(1353): Any amino acid
  MOD_RES (1364)..(1367): Any amino acid
  MOD_RES (1390)..(1411): Any amino acid
  MOD_RES (1543)..(1543): Any amino acid
  MOD_RES (1615)..(1615): Any amino acid
  MOD_RES (1673)..(1673): Any amino acid
  MOD_RES (1687)..(1699): Any amino acid
  MOD_RES (1715)..(1723): Any amino acid
  MOD_RES (1786)..(1792): Any amino acid
  MOD_RES (1844)..(1845): Any amino acid
  MOD_RES (1877)..(1882): Any amino acid
  MOD_RES (1898)..(1924): Any amino acid
  MOD_RES (2022)..(2039): Any amino acid
  MOD_RES (2125)..(2126): Any amino acid
  MOD_RES (2193)..(2194): Any amino acid
  MOD_RES (2218)..(2224): Any amino acid
  MOD_RES (2240)..(2245): Any amino acid
  MOD_RES (2279)..(2281): Any amino acid
  MOD_RES (2300)..(2306): Any amino acid
  MOD_RES (2322)..(2323): Any amino acid
  MOD_RES (2386)..(2401): Any amino acid
  MOD_RES (2497)..(2501): Any amino acid
  MOD_RES (2570)..(2599): Any amino acid
  MOD_RES (2721)..(2722): Any amino acid
  MOD_RES (2806)..(2806): Any amino acid
  MOD_RES (2816)..(2825): Any amino acid
  MOD_RES (2841)..(2850): Any amino acid
  MOD_RES (3004)..(3005): Any amino acid
  MOD_RES (3046)..(3057): Any amino acid
  MOD_RES (3088)..(3090): Any amino acid
  MOD_RES (3133)..(3134): Any amino acid
  MOD_RES (3172)..(3173): Any amino acid
  MOD_RES (3225)..(3227): Any amino acid
  MOD_RES (3268)..(3281): Any amino acid
  MOD_RES (3305)..(3306): Any amino acid
  MOD_RES (3328)..(3329): Any amino acid
  MOD_RES (3342)..(3343): Any amino acid
  MOD_RES (3388)..(3389): Any amino acid
MVKKAILKGKGGGPPRRVSKETATKTRQSRVRMPSGLVLMRMMGILWHAVAGTARNPVLKAFWNSVPLRQAMAALRKIKRTVSALMVGLQKRGKRRSAXDWMSWLLVXXXXXXAFAATVRKERDGSTVIRAEGRDAATQVRXENGTCVILVTDMGSWCDDSLSYECVTIDXXXXXXXXXCFCRNVDGVHLEYGRCGXXXXXXTRRSVLIPSHAQGELTGRGRKWLEGDSXXXXXXXXEGWVWKNRXXXXXXXXVVWLTLESVVTRVXXLVALFCLAPVYAXXXXXXXXXXXXXXXXXXXXXXXXXXXXXXXXXXXXXXXSMDVWLDAIYQESPAQTREYCLHVKLSDTKVAARCPTMGPATLAEEHQGGTVCKRDXXXXXXXXXXXXFGKGSIVACVKAACEAKKKATGHVYDANKIVYTIKVEPHTGDYVAPHETHSGRKTASFTISSEKTILTMGEYGDVSLLCKVPSGVDLAQXXILELDKTVEHLPTAWQVRRDWFNDLALPWRHEGAQQWNNAERLVEFGVPHAVKMDXXXXXXQTGVLLKALAGVPVAHIEGAKYHLKSGXXXXXXGLEKLKMKGLTYTMCDKTKFTWKRAPTDSGHDTVVMEVTFSGTKPCXXXVRAVAHGFPDVNVAMXXTPNPTIETNGGGFIEXXXXXXXXXIYVGELSYQWFQKGSXXGRVFQKTKRGIERLTVXXXHAWDFGSAGGFLSSIGKAVHTVLGGAFNSIFGGVGFLPKLLLGVVLAWLGLNXRNPTMSMGFLLAGVLVLAMTLGVGADVGGAVDTERMXXXXXXXXXXXXXXXEWYDNYAFYPETPGALASAIKETFEEGSCGVLPQNRLEMAMWRSSVTELNLALAEGEANLTVVVDKFDPTDYRGGVPGLLRKGKDIKVSWKSWGQSMIWSIPEASRRFMVGTEGSNECPLERRKTGIFTVAEFGXGLRTKVFLDFRQEPTHECDTGXXXXAVKNGMAIHTDQSLWMRSMKNETGTYIVEXXXXXXXXXXXXASHTIDNADVVDSESFLPASLAXXXXXYNRIPGYAEQVKGPWKHTPIRVIREECPGTKVTINAKCDRRGASVRSXXXXXXXIPEWCCRACTMPPVTIRTGTDCWXXXXXXXVHDQGGLIRSTVVADNGELLSEGGVPGIVALFVVLEYIIRRRPSTGTTVVWGGVIVLALLVTGMVKVESLVRYVVAVGITFHFELGPEIVALMLLQAVFEXXXXXLSAFALRRSLTVREMVTTYFLLLVLELGLPGXXXXXFWRWGDALAMGALIFRACTAEGKTGAGLLLMALMTQRDXXXVHHGLVCFLSXXXXXXXWRLLKGHREQKGLTWIVPLARLLGGEGSGIRLLAFWELSXHRRRRSFSEPXXXXGVMLTLAGGMMRHTPQEALCALXXXXXXXXXXXXXXXXXXXXXXWSGCVEWHPELVNEGGEVSLRVRQDAMGNFHLTELEKEERMMAFWLIAGLAASAIHWSGIIGVMGLWTLTEMLRSSRRSGLVFSGQGGRERGDKPFEVRDGVYRIFSPGLFWGQNQVGVGYGFRGVLHTMWXVTRGAALSINDAVVGPYWADVREDVVCYGGTWSLEEKWRGETVQVHAFPPGKAHEVHQCQPGELILDTGRKXGAIPIDLVKGTSGSPILNAQGAVVGLYGNGLKTNGTYVSSIAQGEVEKSRPNLPQAVXGTGWTSKGQITVLXXXXXXXXXXXXXPELIRQCTDRRLRTLXXXXXXXXXKEMERALSGKRVRFHSPAVSDQQAGGSIVDLMCHTTYVSRRLLPQGRQNWEVATIDEAHWTDXXXXXXXGHLYTLAQENKCALVLMTATRPGKSEPFPESNGAITSEERQIPEGEWRDGFXXITEYEGRSAWFVPSIAKGGAIARALRQKGKSXXXXXXKTFEKDYTRVRDEKPXXXXXXXXXXXXXXXXXXXXXXXXXXXKPEEVDGKVELIGTRRVTTASAAPRRGRVGRQDGRIDEYIYSGQCDDYDGVLVQWKEGQILLDNITTLRGPVVTFYGPEQDRMPEVAGHYRLTEEKRXXXXXXXXXXXXXXXXXXHVAANVSSVTDRSWTWEGPEENAVDEASGDLVTFKSPNGAERTLRPVWKDARMFKEGRDIKEFIAYASGRRSFGDVLTGMSGVPEXXRHRCVSALDVFYTLMHEEPGSRAMKMAERDAPEAFLTMAEVLVLGLATLGVIWCFVVRASISRMMLXXLVLLASLLLLWAGGVGYGNMAGVXXXXXXXLTVLQPEVGKQRSSDXXXXXXFLLTLCSVAGLVAANEMGFLERTKADLSTALWSXXXEPRPWSEWTNVDIQPARSXXXXXXXVSLFTPYMIHQLQTKXXQLVNSAVASGAQAMRDLGGGTPFFGVAGHVMTLGVVSLIGATPTSLMVGVGLAALHLAIVVSXXXXXXXXXXXXXXXXAMVRNPMLDGDVINPFGEGETKPALYERKMSLVLAIALCLMAVVMNRTVASITEASAVGLAAVGQLLRPEVDTLWTMPVACGMSSVVTGSLWGFLXXXXXLWLRASGGRRGGADGDTLGDLWKRRLNNCTREEFFVYRRAGIMETERDKARELLRKGETNTGLAVSRGXXXXXXXXXXXXXXXXXXXXXXXXXXXXXXYYAASRPAVMSVRAYTIGGRGHEAPRMVTSLGWNLIKFRSGVDVFSMQPHRADTVMCDIGESSPDAAVEGERTRRVILLMEQWKNRNPTAACVFKVLAPYRPEVIEALHRFQLRWGGGLVRXXFSRNSTHEMYYSTAITGNIVNSVNVQSRKLLARFGDQRGPTKVPELDLGIGTRCVVLAEDKVKEQDVQERIRALREQYSETWHXDEEHPYRTWXXXXXXXXXXTGSAASLTNGVVKLLXXXXXXXXXXVRMAMTDPTPAGQQRVFKDNADTKAQEPQPGTRVIMRAVNDWILERLAQKSKPRMCSKEEFIAKVKSSAALGAWSDEQNRWASAREAVEDPAFWHLVDEERERHLMGRCAHCVHNIMGKREKKLGEFGVSKGSRAMWYMWLGSRFQEFEALGFXXEDHWASRESSGAGVEGISLNYLGWHLKKLSTLNGGLFYADXXXXXXXXXXXXDLEDEEQILRYMEGEHKQLATTVMQKAYHAXXXKVARPSRDGGCVMDVITRRDQRGSVQVVTYALNTHTNIKVQLXXMMEGEGVIEAADAHNPRLLRVERWLKEYGGERLGRMLXXGDDCVVRPLDDRFSRALYFLNDMAKTRKDVGEWEHSAGFSSVEAVPFCSHHXXXLVMKDGRTLVVPCRDQDELVGRARISPGCGWSIRETACLSXXXXXXXXXXXXXXRDLRTLGLAINSAVPADWVPTGRXXWSIHASGAWITTENMLDVWNRXXILDNPFMQNKEKXXEWRDVPYLPKAQDMLCSSLVGRRERAEWARNIWGAVEKVRRMIGXXKFRDYLSCMDRHDLHWELRLESSII

SEQ ID NO: 265819 - protein, 3414 aa, Tick-borne encephalitis virus
  MOD_RES (11)..(14): Any amino acid
  MOD_RES (99)..(99): Any amino acid
  MOD_RES (108)..(113): Any amino acid
  MOD_RES (133)..(143): Any amino acid
  MOD_RES (164)..(181): Any amino acid
  MOD_RES (195)..(208): Any amino acid
  MOD_RES (224)..(253): Any amino acid
  MOD_RES (267)..(268): Any amino acid
  MOD_RES (279)..(324): Any amino acid
  MOD_RES (340)..(355): Any amino acid
  MOD_RES (373)..(391): Any amino acid
  MOD_RES (407)..(408): Any amino acid
  MOD_RES (463)..(478): Any amino acid
  MOD_RES (494)..(504): Any amino acid
  MOD_RES (522)..(551): Any amino acid
  MOD_RES (565)..(578): Any amino acid
  MOD_RES (619)..(680): Any amino acid
  MOD_RES (695)..(701): Any amino acid
  MOD_RES (721)..(727): Any amino acid
  MOD_RES (750)..(757): Any amino acid
  MOD_RES (767)..(817): Any amino acid
  MOD_RES (856)..(857): Any amino acid
  MOD_RES (930)..(943): Any amino acid
  MOD_RES (959)..(973): Any amino acid
  MOD_RES (990)..(1004): Any amino acid
  MOD_RES (1020)..(1040): Any amino acid
  MOD_RES (1075)..(1092): Any amino acid
  MOD_RES (1103)..(1117): Any amino acid
  MOD_RES (1130)..(1153): Any amino acid
  MOD_RES (1189)..(1189): Any amino acid
  MOD_RES (1202)..(1220): Any amino acid
  MOD_RES (1251)..(1255): Any amino acid
  MOD_RES (1264)..(1269): Any amino acid
  MOD_RES (1294)..(1296): Any amino acid
  MOD_RES (1307)..(1313): Any amino acid
  MOD_RES (1353)..(1353): Any amino acid
  MOD_RES (1364)..(1374): Any amino acid
  MOD_RES (1383)..(1415): Any amino acid
  MOD_RES (1427)..(1450): Any amino acid
  MOD_RES (1474)..(1474): Any amino acid
  MOD_RES (1513)..(1518): Any amino acid
  MOD_RES (1542)..(1544): Any amino acid
  MOD_RES (1571)..(1605): Any amino acid
  MOD_RES (1615)..(1615): Any amino acid
  MOD_RES (1642)..(1655): Any amino acid
  MOD_RES (1673)..(1673): Any amino acid
  MOD_RES (1683)..(1723): Any amino acid
  MOD_RES (1766)..(1820): Any amino acid
  MOD_RES (1844)..(1857): Any amino acid
  MOD_RES (1873)..(1928): Any amino acid
  MOD_RES (1940)..(1949): Any amino acid
  MOD_RES (1965)..(1966): Any amino acid
  MOD_RES (1998)..(2042): Any amino acid
  MOD_RES (2077)..(2080): Any amino acid
  MOD_RES (2092)..(2095): Any amino acid
  MOD_RES (2108)..(2109): Any amino acid
  MOD_RES (2120)..(2136): Any amino acid
  MOD_RES (2156)..(2156): Any amino acid
  MOD_RES (2191)..(2194): Any amino acid
  MOD_RES (2210)..(2259): Any amino acid
  MOD_RES (2279)..(2281): Any amino acid
  MOD_RES (2295)..(2324): Any amino acid
  MOD_RES (2339)..(2339): Any amino acid
  MOD_RES (2363)..(2414): Any amino acid
  MOD_RES (2423)..(2429): Any amino acid
  MOD_RES (2494)..(2506): Any amino acid
  MOD_RES (2570)..(2602): Any amino acid
  MOD_RES (2631)..(2633): Any amino acid
  MOD_RES (2647)..(2658): Any amino acid
  MOD_RES (2679)..(2680): Any amino acid
  MOD_RES (2696)..(2698): Any amino acid
  MOD_RES (2721)..(2729): Any amino acid
  MOD_RES (2739)..(2756): Any amino acid
  MOD_RES (2766)..(2770): Any amino acid
  MOD_RES (2805)..(2806): Any amino acid
  MOD_RES (2816)..(2861): Any amino acid
  MOD_RES (2877)..(2891): Any amino acid
  MOD_RES (2972)..(3006): Any amino acid
  MOD_RES (3022)..(3025): Any amino acid
  MOD_RES (3045)..(3070): Any amino acid
  MOD_RES (3086)..(3094): Any amino acid
  MOD_RES (3106)..(3137): Any amino acid
  MOD_RES (3170)..(3174): Any amino acid
  MOD_RES (3196)..(3202): Any amino acid
  MOD_RES (3223)..(3227): Any amino acid
  MOD_RES (3243)..(3244): Any amino acid
  MOD_RES (3259)..(3282): Any amino acid
  MOD_RES (3305)..(3308): Any amino acid
  MOD_RES (3324)..(3330): Any amino acid
  MOD_RES (3342)..(3343): Any amino acid
  MOD_RES (3374)..(3377): Any amino acid
  MOD_RES (3388)..(3389): Any amino acid
MARKAILKGKXXXXPRRVSKETARKTRQPRVQMPSGLVLMRMLGFLWHAIAGTVRSPVLKSFWKSVPLKQATTALRKIKMAVSTLMIGLQRRGKKRSTXNWTGWLLVXXXXXXTFAATVRKEGDDTTVIRAEXXXXXXXXXXXNGTCVIMATDMGAWCDDSLSXXXXXXXXXXXXXXXXXXCRNVDRVYLEYGRXXXXXXXXXXXXXXIRSHAQGELTGRGRKXXXXXXXXXXXXXXXXXXXXXXXXXXXXXXIVWMTVESVVTRIXXVAVLFCLAPVXXXXXXXXXXXXXXXXXXXXXXXXXXXXXXXXXXXXXXXXXXXXXXLDAIYQEKPAKTREYXXXXXXXXXXXXXXXXTTGPATLTEQHQSGTVCXXXXXXXXXXXXXXXXXXXSIVTCVKVACEAKKKXXGHVYDANKIVYPVKVEPHTGDYVAVNETHSGRKTPSFTVSSEKTILNMGDYGDVXXXXXXXXXXXXXXXXILELDKTLEHLPTAWXXXXXXXXXXXLPWKHEGAQHWNNAERLXXXXXXXXXXXXXXXXXXXXXXXXXXXXXXPVAHIDGAKYHLKXXXXXXXXXXXXXXMNGLTYTVCDKTKFAWKRTPTDSGHDTVVMEVSFSGTKPCXXXXXXXXXXXXXXXXXXXXXXXXXXXXXXXXXXXXXXXXXXXXXXXXXXXXXXXXXXXXXXRVFQKTRRGIERLTXXXXXXXDFGSTGGFLASIGKALHTVXXXXXXXLFGGVGFLPKILMGAALAWLGLXXXXXXXXMSFLLAGVLXXXXXXXXXXXXXXXXXXXXXXXXXXXXXXXXXXXXXXXXXXXXXXXXXXXLASAIKETFEEGNCGILPQNRLEMAMWRSASTELNLALXXGEANLTVMVDKFDPTDYRGGISGLLKKGKDIRVSWRSWGQSIIWSIPEAPRRFMVGTEGQSECPPERRKTGVXXXXXXXXXXXXXXFLDFRQEATHECDTGXXXXXXXXXXXXXXXQSLWMKSVRNETGTYIXXXXXXXXXXXXXXXSHTIDNADVVDSESFXXXXXXXXXXXXXXXXXXXXXVKGPWKYTPIRVVREECPGTTVTISADCDRRGASXXXXXXXXXXXXXXXXXXCTLPPVTIRTXXXXXXXXXXXXXXXQGGLVRSTVVADXXXXXXXXXXXXXXXXXXXXXXXXRRRPATGTAVVWGGFVVFALLVTGLVKMESLVRYVXAVGIAFHLELGPXXXXXXXXXXXXXXXXXXXSAFALRRGLTVREMVITYFLLLVLELGLPYXXXXXLWRWGDALXXXXXXLRACTAEGKAGVGLLLMALMTQQNXXXVHYGLIIFLGXXXXXXXWRLLEGHREQKGLSWVVPLAGLMGGEGSGIRLLSFWELSXHGKRRSFSEPXXXXXXXXXXXSGMMRHTPXXXXXXXXXXXXXXXXXXXXXXXXXXXXXXXXXVEWYPELVNEGXXXXXXXXXXXXXXXXXXXXXXXXRMMAFWLLAGLAASAVHWSGILGXMGLWTLSEMMRSARRSDLAFSGQGRGERGDRPFEVRDGXXXXXXPGLFWGQSQVGVGYGFRGVLHTMXXXTRGAALSIDDAVAGPYWAEVKEDVVCXXXXXXXXXXXXXXXXXXXXXXXXXXXXXXXXXXXELLLDTGGRXGAILIDLSKGTSGSPILNAQGAVVGLXXXXXXXXXXXXXXIAQGEAEKSRPSLPPAVXGMGWTAKGQXXXXXXXXXXXXXXXXXXXXXXXXXXXXXXXXXXXXXXXXXKEMERALTGKRVRFHSPAVSDQQMGGAIVDLMCHATYVSRRLXXXXXXXXXXXXXXXXXXXXXXXXXXXXXXXXXXXXXXXXXXXXXXXXXXXXXXXPESNGAITSEEKQIPNGEWRDGFXXXXXXXXXXXXXXPSIAKGGVIARTLRQXXXXXXXXXXXXXXXXXXXXXXXXXXXXXXXXXXXXXXXXXXXXXXXXXXXXXXXXVDGRVELIGTRXXXXXXXXXXRGRVGRHEGRIDEYIXXGQCDDDDSGLVQWKEAQILLDDIITLRGPVAXXXXXXXXXXXXXXXXXXXXXXXXXXXXXXXXXXXXXXXXXXXXXANVSGVTSRSWTWEGPEANAVDEANGGLVTFRSPXXXXRTLKPVWRDARXXXXGRDIREFIAYASXXRSIGDVLTGMXXXXXXXXXXXXXXXXXFYTLMHEKPGSSAMRMAERXAPEAFLTLVEMMVLGLGTLGVVWCFVARTSISRMXXXXLVLLASLVLLWAGGVXXXXXXXXXXXXXXXXXXXXXXXXXXXXXXXXXXXXXXXXXXXXXXXXXXNEMGLLEKTKADLSTVLWAXXXEPRSWGEWTNIDIXXXXXXXXXXXXXXXXXXXXXXXXXXXXXXLVNSAVVTGAQAMRXLGGGAPFIGVAGHVVSLGVVSLVXXXXXXXXXXXXXXXXXXXXXXXXXXXXXXXXXXXXXXXXXXXXXXXXXXXXYPFGEGETXXXXXXXKMSLVLAVVLCLISVVMNRTVLSITEASAVGLAAAGQLLSPEEDTLWTMPVACGLSGVVTGSLWXXXXXXXXXXXXXSGSRRGGSDGDTLGDLWKQRLNSCTKEEFFVYRRTGILETERDKARELLKRGETNVGLAVSRGXXXXXXXXXXXXXXXXXXXXXXXXXXXXXXXXXASRPSVMNVRAYTIGGKGHETPRMVTSLXXXLIKFRAGVDVFSMXXXXXXXXXXXXGESNPDAVVEGEKTRKVILLXXQWKNRNPAAACVFKVXXXYRPKVIEALHRFQLKWGGGLVRXXXXXXXXXKVYYSTAVTXXXXXXXXXXXXXXXXXXAGQRGPTRVXXXXXGVGTRCVVLAEDRVREQDVQERIKALKEQYGETWXXDGEHPYRTWXXXXXXXXXXXXXXXXXXXXXXXXXXXXXXXXXXXXXXXXXXXXXXWQQRVFKKNADTKAQXXXXXXXXXXXXXXXWILDRLAQRSRSRIHSKEEFIAKVRSNAALGAWSNEQNRWSNAKEAVEDPVFWRLVDEERERDLTGRCAHCAFNIMGKREXXXXXXXXXXXXXXXXXXXXXXXXXXXXXXXXXXXDHWASRGFSGSGVEGXXXXYLGWHLKGLSIPEGGLFYAXXXXXXXXXXXXXXXXXXXXXXXXXXGEHRQLAATVMQKAYXXXXXXXXXPSREGGCVMDVXXXXXXXXXXXXXXXXXXXXXXXXXXXXXXXXGEGVIEATDAHNPRLFRVERWLREHGGERLGRXXXXXDDCVVRPIDDRFSGALYFLNDXXXXXXXIGEWEHSAGLSSWEAVPFCSXXXXXLVMKDGRSLIVPCRDXXELVGRAPVSPGCGWXXXXXXXXXXXXXXXXXXXXXXXXDLRTLGLAISSAVPIDWVPTGRXXXXIHASGSWMTTENMLDXXXXXXXLDNPFMQNKERXXEWRDIPYLPKAHDMLCSSLVGRKERAEWARXXXXAVEKVRKMMGXXRCKDYPSCMDRHYLHWNLKLEGSII

SEQ ID NO: 265820 - protein, 3414 aa, Tick-borne encephalitis virus
  MOD_RES (1)..(16): Any amino acid
  MOD_RES (37)..(42): Any amino acid
  MOD_RES (99)..(99): Any amino acid
  MOD_RES (108)..(113): Any amino acid
  MOD_RES (131)..(148): Any amino acid
  MOD_RES (158)..(253): Any amino acid
  MOD_RES (267)..(268): Any amino acid
  MOD_RES (278)..(324): Any amino acid
  MOD_RES (340)..(360): Any amino acid
  MOD_RES (371)..(392): Any amino acid
  MOD_RES (407)..(413): Any amino acid
  MOD_RES (424)..(505): Any amino acid
  MOD_RES (521)..(589): Any amino acid
  MOD_RES (603)..(703): Any amino acid
  MOD_RES (719)..(732): Any amino acid
  MOD_RES (750)..(822): Any amino acid
  MOD_RES (838)..(840): Any amino acid
  MOD_RES (855)..(875): Any amino acid
  MOD_RES (886)..(890): Any amino acid
  MOD_RES (907)..(909): Any amino acid
  MOD_RES (918)..(943): Any amino acid
  MOD_RES (953)..(974): Any amino acid
  MOD_RES (989)..(1010): Any amino acid
  MOD_RES (1019)..(1040): Any amino acid
  MOD_RES (1053)..(1053): Any amino acid
  MOD_RES (1073)..(1154): Any amino acid
  MOD_RES (1188)..(1220): Any amino acid
  MOD_RES (1235)..(1273): Any amino acid
  MOD_RES (1294)..(1296): Any amino acid
  MOD_RES (1307)..(1313): Any amino acid
  MOD_RES (1344)..(1353): Any amino acid
  MOD_RES (1362)..(1458): Any amino acid
  MOD_RES (1474)..(1476): Any amino acid
  MOD_RES (1513)..(1518): Any amino acid
  MOD_RES (1530)..(1545): Any amino acid
  MOD_RES (1570)..(1615): Any amino acid
  MOD_RES (1640)..(1659): Any amino acid
  MOD_RES (1671)..(1673): Any amino acid
  MOD_RES (1683)..(1735): Any amino acid
  MOD_RES (1754)..(1824): Any amino acid
  MOD_RES (1840)..(1857): Any amino acid
  MOD_RES (1873)..(1952): Any amino acid
  MOD_RES (1964)..(1967): Any amino acid
  MOD_RES (1980)..(2044): Any amino acid
  MOD_RES (2055)..(2061): Any amino acid
  MOD_RES (2075)..(2140): Any amino acid
  MOD_RES (2154)..(2157): Any amino acid
  MOD_RES (2175)..(2177): Any amino acid
  MOD_RES (2186)..(2270): Any amino acid
  MOD_RES (2279)..(2281): Any amino acid
  MOD_RES (2291)..(2339): Any amino acid
  MOD_RES (2362)..(2429): Any amino acid
  MOD_RES (2477)..(2481): Any amino acid
  MOD_RES (2492)..(2507): Any amino acid
  MOD_RES (2517)..(2526): Any amino acid
  MOD_RES (2545)..(2549): Any amino acid
  MOD_RES (2565)..(2604): Any amino acid
  MOD_RES (2627)..(2682): Any amino acid
  MOD_RES (2692)..(2705): Any amino acid
  MOD_RES (2714)..(2775): Any amino acid
  MOD_RES (2801)..(2806): Any amino acid
  MOD_RES (2816)..(2892): Any amino acid
  MOD_RES (2910)..(2924): Any amino acid
  MOD_RES (2971)..(3009): Any amino acid
  MOD_RES (3021)..(3025): Any amino acid
  MOD_RES (3044)..(3072): Any amino acid
  MOD_RES (3082)..(3137): Any amino acid
  MOD_RES (3150)..(3153): Any amino acid
  MOD_RES (3169)..(3174): Any amino acid
  MOD_RES (3195)..(3205): Any amino acid
  MOD_RES (3222)..(3229): Any amino acid
  MOD_RES (3243)..(3284): Any amino acid
  MOD_RES (3305)..(3312): Any amino acid
  MOD_RES (3322)..(3332): Any amino acid
  MOD_RES (3342)..(3346): Any amino acid
  MOD_RES (3356)..(3365): Any amino acid
  MOD_RES (3374)..(3378): Any amino acid
  MOD_RES (3388)..(3389): Any amino acid
  MOD_RES (3398)..(3403): Any amino acid
XXXXXXXXXXXXXXXXRVSKEAAKKTRQSRVQMPSGXXXXXXMGFLWHAVAGTVRSPVLKSFWKPVPLKQATTALRKIKKAVSALMVGLQRREKKRSTXDWMGWLLVXXXXXXTIAATVRRERDDTTVIRXXXXXXXXXXXXXXXXXXILATDMGAWXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVWLTLESVVARVXXVVVLFCLAPXXXXXXXXXXXXXXXXXXXXXXXXXXXXXXXXXXXXXXXXXXXXXXXLDAIYQENPAQTREYXXXXXXXXXXXXXXXXXXXXXTLAEQHQSGTXXXXXXXXXXXXXXXXXXXXXXIVTCVKVSCEAKKKXXXXXXXPNRIVYTVKVXXXXXXXXXXXXXXXXXXXXXXXXXXXXXXXXXXXXXXXXXXXXXXXXXXXXXXXXXXXXXXXXXXXXXXXXXXXXXXXXXXPWRHEGVRNWNNAERXXXXXXXXXXXXXXXXXXXXXXXXXXXXXXXXXXXXXXXXXXXXXXXXXXXXXXXXXXXXXXXXXXXXXTKFTWRRTPTDSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGSTGGLLSSIGKALHXXXXXXXXXXXXXXGFLPKILIGMALAWLGLXXXXXXXXXXXXXXXXXXXXXXXXXXXXXXXXXXXXXXXXXXXXXXXXXXXXXXXXXXXXXXXXXXXXXXXXXKEAFEEGTCGILPQNXXXMAMWRSAATELNLAXXXXXXXXXXXXXXXXXXXXXGGVSGLLRKGXXXXXSWKSWGHSVIWSIPEAXXXFMVGIEGSXXXXXXXXXXXXXXXXXXXXXXXXXXFVDFRQESTXXXXXXXXXXXXXXXXXXXXXXSLWMKSVRNETGTYXXXXXXXXXXXXXXXXXXXXXXPEVVDSELXXXXXXXXXXXXXXXXXXXXXXVKGPWKYLPIRVXRGECPGTTVVITADCDKRGXXXXXXXXXXXXXXXXXXXXXXXXXXXXXXXXXXXXXXXXXXXXXXXXXXXXXXXXXXXXXXXXXXXXXXXXXXXXXXXXXXRRPSTGSTVVWGGIVVFALLVTGMVRMESLVRYXXXXXXXXXXXXXXXXXXXXXXXXXXXXXXXXXSAFALRRNLTVREMXXXXXXXXXXXXXXXXXXXXXXXXXXXXXXXXXXXXXXXTAEGKAGVGLLLMPLLTKRGXXXVHYGLIFFLSXXXXXXXWRLLEGHREQKGLSWTVPMAGLVGGEGSGIXXXXXXXXXXSGRRRSFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLSASAIHWSGIIGXXXLWTLSEMLKTARRSDLVFSGQGNRERGDKPFEVRDGXXXXXXPGLFWGQSQVGXXXXXXXXXXXXXXXXRGAALYVDDAVAGPYWSDVREDVVXXXXXXXXXXXXXXXXXXXXXXXXXXXXXXXXXXXXXXXXXXXXXXGAVLIDLSKGTSRSPTINSQGVVVXXXXXXXXXXXXXXXXXXXXEAERSRPNLPQXXXGIGWTAKGQXXXXXXXXXXXXXXXXXXXXXXXXXXXXXXXXXXXXXXXXXXXXXXXXXXXXXRFLSPVVGDQQVGGSIVDXXXXXXXXXXXXXXXXXXXXXXXXXXXXXXXXXXXXXXXXXXXXXXXXXXXXXXXXXXXXXXXXXXXXXXXRGITSEERQIPNGEWXXXXXXXXXXXXXXXXXXPSIVKGGIIARALRQXXXXXXXXXXXXXXXXXXXXXXXXXXXXXXXXXXXXXXXXXXXXXXXXXXXXXXXXXXXXXXXXXXXXXXXXXXXXXXXXVGRQEGRIDEYXXXXQCDEDDGGLVQWXXXXXXXXXXXXXXXXXXXXXXXXXXXXXXXXXXXXXXXXXXXXXXXXXXXXXXXXXXXXXXXXXVSSVTSRSWTXXXXXXXAVDEASGGLVTFRXXXXXXXXXXXXXXXXXXXXXXXXXXXXXXXXXXXXXXXXXXXXXXXXXXXXXXXXXXXXXXXXXXMHDEPDSRAMRMAXXXXPEAFLTVAEMMVLGLGTXXXVWCFVARTXXXXXXXXXXXXXXXXXXXXXXXXXXXXXXXXXXXXXXXXXXXXXXXXXXXXXXXXXXXXXXXXXXXXXXXXXXXXXXXXXXXXXDLSAVLWSXXXEMRSWEEWTXXXXXXXXXXXXXXXXXXXXXXXXXXXXXXXXXXXXXXXXXXXXXXXXXLGGGAPFLGVAGHVMSLGVVSLXXXXXXXXXXXXXXXXXXXXXXXXXXXXXXXXXXXXXXXXXXXXXXXXXXXXXXXXXXXXXXXXXXXXRMSLVLATVLCLISVVMNRTMPSITEAAAVGLAALGQLLKPEADTLWXXXXXCGLSGVVTGSXXXXXXXXXXXXXXXXGSRRGGSDGXXXXXXXXXXLNSCTREEFFIYRRTGILXXXXXKARELLKKGETNMGLXXXXXXXXXXXXXXXXXXXXXXXXXXXXXXXXXXXXXXXXRPAVMNVKAYTIGGKGHETPRMXXXXXXXXXXXXXXXXXXXXXXXXXXXXXXXXXXXXXXXXXXXXXXXXXXXXXXXXKIRNPTATCXXXXXXXXXXXXXXTLHRFQLQXXXXXXXXXXXXXXXXXXXXXXXXXXXXXXXXXXXXXXXXXXXXXXXXXXXXXXXXXXXXXXCVVLAEDKVKEQDVRERIRALKEQYXXXXXXDAEHPYRTWXXXXXXXXXXXXXXXXXXXXXXXXXXXXXXXXXXXXXXXXXXXXXXXXXXXXXXXXXXXXXXXXXXXXXXXXXXXXXMLERLAQKSNSRIHSKEXXXXXXXXXXXXXXXSEEQNRWAGAREAVEDPAFWKLVDEERERHLAGRSAHGVFNIMGKRXXXXXXXXXXXXXXXXXXXXXXXXXXXXXXXXXXXXXXXASRGFSGSGVEXXXXXYLGWYLKELSTPEGGLFYXXXXXXXXXXXXXXXXXXXXXXXXXXXXXHKQLAATVMXXXXXXXXXXXXXXXXXXXXXXXXXXXXXXXXXXXXXXXXXXXXXXXXXXXXXXXXGEGVVEASDAHNXXXXRVERWLRNHGEERLGXXXXXXDDCVVRPVDDRFGRALYFLNXXXXXXXXXXXWEHSAGFAGWEEVPFCXXXXXXXXMKDGRALVVPCRDXXXXXXXXXXXXXXXXXXXXXXXXXXXXXXXXXXXXXXXXXXRTLGLTICSAVPTDWVPTGRXXXXXXXXGAWMTTENMXXXXXXXXXXXNPFMHGKEKXXXXXNVPYLPKAHXXXXXXXXXXTERAEWAKXXXXXVEKVRKIVGXXKCKDYPSCXXXXXXHWELKLESSIF

SEQ ID NO: 265821 - protein, 3414 aa, Tick-borne encephalitis virus
  MOD_RES (1)..(16): Any amino acid
  MOD_RES (26)..(76): Any amino acid
  MOD_RES (89)..(90): Any amino acid
  MOD_RES (99)..(99): Any amino acid
  MOD_RES (108)..(118): Any amino acid
  MOD_RES (129)..(253): Any amino acid
  MOD_RES (267)..(268): Any amino acid
  MOD_RES (277)..(392): Any amino acid
  MOD_RES (403)..(508): Any amino acid
  MOD_RES (520)..(589): Any amino acid
  MOD_RES (601)..(732): Any amino acid
  MOD_RES (742)..(822): Any amino acid
  MOD_RES (831)..(840): Any amino acid
  MOD_RES (855)..(893): Any amino acid
  MOD_RES (906)..(976): Any amino acid
  MOD_RES (987)..(1055): Any amino acid
  MOD_RES (1073)..(1156): Any amino acid
  MOD_RES (1176)..(1285): Any amino acid
  MOD_RES (1294)..(1296): Any amino acid
  MOD_RES (1307)..(1313): Any amino acid
  MOD_RES (1323)..(1324): Any amino acid
  MOD_RES (1340)..(1458): Any amino acid
  MOD_RES (1474)..(1477): Any amino acid
  MOD_RES (1491)..(1549): Any amino acid
  MOD_RES (1559)..(1626): Any amino acid
  MOD_RES (1639)..(1673): Any amino acid
  MOD_RES (1683)..(1737): Any amino acid
  MOD_RES (1754)..(1828): Any amino acid
  MOD_RES (1839)..(2157): Any amino acid
  MOD_RES (2167)..(2281): Any amino acid
  MOD_RES (2291)..(2341): Any amino acid
  MOD_RES (2357)..(2430): Any amino acid
  MOD_RES (2442)..(2449): Any amino acid
  MOD_RES (2458)..(2461): Any amino acid
  MOD_RES (2477)..(2529): Any amino acid
  MOD_RES (2545)..(2549): Any amino acid
  MOD_RES (2558)..(2617): Any amino acid
  MOD_RES (2627)..(2777): Any amino acid
  MOD_RES (2801)..(2806): Any amino acid
  MOD_RES (2815)..(2893): Any amino acid
  MOD_RES (2910)..(2937): Any amino acid
  MOD_RES (2950)..(2955): Any amino acid
  MOD_RES (2964)..(3009): Any amino acid
  MOD_RES (3021)..(3025): Any amino acid
  MOD_RES (3036)..(3154): Any amino acid
  MOD_RES (3169)..(3179): Any amino acid
  MOD_RES (3195)..(3213): Any amino acid
  MOD_RES (3222)..(3284): Any amino acid
  MOD_RES (3297)..(3333): Any amino acid
  MOD_RES (3342)..(3347): Any amino acid
  MOD_RES (3356)..(3378): Any amino acid
  MOD_RES (3388)..(3414): Any amino acid
XXXXXXXXXXXXXXXXRASKETAKKXXXXXXXXXXXXXXXXXXXXXXXXXXXXXXXXXXXXXXXXXXXXXXXXXXXKIKRAVSTLMIGXXKRGKRRSVXDWTSWLLVXXXXXXXXXXXVRKERDDTTVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVWMTVESVVTRTXXVVVLFCLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVTCVKVSCEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEGARNWNNAEXXXXXXXXXXXXXXXXXXXXXXXXXXXXXXXXXXXXXXXXXXXXXXXXXXXXXXXXXXXXXXXXXXXXXXTKFTWRRTPTDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFIPKLLLGXXXXXXXXXXXXXXXXXXXXXXXXXXXXXXXXXXXXXXXXXXXXXXXXXXXXXXXXXXXXXXXXXXXXXXXXXXXXXXXXXRETFEEGTXXXXXXXXXXMAMWRSSSTELNLAXXXXXXXXXXXXXXXXXXXXXXXXXXXXXXXXXXXXXXXSWGQAMIWSIPEXXXXXXXXXXXXXXXXXXXXXXXXXXXXXXXXXXXXXXXXXXXXXXXXXXXXXXXXXXXXXXXXXXXXXXXWMKSVRNETGXXXXXXXXXXXXXXXXXXXXXXXXXXXXXXXXXXXXXXXXXXXXXXXXXXXXXXXXXXXXXXXXXXXXXECPGTRVIISADCDRRGXXXXXXXXXXXXXXXXXXXXXXXXXXXXXXXXXXXXXXXXXXXXXXXXXXXXXXXXXXXXXXXXXXXXXXXXXXXXXXXXXXXXPATGTTAVWGGLIVLALLVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMALITQQDXXXVHYGLIFFLGXXXXXXXWRLLEGHREXXGLSWIVPLAGLVGGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLAASALHWSGILGXXXXWTLTKMLRPSRRSXXXXXXXXXXXXXXXXXXXXXXXXXXXXXXXXXXXXXXXXXXXXXXXXXXXXXXXXXXXLSVDDAVVGXXXXXXXXXXXXXXXXXXXXXXXXXXXXXXXXXXXXXXXXXXXXXXXXXXXXXXXXXXXXXXXXXXXXSGSPIINSQGVVXXXXXXXXXXXXXXXXXXXXXXXXXXXXXXXXXXXGSGWTAKGQXXXXXXXXXXXXXXXXXXXXXXXXXXXXXXXXXXXXXXXXXXXXXXXXXXXXXXXHSPVVSDHQGGGAIVDXXXXXXXXXXXXXXXXXXXXXXXXXXXXXXXXXXXXXXXXXXXXXXXXXXXXXXXXXXXXXXXXXXXXXXXXXXXSEVKQIPEGEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPEAFLTMAEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVRSWEEWTXXXXXXXXXXXXXXXXXXXXXXXXXXXXXXXXXXXXXXXXXXXXXXXXXXXGGAPFFGIAGHVMALXXXXXXXXXXXXXXXXXXXXXXXXXXXXXXXXXXXXXXXXXXXXXXXXXXXXXXXXXXXXXXXXXXXXXXXXXXMSLVLAVALCLXXXXXXXXVPSITEAAXXXXAAAGQLLRPEEDTLWXXXXXXXXXXXXXXXXXXXXXXXXXXXXXXXXXXXXXXXXXXXXXXXXXXXXXCTREEFFVYRRTGIMXXXXXRARELLRRXXXXXXXXXXXXXXXXXXXXXXXXXXXXXXXXXXXXXXXXXXXXXXXXXXXXXXXXXXXXGRGHETPKMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLADDKVKEQDVQERINALREQYXXXXXXNGEHPYRTXXXXXXXXXXXXXXXXXXXXXXXXXXXXXXXXXXXXXXXXXXXXXXXXXXXXXXXXXXXXXXXXXXXXXXXXXXXXXXXLERLARKNRPRMCSREXXXXXXXXXXXXXXXXXXXXXXXXXXXXVEDPAFWKLVDEXXXXXXAGRCAHCAXXXXXXXXXXXXXXXXXXXXXXXXXXXXXXXXXXXXXXXXXXXXXXASRESSGSGVEXXXXXYLGWHLKRLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVERWLRDYGEERLGXXXXXXXXXXXRGIDDRFSGALYFLNXXXXXXXXXXXXXXXXXXXSVEEVPFCXXXXXXXXXXXXXXXXXXXXXXXXXXXXXXXXXXXXXXXXXXXXXXXXXXXXXXXXXXXXXXXRTLGFAICSAVPXXXXXXXXXXXXXXXXXXXXXXXXXXXXXXXXXXXXXPFMQNKGKXXXXXXIPYLPKAQXXXXXXXXXXXXXXXXXXXXXXXVEKVRKMVGXXXXXXXXXXXXXXXXXXXXXXXXXXX

SEQ ID NO: 265822 - protein, 3414 aa, Tick-borne encephalitis virus
  MOD_RES (99)..(113): Any amino acid
  MOD_RES (246)..(253): Any amino acid
  MOD_RES (267)..(268): Any amino acid
  MOD_RES (1251)..(1255): Any amino acid
  MOD_RES (1294)..(1296): Any amino acid
  MOD_RES (1307)..(1313): Any amino acid
  MOD_RES (1353)..(1353): Any amino acid
  MOD_RES (1486)..(1486): Any amino acid
  MOD_RES (1615)..(1615): Any amino acid
  MOD_RES (1673)..(1673): Any amino acid
  MOD_RES (2279)..(2281): Any amino acid
  MOD_RES (2806)..(2806): Any amino acid
  MOD_RES (3342)..(3343): Any amino acid
  MOD_RES (3388)..(3389): Any amino acid
MAGKAILKGKGGGPPRRVSKETAKKTRQSRVQMPNGLVLMRMMGILWHAVAGTARSPVLKSFWNSVPLKQATAALRKIKKAVSTLMVGLQRRGKRRSAXXXXXXXXXXXXXXXTLAATVRKERDGTTVIRAEGKDAATQVRVENGTCVILATDMGSWCDDSLTYECVTIDQGEEPVDVDCFCRNVDGVYLEYGRCGKQEGSRTRRSVLIPSHAQGDLTGRGHKWLEGDSLRTHLTRVEGWVWKNKXXXXXXXXVVWLTVESVVTRVXXVVVLLCLAPVYASRCTHLENRDFVTGTQGTTRVTLVLELGGCVTITAEGKPSMDVWLDSIYQENPAKTREYCLHAKLSDTKVAARCPTMGPATLAEEHQSGTVCKRDQSDRGWGNHCGLFGKGSIVTCVKASCEAKKKATGHVYDANKIVYTVKVEPHTGDYVAANETHSGRKTASFTVSSEKTILTMGDYGDVSLLCRVASGVDLAQTVILELDKTSEHLPTAWQVHRDWFNDLALPWKHEGAQNWNNAERLVEFGAPHAVKMDVYNLGDQTGVLLKSLAGVPVAHIDGTKYHLKSGHVTCEVGLEKLKMKGLTYTMCDKTKFTWKRIPTDSGHDTVVMEVAFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSLFGGVGFLPKILVGVALAWLGLNMRNPTMSMSFLLAGGLVLAMTLGVGADVGCAVDTERMELRCGEGLVVWREVSEWYDNYAYYPETPGALASAIKETFEEGTCGIVPQNRLEMAMWRSSATELNLALAEGDANLTVVVDKLDPTDYRGGIPGLLKKGKDIKVSWKSWGHSMIWSVPEAPRRFMVGTEGGSECPLERRKTGVFTVAEFGVGLRTKVFLDFRQESTHECDTGVMGAAVKNGMAVHTDQSLWMKSVRNDTGTYIVELLVTDLRNCSWPASHTIDNAEVVDSELFLPASLAGPRSWYNRIPGYSEQVKGPWKYSPIRVTREECPGTRVTINADCDKRGASVRSTTESGKVIPEWCCRTCTLPPVTFRTGTDCWYAMEIRPVHDQGGLVRSMVVADNGELLSEGGIPGIVALFVVLEYVIRRRPATGTTAMWGGIVVLALLVTGLVRIESLVRYVVAVGITFHLELGPEIVALTLLQAVFELRVGLLSAFALRSNLTVREMVTIYFLLLVLELGLPSXXXXXLWKWGDALAMGALIFRACTAEEKTGVGLLLMALMTQQDXXXAHYGLMLFLGXXXXXXXWKLIRGHREQKGLTWIVPLAGLLGGEGSGVRLLAFWELAXHRGRRSFSEPLTVVGVMLTLASGMMRHTSQEALCALAVASFLLLMLVLGTRKMQLVAEWSGCVEWHPELMNEGGEVSLRVRQDSMGNFHLTELEKEERVMAFWLLAGLAASAFHWSGILGVMGLWTLSEMLRXARRSDLVFSGQGGRERGDRPFEVKDGVYRIFSPGLLWGQRQVGVGYGSKGVLHTMWHVTRGAALSIDDAVAGPYWADVKEDVVCYGGAWSLEEKWKGETVQVHAFPPGRAHEVHQCQPGELLLDTGRRXGAVPIDLAKGTSGSPILNSQGVVVGLYGNGLKTNETYVSSIAQGEAEKSRPNLPPAVXGTGWTAKGQITVLDMHPGSGKTHRVLPELIRQCIDRRLRTLVLAPTRVVLKEMERALNGKRVRFHSPAVGDQQVGGAIVDVMCHATYVNRRLLPQGRQNWEVAIMDEAHWTDPHSIAARGHLYTLAKENKCALVLMTATPPGKSEPFPESNGAISSEEKQIPDGEWRDGFDWITEYEGRTAWFVPSIAKGGIIARTLRQKGKSVICLNSKTFEKDYSRVRDEKPDFVVTTDISEMGANLDVSRVIDGRTNIKPEEVDGRVELTGTRRVTTASAAQRRGRVGRQEGRTDEYIYSGQCDDDDSGLVQWKEAQILLDNITTLRGPVATFYGPEQDKMPEVAGHFRLTEEKRKHFRHLLTHCDFTPWLAWHVAANVSSVTSRNWTWEGPEENTVDEANGDLVTFRSPNGAERTLRPVWRDARMFREGRDIREFVAYASGRRSFGDVLSGMSGVPELLRHRCVSAMDVFYTLMHEEPGSRAMRMAERDAPEAFLTVVEMMVLGLATLGVVWCFVVRTSISRMMLGTLVLLASLALLWAGGVSYGNMAGVALIFYTLLTVLQPEAGKQRSSDDNKLAYFLLTLCSLAGLVAANEMGFLEKTKADLSTVLWSXXXELRSWEEWTNIDIQPARSWGTYVLVVSLFTPYIIHQLQTKIQQLVNSAVATGAQAMRDLGGGAPFFGVAGHVMALGVVSLVGATPTSLVVGVGLAAFHLAIVVSGLEAELTQRAHKVFFSAMVRNPMVDGDVINPFGEGEAKPALYERKMSLVLAIVLCLMSVVMNRTVPSITEASAVGLAAAGQLLRPEADTLWTMPVACGLSGVVRGSLWGFLPLGHRLWLRASGSRRGGSEGDTLGDLWKRKLNGCTKEEFFAYRRTGILETERDKARELLRRGETNMGLAVSRGTAKLAWLEERGYATLKGEVVDLGCGRGGWSYYAASRPAVMSVKAYTIGGKGHETPKMVTSLGWNLIKFRAGMDVFSMQPHRADTIMCDIGESNPDAVVEGERTRKVILLMEQWKNRNPTATCVFKVLAPYRPEVIEALHRFQLQWGGGLVRTPFSRNSTHEMYYSTAVTGNIVNSVNIQSRKLLARFGDQRGPTRVPELDLGVGTRCVVLAEDKVKEKDVQERISALREQYGETWHXDREHPYRTWQYWGSYRTAPTGSAASLINGVVKLLSWPWNAREDVVRMAMTDTTAFGQQRVFKEKVDTKAQEPQPGTKVIMRAVNDWILERLARKSKPRMCSREEFIAKVKSNAALGAWSDEQNRWSSAKEAVEDPAFWQLVDEERERHLAGRCAHCVYNMMGKREKKLGEFGVAKGSRAIWYMWLGSRFLEFEALGFLNEDHWASRGSSGSGVEGISLNYLGWHLKKLSTLEGGLFYADDTAGWDTKVTNADLEDEEQLLRYMEGEHKQLAATIMQKAYHAKVVKVARPSRDGGCIMDVITRRDQRGSGQVVTYALNTLTNIKVQLIRMMEGEGVIEASDAHNPRLLRVERWLRDHGEERLGRMLVSGDDCVVRPVDDRFGKALYFLNDMAKTRKDIGEWEHSVGFSNWEEVPFCSHHFHELVMKDGRALIVPCRDQDELVGRARVSPGCGWSVRETACLSKAYGQMWLLSYFHRRDLRTLGLAICSAVPVDWVPTGRTTWSIHASGAWMTTEDMLDVWNRVWILDNPFMHSKEKXXEWRDVPYLPKSHDMLCSSLVGRKERAEWAKNIWGAVEKVRKMIGXXKFKDYLSCMDRHDLHWELKLESSII

SEQ ID NO: 265823 - protein, 3414 aa, Tick-borne encephalitis virus
  MOD_RES (99)..(113): Any amino acid
  MOD_RES (172)..(178): Any amino acid
  MOD_RES (198)..(201): Any amino acid
  MOD_RES (231)..(236): Any amino acid
  MOD_RES (246)..(253): Any amino acid
  MOD_RES (267)..(268): Any amino acid
  MOD_RES (282)..(318): Any amino acid
  MOD_RES (377)..(386): Any amino acid
  MOD_RES (535)..(538): Any amino acid
  MOD_RES (568)..(571): Any amino acid
  MOD_RES (620)..(620): Any amino acid
  MOD_RES (655)..(661): Any amino acid
  MOD_RES (697)..(697): Any amino acid
  MOD_RES (789)..(801): Any amino acid
  MOD_RES (960)..(961): Any amino acid
  MOD_RES (993)..(1002): Any amino acid
  MOD_RES (1027)..(1029): Any amino acid
  MOD_RES (1079)..(1083): Any amino acid
  MOD_RES (1109)..(1113): Any amino acid
  MOD_RES (1216)..(1218): Any amino acid
  MOD_RES (1251)..(1255): Any amino acid
  MOD_RES (1294)..(1296): Any amino acid
  MOD_RES (1307)..(1313): Any amino acid
  MOD_RES (1353)..(1353): Any amino acid
  MOD_RES (1365)..(1366): Any amino acid
  MOD_RES (1391)..(1410): Any amino acid
  MOD_RES (1486)..(1486): Any amino acid
  MOD_RES (1615)..(1615): Any amino acid
  MOD_RES (1673)..(1673): Any amino acid
  MOD_RES (1688)..(1698): Any amino acid
  MOD_RES (1716)..(1722): Any amino acid
  MOD_RES (1787)..(1791): Any amino acid
  MOD_RES (1878)..(1881): Any amino acid
  MOD_RES (1899)..(1923): Any amino acid
  MOD_RES (2023)..(2038): Any amino acid
  MOD_RES (2219)..(2223): Any amino acid
  MOD_RES (2241)..(2244): Any amino acid
  MOD_RES (2279)..(2281): Any amino acid
  MOD_RES (2301)..(2305): Any amino acid
  MOD_RES (2387)..(2400): Any amino acid
  MOD_RES (2498)..(2500): Any amino acid
  MOD_RES (2571)..(2598): Any amino acid
  MOD_RES (2806)..(2806): Any amino acid
  MOD_RES (2817)..(2824): Any amino acid
  MOD_RES (2842)..(2849): Any amino acid
  MOD_RES (3047)..(3056): Any amino acid
  MOD_RES (3089)..(3089): Any amino acid
  MOD_RES (3226)..(3226): Any amino acid
  MOD_RES (3269)..(3280): Any amino acid
  MOD_RES (3342)..(3343): Any amino acid
  MOD_RES (3388)..(3389): Any amino acid
MVKKAILKGKGGGPPRRVSKETAKKTRQSRVRMPNGLVLMRMMGILWHAVAGTARNPVLKSFWNSVPLRQATAALRKIKRTVSALMVGLQKRGKRRSAXXXXXXXXXXXXXXXALAATVRKERDGSTVIRAEGRDAATQVRVENGTCVILVTDMGSWCDDSLSYECVTIDQXXXXXXXDCFCRNVDGVHLEYGRCGKXXXXRTRRSVLIPSHAQGELTGRGRKWLEGDSLXXXXXXVEGWVWKNRXXXXXXXXVVWLTLESVVTRVXXLVALFCLAPVYASXXXXXXXXXXXXXXXXXXXXXXXXXXXXXXXXXXXXXPSMDVWLDAIYQESPAKTREYCLHVKLSDTKVAARCPTTGPATLAEEHQGGTVCKRDQXXXXXXXXXXLFGKGSIVACVKAACEAKKKATGHVYDANKIVYPIKVEPHTGDYVAPHETHSGRKTASFTISSEKTILTMGEYGDVSLLCKVPSGVDLAQTVILELDKTVEHLPTAWQVRRDWFNDLALPWRHEGAQQWNNAERLVEFGVPHAVKMDVXXXXDQTGVLLKALAGVPVAHIEGAKYHLKSGHXXXXVGLEKLKMKGLTYTMCDKTKFTWKRTPTDSGHDTVVMEVTFSGTKPCRXPVRAVAHGFPDVNVAMLITPNPTIETNGGGFIEMXXXXXXXIIYVGELSYQWFQKGSSIGRVFQKTKRGIERLTVIXEHAWDFGSAGGFLSSIGKAVHTVLGGAFNSIFGGVGFLPKLLLGVVLAWLGLNMRNPTMSMGFLLAGVLVLAMTLGVGADVGGAVDTERMEXXXXXXXXXXXXXSEWYDNYAFYPETPGALASAIKETFEEGSCGVLPQNRLEMAMWRSSVTELNLALAEGEANLTVVVDKFDPTDYRGGVSGLLRKGKDIKVSWKSWGQSMIWSIPEAPRRFMVGTEGSNECPLERRKTGIFTVAEFGVGLRTKVFLDFRQEPTHECDTGVXXAAVKNGMAIHTDQSLWMRSMKNETGTYIVELXXXXXXXXXXPASHTIDNADVVDSESFLPASLAGXXXWYNRIPGYAEQVKGPWKHTPIRVIREECPGTKVTINAKCDRRGASVRSTXXXXXVIPEWCCRACTMPPVTIRTGTDCWYXXXXXPVHDQGGLIRSTVVADNGELLSEGGVPGIVALFVVLEYIIRRRPSTGTTVVWGGVVVLALLVTGMVKVESLVRYVVAVGIAFHFELGPEIVALMLLQAVFELXXXLLSAFALRRSLTVREMVTTYFLLLVLELGLPGXXXXXFWRWGDALAMGALIFRACTAEGKTGAGLLLMALMTQRDXXXVHHGLVCFLSXXXXXXXWRLLKGHREQKGLTWVVPLARLLGGEGSGIRLLAFWELSXHGRRRSFSEPLXXVGVMLTLAGGMMRHTPQEALCALAXXXXXXXXXXXXXXXXXXXXEWSGCVEWHPELVNEGGEVSLRVRQDAMGNFHLTELEKEERMMAFWLIAGLAASAVHWSGIIGVMGLWTLTEMLRXSRRSDLVFSGQGGRERGDKPFEVRDGVYRIFSPGLFWGQRQVGVGYGFRGVLHTMWHVTRGAALSINDAVAGPYWADVREDVVCYGGAWSLEEKWRGETVQVHAFPPGKAHEVHQCQPGELILDTGRKXGAIPIDLVKGTSGSPILNAQGAVVGLYGNGLKTNGTYVSSIAQGEVEKSRPNLPQAVXGTGWTSKGQITVLDXXXXXXXXXXXLPELIRQCTDRRLRTLVXXXXXXXLKEMERALSGKRVRFHSPAVSDQQAGGSIVDLMCHTTYVSRRLLPQGRQNWEVATIDEAHWTDPXXXXXRGHLYTLAQENKCALVLMTATRPGKSEPFPESNGAITSEERQIPEGEWRDGFDWITEYEGRTAWFVPSIAKGGAIARALRQKGKSVXXXXSKTFEKDYTRVRDEKPDXXXXXXXXXXXXXXXXXXXXXXXXXIKPEEVDGKVELIGTRRVTTASAAQRRGRVGRQDGRIDEYIYSGQCDDDDGGLVQWKEAQILLDDIITLRGPVVTFYGPEQDRMPEVAGHYRLTEEKRKXXXXXXXXXXXXXXXXWHVAANVSSVTDRSWTWEGPEANAVDEASGDLVTFKSPNGAERTLRPVWKDARMFKEGRDIKEFIAYASGRRSFGDVLTGMSGVPELLRHRCVSALDVFYTLMHEEPGSRAMKMAERDAPEAFLTMAEVMVLGLATLGVIWCFVARASISRMMLGTLVLLASLLLLWAGGVGYGNMAGVAXXXXXLLTVLQPEVGKQRSSDDXXXXYFLLTLCSVAGLVAANEMGFLERTKADLSTALWSXXXEPRPWSEWTNVDIQPARSWXXXXXVVSLFTPYMIHQLQTKIQQLVNSAVASGAQAMRDLGGGTPFFGVAGHVMTLGVVSLIGATPTSLMVGVGLAALHLAIVVSGXXXXXXXXXXXXXXSAMVRNPMLDGDVINPFGEGETKPALYERKMSLVLAIALCLMSVVMNRTVASITEASAVGLAAVGQLLRPEVDTLWTMPVACGMSSVVTGSLWGFLPXXXRLWLRASGGRRGGADGDTLGDLWKRRLNNCTREEFFVYRRTGILETERDKARELLRKGETNTGLAVSRGTXXXXXXXXXXXXXXXXXXXXXXXXXXXXSYYAASRPAVMSVRAYTIGGRGHEAPRMVTSLGWNLIKFRSGVDVFSMQPHRADTVMCDIGESSPDAAVEGERTRRVILLMEQWKNRNPTAACVFKVLAPYRPEVIEALHRFQLRWGGGLVRTPFSRNSTHEMYYSTAITGNIVNSVNVQSRKLLARFGDQRGPTRVPELDLGIGTRCVVLAEDKVKEQDVQERIRALREQYSETWHXDEEHPYRTWQXXXXXXXXPTGSAASLTNGVVKLLSXXXXXXXXVVRMAMTDPTPFGQQRVFKDNADTKAQEPQPGTRVIMRAVNDWILERLAQKSKPRMCSKEEFIAKVRSSAALGAWSDEQNRWASAREAVEDPAFWHLVDEERERHLMGRCAHCVHNIMGKREKKLGEFGVSKGSRAMWYMWLGSRFQEFEALGFLNEDHWASRESSGAGVEGISLNYLGWYLKGLSTLNGGLFYADDXXXXXXXXXXADLEDEEQILRYMEGEHKQLATTVMQKAYHAKXVKVARPSRDGGCVMDVITRRDQRGSVQVVTYALNTHTNIKVQLIRMMEGEGVIEAADAHNPRLLRVERWLKEYGGERLGRMLVSGDDCVVRPLDDRFSRALYFLNDMAKTRKDVGEWEHSAGFSSVEAVPFCSHHFXELVMKDGRSLVVPCRDQDELVGRARISPGCGWSIRETACLSKXXXXXXXXXXXXRRDLRTLGLAINSAVPADWVPTGRTTWSIHASGAWMTTENMLDVWNRVWILDNPFMQNKEKXXEWRDVPYLPKAQDMLCSSLVGRRERAEWARNIWGAVEKVRRMIGXXKFRDYPSCMDRHDLHWELRLESSII

SEQ ID NO: 265824 - protein, 3414 aa, Tick-borne encephalitis virus
  MOD_RES (12)..(13): Any amino acid
  MOD_RES (99)..(113): Any amino acid
  MOD_RES (135)..(142): Any amino acid
  MOD_RES (165)..(180): Any amino acid
  MOD_RES (196)..(207): Any amino acid
  MOD_RES (225)..(253): Any amino acid
  MOD_RES (267)..(268): Any amino acid
  MOD_RES (280)..(323): Any amino acid
  MOD_RES (344)..(354): Any amino acid
  MOD_RES (374)..(390): Any amino acid
  MOD_RES (464)..(477): Any amino acid
  MOD_RES (495)..(503): Any amino acid
  MOD_RES (523)..(550): Any amino acid
  MOD_RES (566)..(577): Any amino acid
  MOD_RES (620)..(679): Any amino acid
  MOD_RES (696)..(700): Any amino acid
  MOD_RES (722)..(726): Any amino acid
  MOD_RES (751)..(756): Any amino acid
  MOD_RES (768)..(816): Any amino acid
  MOD_RES (931)..(942): Any amino acid
  MOD_RES (960)..(972): Any amino acid
  MOD_RES (991)..(1003): Any amino acid
  MOD_RES (1021)..(1039): Any amino acid
  MOD_RES (1076)..(1091): Any amino acid
  MOD_RES (1104)..(1116): Any amino acid
  MOD_RES (1131)..(1152): Any amino acid
  MOD_RES (1203)..(1219): Any amino acid
  MOD_RES (1251)..(1255): Any amino acid
  MOD_RES (1265)..(1268): Any amino acid
  MOD_RES (1294)..(1296): Any amino acid
  MOD_RES (1307)..(1313): Any amino acid
  MOD_RES (1353)..(1353): Any amino acid
  MOD_RES (1365)..(1373): Any amino acid
  MOD_RES (1384)..(1414): Any amino acid
  MOD_RES (1428)..(1449): Any amino acid
  MOD_RES (1486)..(1486): Any amino acid
  MOD_RES (1514)..(1517): Any amino acid
  MOD_RES (1543)..(1543): Any amino acid
  MOD_RES (1572)..(1573): Any amino acid
  MOD_RES (1583)..(1604): Any amino acid
  MOD_RES (1615)..(1615): Any amino acid
  MOD_RES (1643)..(1654): Any amino acid
  MOD_RES (1673)..(1673): Any amino acid
  MOD_RES (1684)..(1722): Any amino acid
  MOD_RES (1767)..(1819): Any amino acid
  MOD_RES (1845)..(1852): Any amino acid
  MOD_RES (1874)..(1927): Any amino acid
  MOD_RES (1941)..(1947): Any amino acid
  MOD_RES (1999)..(2005): Any amino acid
  MOD_RES (2015)..(2041): Any amino acid
  MOD_RES (2078)..(2079): Any amino acid
  MOD_RES (2093)..(2094): Any amino acid
  MOD_RES (2121)..(2135): Any amino acid
  MOD_RES (2192)..(2193): Any amino acid
  MOD_RES (2211)..(2258): Any amino acid
  MOD_RES (2279)..(2281): Any amino acid
  MOD_RES (2296)..(2323): Any amino acid
  MOD_RES (2364)..(2369): Any amino acid
  MOD_RES (2379)..(2413): Any amino acid
  MOD_RES (2495)..(2505): Any amino acid
  MOD_RES (2571)..(2601): Any amino acid
  MOD_RES (2632)..(2632): Any amino acid
  MOD_RES (2648)..(2653): Any amino acid
  MOD_RES (2697)..(2697): Any amino acid
  MOD_RES (2722)..(2728): Any amino acid
  MOD_RES (2740)..(2755): Any amino acid
  MOD_RES (2806)..(2806): Any amino acid
  MOD_RES (2817)..(2860): Any amino acid
  MOD_RES (2878)..(2890): Any amino acid
  MOD_RES (2973)..(3005): Any amino acid
  MOD_RES (3023)..(3024): Any amino acid
  MOD_RES (3046)..(3069): Any amino acid
  MOD_RES (3087)..(3093): Any amino acid
  MOD_RES (3107)..(3136): Any amino acid
  MOD_RES (3171)..(3173): Any amino acid
  MOD_RES (3197)..(3201): Any amino acid
  MOD_RES (3224)..(3226): Any amino acid
  MOD_RES (3261)..(3281): Any amino acid
  MOD_RES (3306)..(3307): Any amino acid
  MOD_RES (3325)..(3329): Any amino acid
  MOD_RES (3342)..(3343): Any amino acid
  MOD_RES (3375)..(3376): Any amino acid
  MOD_RES (3388)..(3389): Any amino acid
MARKAILKGKGXXPPRRVSKETATKTRQPRVQMPSGLVLMRMLGFLWHAIAGTVRSPVLKAFWKSVPLKQAMTALRKIKMAVSALMVGLQRRGKKRSTXXXXXXXXXXXXXXXTFAATVRKEGDDTTVIRAEGRXXXXXXXXENGTCVILATDMGAWCDDSLSYXXXXXXXXXXXXXXXXFCRNVDRVYLEYGRCXXXXXXXXXXXXLIRSHAQGELTGRGRKWXXXXXXXXXXXXXXXXXXXXXXXXXXXXXIVWLTVESVVTRIXXVAVLFCLAPVYXXXXXXXXXXXXXXXXXXXXXXXXXXXXXXXXXXXXXXXXXXXXWLDAIYQENPAQTREYCLHAXXXXXXXXXXXPTMGPATLAEQHQSGTVCKXXXXXXXXXXXXXXXXXGSIVTCVKVACEAKKKATGHVYDANRIVYTIKVEPHTGDYVAVNETHSGRKTPSFTVSSEKTILNMGDYGDVSXXXXXXXXXXXXXXVILELDKTLEHLPTAWQXXXXXXXXXALPWKHEGAQHWNNAERLVXXXXXXXXXXXXXXXXXXXXXXXXXXXXVPVAHIDGAKYHLKSXXXXXXXXXXXXKMNGLTYTVCDKTKFAWKRAPTDSGHDTVVMEVSFSGTKPCRXXXXXXXXXXXXXXXXXXXXXXXXXXXXXXXXXXXXXXXXXXXXXXXXXXXXXXXXXXXXGRVFQKTRRGIERLTVXXXXXWDFGSTGGFLASIGKALHTVLXXXXXSLFGGVGFLPKILMGAALAWLGLNXXXXXXSMSFLLAGVLVXXXXXXXXXXXXXXXXXXXXXXXXXXXXXXXXXXXXXXXXXXXXXXXXXALASAIKETFEEGNCGILPQNRLEMAMWRSASTELNLALAEGEANLTVMVDKFDPTDYRGGVPGLLKKGKDIKVSWKSWGQAMIWSIPEASRRFMVGTEGQSECPPERRKTGVFXXXXXXXXXXXXVFVDFRQEATHECDTGVXXXXXXXXXXXXXDQSLWMKSVRNETGTYIVXXXXXXXXXXXXXASHTIDNADVVDSESFLXXXXXXXXXXXXXXXXXXXQVKGPWKYTPIRVTREECPGTTVTISADCDRRGASVXXXXXXXXXXXXXXXXTCTLPPVTIRTGXXXXXXXXXXXXXDQGGLVRSTVVADNXXXXXXXXXXXXXXXXXXXXXXIRRRPATGTAVVWGGFIVFALLVTGLVRMESLVRYVVAVGITFHFELGPEXXXXXXXXXXXXXXXXXLSAFALRRGLTVREMVITYFLLLVLELGLPYXXXXXLWRWGDALAXXXXILRACTAEGKAGVGLLLMALITQQDXXXVHYGLIIFLGXXXXXXXWRLLEGHREQKGLSWIVPLAGLMGGEGSGIRLLSFWELSXHGKRRSFSEPLXXXXXXXXXASGMMRHTPQXXXXXXXXXXXXXXXXXXXXXXXXXXXXXXXCVEWYPELVNEGGXXXXXXXXXXXXXXXXXXXXXXERMMAFWLLAGLAASAIHWSGILGVMGLWTLSEMMRXARRSGLVFSGQGRGERGDRPFEVRDGVXXXXSPGLFWGQNQVGVGYGFRGVLHTMWXVTRGAALYVDDAVVGPYWSEVKEDVVCYXXTWSLEEKWKXXXXXXXXXXXXXXXXXXXXXXGELLLDTGGRXGAILIDLSKGTSGSPILNAQGAVVGLYXXXXXXXXXXXXSIAQGEAERSRPSLPPAVXGMGWTAKGQIXXXXXXXXXXXXXXXXXXXXXXXXXXXXXXXXXXXXXXXLKEMERALTGKRVRFHSPAVGDQQVGGAIVDVMCHATYVSRRLLXXXXXXXXXXXXXXXXXXXXXXXXXXXXXXXXXXXXXXXXXXXXXXXXXXXXXFPESNGAITSEEKQIPNGEWRDGFDXXXXXXXXSAWFVPSIAKGGVIARTLRQKXXXXXXXXXXXXXXXXXXXXXXXXXXXXXXXXXXXXXXXXXXXXXXXXXXXXXXEVDGRVELIGTRRXXXXXXXPRRGRVGRHEGRIDEYIYSGQCDEDDSVLVQWKEAQILLDNITTLRGPVVTXXXXXXXKMPEVAGHYXXXXXXXXXXXXXXXXXXXXXXXXXXXAANVSGVTSRSWTWEGPEENAVDEANGGLVTFRSPNXXERTLKPVWRDARMXXEGRDIREFIAYASGRRSIGDVLTGMSXXXXXXXXXXXXXXXVFYTLMHDKPDSSAMRMAERDAPEAFLTMVEMLVLGLGTLGVVWCFVVRASISRMMXXTLVLLASLALLWAGGVGXXXXXXXXXXXXXXXXXXXXXXXXXXXXXXXXXXXXXXXXXXXXXXXXANEMGLLEKTKADLSTVLWAXXXEPRSWGEWTNIDIQXXXXXXXXXXXXXXXXXXXXXXXXXXXXQLVNSAVVTGAQAMRDLGGGAPFFGVAGHVVSLGVVSLVGXXXXXXMVGVGLAAFXXXXXXXXXXXXXXXXXXXXXXXXXXXXXXXXXXXIYPFGEGEAKPALYERKMSLVLAVVLCLIAVVMNRTVPSITEAAAVGLAAAGQLLSPEEDTLWTMPVACGLSGVVTGSLWGXXXXXXXXXXXASGSRRGGSDGDTLGDLWKQRLNSCTKEEFFIYRRAGIMETERDKARELLKKGETNVGLAVSRGTXXXXXXXXXXXXXXXXXXXXXXXXXXXXXXXAASRPSVMNVRAYTIGGKGHETPRMVTSLGXNLIKFRAGVDVFSMQXXXXXXIMCDIGESNPDAAVEGEKTRKVILLMEQWKNRNPAAACVFKVLXPYRPKVIEALHRFQLKWGGGLVRTXXXXXXXHKVYYSTAVTGXXXXXXXXXXXXXXXXFAGQRGPTKVPELDLGVGTRCVVLAEDRVREKDVQERIKALKEQYGETWHXDGEHPYRTWQXXXXXXXXXXXXXXXXXXXXXXXXXXXXXXXXXXXXXXXXXXXXAWQQRVFKKNADTKAQEXXXXXXXXXXXXXDWILERLAQRSNSRIHSKEEFIAKVKSNAALGAWSNEQNRWSNAKEAVEDPVFWRLVDEERERDLAGRSAHGVFNIMGKREKXXXXXXXXXXXXXXXXXXXXXXXXXXXXXXXXXEDHWASREFSGSGVEGIXXNYLGWHLKGLSIPEGGLFYADXXXXXXXXXXXXXXXXXXXXXXXXEGEHRQLAATVMQKAYHXXXXXXXRPSREGGCVMDVIXXXXXXXXXXXXXXXXXXXXXXXXXXXXXXEGEGVIEATDAHNPRLLRVERWLREHGGERLGRMXXXGDDCVVRPIDDRFSGALYFLNDMXXXXXDIGEWEHSAGLSGWEAVPFCSHXXXELVMKDGRTLVVPCRDQDELVGRAPVSPGCGWSIXXXXXXXXXXXXXXXXXXXXXRDLRTLGFAICSAVPIDWVPTGRTXXSIHASGAWITTEDMLDVXXXXXILDNPFMQNKERXXEWRDIPYLPKAHDMLCSSLVGRKERAEWARNXXGAVEKVRKIVGXXRCKDYLSCMDRHYLHWELKLEGSII

SEQ ID NO: 265825 - protein, 3414 aa, Tick-borne encephalitis virus
  MOD_RES (1)..(15): Any amino acid
  MOD_RES (38)..(41): Any amino acid
  MOD_RES (99)..(113): Any amino acid
  MOD_RES (132)..(147): Any amino acid
  MOD_RES (159)..(253): Any amino acid
  MOD_RES (267)..(268): Any amino acid
  MOD_RES (279)..(323): Any amino acid
  MOD_RES (341)..(359): Any amino acid
  MOD_RES (372)..(391): Any amino acid
  MOD_RES (408)..(412): Any amino acid
  MOD_RES (425)..(504): Any amino acid
  MOD_RES (522)..(588): Any amino acid
  MOD_RES (604)..(702): Any amino acid
  MOD_RES (720)..(731): Any amino acid
  MOD_RES (751)..(821): Any amino acid
  MOD_RES (839)..(839): Any amino acid
  MOD_RES (856)..(874): Any amino acid
  MOD_RES (887)..(888): Any amino acid
  MOD_RES (908)..(908): Any amino acid
  MOD_RES (918)..(942): Any amino acid
  MOD_RES (954)..(973): Any amino acid
  MOD_RES (990)..(1009): Any amino acid
  MOD_RES (1020)..(1039): Any amino acid
  MOD_RES (1074)..(1153): Any amino acid
  MOD_RES (1189)..(1219): Any amino acid
  MOD_RES (1237)..(1272): Any amino acid
  MOD_RES (1294)..(1296): Any amino acid
  MOD_RES (1307)..(1313): Any amino acid
  MOD_RES (1345)..(1353): Any amino acid
  MOD_RES (1363)..(1458): Any amino acid
  MOD_RES (1475)..(1475): Any amino acid
  MOD_RES (1486)..(1486): Any amino acid
  MOD_RES (1514)..(1517): Any amino acid
  MOD_RES (1535)..(1544): Any amino acid
  MOD_RES (1571)..(1615): Any amino acid
  MOD_RES (1641)..(1658): Any amino acid
  MOD_RES (1672)..(1673): Any amino acid
  MOD_RES (1684)..(1734): Any amino acid
  MOD_RES (1754)..(1823): Any amino acid
  MOD_RES (1841)..(1856): Any amino acid
  MOD_RES (1874)..(1951): Any amino acid
  MOD_RES (1965)..(1966): Any amino acid
  MOD_RES (1991)..(2043): Any amino acid
  MOD_RES (2056)..(2060): Any amino acid
  MOD_RES (2076)..(2139): Any amino acid
  MOD_RES (2155)..(2156): Any amino acid
  MOD_RES (2176)..(2176): Any amino acid
  MOD_RES (2187)..(2201): Any amino acid
  MOD_RES (2211)..(2266): Any amino acid
  MOD_RES (2279)..(2281): Any amino acid
  MOD_RES (2292)..(2338): Any amino acid
  MOD_RES (2363)..(2428): Any amino acid
  MOD_RES (2478)..(2480): Any amino acid
  MOD_RES (2493)..(2506): Any amino acid
  MOD_RES (2518)..(2526): Any amino acid
  MOD_RES (2546)..(2548): Any amino acid
  MOD_RES (2566)..(2603): Any amino acid
  MOD_RES (2628)..(2653): Any amino acid
  MOD_RES (2663)..(2665): Any amino acid
  MOD_RES (2675)..(2681): Any amino acid
  MOD_RES (2693)..(2704): Any amino acid
  MOD_RES (2715)..(2774): Any amino acid
  MOD_RES (2801)..(2806): Any amino acid
  MOD_RES (2817)..(2891): Any amino acid
  MOD_RES (2911)..(2917): Any amino acid
  MOD_RES (2972)..(3008): Any amino acid
  MOD_RES (3022)..(3024): Any amino acid
  MOD_RES (3045)..(3071): Any amino acid
  MOD_RES (3083)..(3136): Any amino acid
  MOD_RES (3170)..(3173): Any amino acid
  MOD_RES (3196)..(3204): Any amino acid
  MOD_RES (3223)..(3228): Any amino acid
  MOD_RES (3244)..(3283): Any amino acid
  MOD_RES (3306)..(3311): Any amino acid
  MOD_RES (3323)..(3331): Any amino acid
  MOD_RES (3342)..(3345): Any amino acid
  MOD_RES (3357)..(3364): Any amino acid
  MOD_RES (3375)..(3377): Any amino acid
  MOD_RES (3388)..(3389): Any amino acid
  MOD_RES (3399)..(3402): Any amino acid
XXXXXXXXXXXXXXXRRASKEAARKTRQSRVQMPSGLXXXXMMGFLWHAVAGTVRSPVLKSFWNSVPLKQATAALRKIKRAVSTLMIGLQKRGKRRSVXXXXXXXXXXXXXXXTIAATVRRERDDTTVIRAXXXXXXXXXXXXXXXXVIMATDMGSWCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVWMTLESVVARVXXVVALLCLAPVXXXXXXXXXXXXXXXXXXXXXXXXXXXXXXXXXXXXXXXXXXXXXWLDAIYQEKPAKTREYCXXXXXXXXXXXXXXXXXXXATLTEEHQGGTVXXXXXXXXXXXXXXXXXXXXSIVTCVKVSCEAKKKAXXXXXDPNKIVYPVKVEXXXXXXXXXXXXXXXXXXXXXXXXXXXXXXXXXXXXXXXXXXXXXXXXXXXXXXXXXXXXXXXXXXXXXXXXXXXXXXXXLPWRHEGARNWNNAERLXXXXXXXXXXXXXXXXXXXXXXXXXXXXXXXXXXXXXXXXXXXXXXXXXXXXXXXXXXXXXXXXXXXKTKFTWRRTPTDSGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFGSTGGLLSSIGKALHTXXXXXXXXXXXXVGFIPKLLLGMALAWLGLNXXXXXXXXXXXXXXXXXXXXXXXXXXXXXXXXXXXXXXXXXXXXXXXXXXXXXXXXXXXXXXXXXXXXXXXIKEAFEEGTCGILPQNRXEMAMWRSSSTELNLALXXXXXXXXXXXXXXXXXXXRGGIPGLLRKGKXXRVSWRSWGQSIIWSIPEAPXRFMVGIEGSXXXXXXXXXXXXXXXXXXXXXXXXXVFLDFRQEATHXXXXXXXXXXXXXXXXXXXXQSLWMKSVRNETGTYIXXXXXXXXXXXXXXXXXXXXNPEVVDSELFXXXXXXXXXXXXXXXXXXXXQVKGPWKYLPIRVIRGECPGTRVIITADCDKRGAXXXXXXXXXXXXXXXXXXXXXXXXXXXXXXXXXXXXXXXXXXXXXXXXXXXXXXXXXXXXXXXXXXXXXXXXXXXXXXXXRRRPSTGTTAVWGGLIVLALLVTGMVKVESLVRYVXXXXXXXXXXXXXXXXXXXXXXXXXXXXXXXLSAFALRRSLTVREMVIXXXXXXXXXXXXXXXXXXXXXXXXXXXXXXXXXXXXCTAEGKAGVGLLLMPLLTKRGXXXVHYGLIFFLSXXXXXXXWRLLEGHREQKGLSWTVPMAGLVGGEGSGIRXXXXXXXXXSGRRRSFSEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLSASAIHWSGIIGVXGLWTLTKMLRXARRSDLAFSGQGNRERGDKPFEVRDGVXXXXSPGLFWGQSQVGVGYGSXXXXXXXXXXTRGAALSIDDAVAGPYWAEVKEDVVCXXXXXXXXXXXXXXXXXXXXXXXXXXXXXXXXXXXXXXXXXXXXXGAVLIDLAKGTSRSPIINSQGVVVGXXXXXXXXXXXXXXXXXXGEAEKSRPSLPPAXXGIGWTAKGQIXXXXXXXXXXXXXXXXXXXXXXXXXXXXXXXXXXXXXXXXXXXXXXXXXXXVRFHSPVVGDQQMGGAIVDXXXXXXXXXXXXXXXXXXXXXXXXXXXXXXXXXXXXXXXXXXXXXXXXXXXXXXXXXXXXXXXXXXXXXXNRGITSEVRQIPNGEWRXXXXXXXXXXXXXXXXVPSIVKGGIIARALRQKXXXXXXXXXXXXXXXXXXXXXXXXXXXXXXXXXXXXXXXXXXXXXXXXXXXXXXXXXXXXXXXXXXXXXXXXXXXXXXRVGRQEGRIDEYIXXGQCDDYDSGLVQWKEGQILLDNITXXXXXXXXXXXXXXXXXXXXXXXXXXXXXXXXXXXXXXXXXXXXXXXXXXXXXNVSSVTSRSWTWXXXXXNAVDEASGGLVTFRSXXXXXXXXXXXXXXXXXXXXXXXXXXXXXXXXXXXXXXXXXXXXXXXXXXXXXXXXXXXXXXXXLMHEEPGSSAMRMAEXXAPEAFLTLVEMMVLGLGTLXVVWCFVARTSXXXXXXXXXXXXXXXVLLWAGGVSXXXXXXXXXXXXXXXXXXXXXXXXXXXXXXXXXXXXXXXXXXXXXXXXXXXXXXXXKTKADLSAVLWSXXXEMRSWEEWTNXXXXXXXXXXXXXXXXXXXXXXXXXXXXXXXXXXXXXXXXXXXXXXXDLGGGAPFLGVAGHVMSLGVVSLVXXXXXXXXXXXXXXXXXXXXXXXXXXXXXXXXXXXXXXXXXXXXXXXXXXXXXXXXXXXXXXXXXXRRMSLVLATVLCLMSVVMNRTMLSITEASAVGLAAAGQLLRPEEDTLWTXXXACGLSGVVTGSLXXXXXXXXXXXXXXSGSRRGGSDGDXXXXXXXXXLNSCTREEFFVYRRTGIMEXXXDKARELLKRGETNVGLAXXXXXXXXXXXXXXXXXXXXXXXXXXXXXXXXXXXXXXSRPAVMNVKAYTIGGRGHETPKMVXXXXXXXXXXXXXXXXXXXXXXXXXXVMCDIGESNXXXVVEGEKTRKXXXXXXXWKIRNPTATCVXXXXXXXXXXXXETLHRFQLQWXXXXXXXXXXXXXXXXXXXXXXXXXXXXXXXXXXXXXXXXXXXXXXXXXXXXXXXXXXXXRCVFLAEDKVKEQDVRERINALREQYXXXXXXNAEHPYRTWQXXXXXXXXXXXXXXXXXXXXXXXXXXXXXXXXXXXXXXXXXXXXXXXXXXXXXXXXXXXXXXXXXXXXXXXXXXXWILERLARKNRPRMCSREEXXXXXXXNAALGAWSEEQNRWSGAREAVEDPAFWKLVDEERERHLAGRCAHCAYNMMGKREXXXXXXXXXXXXXXXXXXXXXXXXXXXXXXXXXXXXXWASRGFSGSGVEGXXXNYLGWYLKELSTPEGGLFYAXXXXXXXXXXXXXXXXXXXXXXXXXXXEHKQLAATVMQXXXXXXXXXXXXXXXXXXXXXXXXXXXXXXXXXXXXXXXXXXXXXXXXXXXXXXEGEGVVEATDAHNPRLLRVERWLRNHGEERLGRXXXXGDDCVVRPVDDRFGRALYFLNDXXXXXXXXXEWEHSAGFASWEAVPFCSXXXXXXVMKDGRALVVPCRDQXXXXXXXXXXXXXXXXXXXXXXXXXXXXXXXXXXXXXXXXLRTLGLTICSAVPTDWVPTGRTXXXXXXSGSWMTTEDMLXXXXXXXXXDNPFMHGKEKXXXXRNVPYLPKAHDXXXXXXXXRTERAEWAKNXXXAVEKVRKMMGXXKCKDYPSCMXXXXLHWNLKLESSIF

SEQ ID NO: 265826 - protein, 3414 aa, Tick-borne encephalitis virus
  MOD_RES (1)..(15): Any amino acid
  MOD_RES (27)..(60): Any amino acid
  MOD_RES (74)..(75): Any amino acid
  MOD_RES (99)..(114): Any amino acid
  MOD_RES (130)..(253): Any amino acid
  MOD_RES (267)..(268): Any amino acid
  MOD_RES (278)..(326): Any amino acid
  MOD_RES (336)..(391): Any amino acid
  MOD_RES (404)..(508): Any amino acid
  MOD_RES (521)..(588): Any amino acid
  MOD_RES (602)..(708): Any amino acid
  MOD_RES (718)..(731): Any amino acid
  MOD_RES (742)..(821): Any amino acid
  MOD_RES (832)..(839): Any amino acid
  MOD_RES (856)..(893): Any amino acid
  MOD_RES (908)..(975): Any amino acid
  MOD_RES (988)..(1052): Any amino acid
  MOD_RES (1074)..(1155): Any amino acid
  MOD_RES (1177)..(1284): Any amino acid
  MOD_RES (1294)..(1296): Any amino acid
  MOD_RES (1307)..(1313): Any amino acid
  MOD_RES (1341)..(1458): Any amino acid
  MOD_RES (1475)..(1476): Any amino acid
  MOD_RES (1486)..(1490): Any amino acid
  MOD_RES (1500)..(1548): Any amino acid
  MOD_RES (1566)..(1625): Any amino acid
  MOD_RES (1640)..(1673): Any amino acid
  MOD_RES (1684)..(1736): Any amino acid
  MOD_RES (1754)..(1828): Any amino acid
  MOD_RES (1840)..(1860): Any amino acid
  MOD_RES (1870)..(2142): Any amino acid
  MOD_RES (2152)..(2156): Any amino acid
  MOD_RES (2174)..(2281): Any amino acid
  MOD_RES (2292)..(2340): Any amino acid
  MOD_RES (2358)..(2430): Any amino acid
  MOD_RES (2442)..(2442): Any amino acid
  MOD_RES (2459)..(2460): Any amino acid
  MOD_RES (2478)..(2528): Any amino acid
  MOD_RES (2546)..(2548): Any amino acid
  MOD_RES (2559)..(2616): Any amino acid
  MOD_RES (2628)..(2776): Any amino acid
  MOD_RES (2801)..(2806): Any amino acid
  MOD_RES (2816)..(2892): Any amino acid
  MOD_RES (2911)..(2936): Any amino acid
  MOD_RES (2951)..(2954): Any amino acid
  MOD_RES (2964)..(3008): Any amino acid
  MOD_RES (3022)..(3024): Any amino acid
  MOD_RES (3036)..(3152): Any amino acid
  MOD_RES (3170)..(3178): Any amino acid
  MOD_RES (3196)..(3213): Any amino acid
  MOD_RES (3223)..(3283): Any amino acid
  MOD_RES (3297)..(3332): Any amino acid
  MOD_RES (3342)..(3347): Any amino acid
  MOD_RES (3357)..(3377): Any amino acid
  MOD_RES (3388)..(3414): Any amino acid
XXXXXXXXXXXXXXXRRVSKEAAKKTXXXXXXXXXXXXXXXXXXXXXXXXXXXXXXXXXXSFWKPVPLKQATAXXRKIKKAVSTLMVGLQRREKKRSTXXXXXXXXXXXXXXXXFAATVRKERDDTTVIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVWMTVESVVTRTXXVVALLCLAPXXXXXXXXXXXXXXXXXXXXXXXXXXXXXXXXXXXXXXXXXXXXXXXXXAIYQENPAQXXXXXXXXXXXXXXXXXXXXXXXXXXXXXXXXXXXXXXXXXXXXXXXXXXXXXXXXSIVTCVKVSCEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEGVQNWNNAERXXXXXXXXXXXXXXXXXXXXXXXXXXXXXXXXXXXXXXXXXXXXXXXXXXXXXXXXXXXXXXXXXXXXKTKFTWRRTPTDSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFLSSIGKALXXXXXXXXXXXXXXVGFLPKILIGXXXXXXXXXXXXXXXXXXXXXXXXXXXXXXXXXXXXXXXXXXXXXXXXXXXXXXXXXXXXXXXXXXXXXXXXXXXXXXXXIRETFEEGTCXXXXXXXXEMAMWRSAATELNLALXXXXXXXXXXXXXXXXXXXXXXXXXXXXXXXXXXXXXXSWGHSVIWSIPEAPXXXXXXXXXXXXXXXXXXXXXXXXXXXXXXXXXXXXXXXXXXXXXXXXXXXXXXXXXXXXXXXXXXXXLWMKSVRNETGTXXXXXXXXXXXXXXXXXXXXXXXXXXXXXXXXXXXXXXXXXXXXXXXXXXXXXXXXXXXXXXXXXVRGECPGTTVVISADCDRRGAXXXXXXXXXXXXXXXXXXXXXXXXXXXXXXXXXXXXXXXXXXXXXXXXXXXXXXXXXXXXXXXXXXXXXXXXXXXXXXXXXXRPATGSTVVWGGIVVFALLVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLMALMTQQNXXXVHYGLIFFLGXXXXXXXWRLLEGHREQKGLSWIVPLAGLVGGEGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLAASALHWSGILGVXXLWTLSEMLKXXXXXDLAFSGQGGXXXXXXXXXXXXXXXXXXXXXXXXXXXXXXXXXXXXXXXXXXXXXXXXXALSVDDAVAGPYWAEVKXXXXXXXXXXXXXXXXXXXXXXXXXXXXXXXXXXXXXXXXXXXXXXXXXXXXXXXXXXXXTSGSPTLNSQGVVVXXXXXXXXXXXXXXXXXXXXXXXXXXXXXXXXXXGSGWTAKGQIXXXXXXXXXXXXXXXXXXXXXXXXXXXXXXXXXXXXXXXXXXXXXXXXXXXXXFLSPAVSDHQGGGAIVDXXXXXXXXXXXXXXXXXXXXXXXXXXXXXXXXXXXXXXXXXXXXXXXXXXXXXXXXXXXXXXXXXXXXXXXXXXXSEERQIPNGEWXXXXXXXXXXXXXXXXXXXXXAKGGIIARAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEEPGSSAMRXXXXXAPEAFLTVAEMLVLGLAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVRSWEEWTNXXXXXXXXXXXXXXXXXXXXXXXXXXXXXXXXXXXXXXXXXXXXXXXXXGGGAPFIGIAGHVMALGXXXXXXXXXXXXXXXXXXXXXXXXXXXXXXXXXXXXXXXXXXXXXXXXXXXXXXXXXXXXXXXXXXXXXXXXXMSLVLAVALCLXSVVMNRTVLSITEASAXXLAALGQLLKPEADTLWTXXXXXXXXXXXXXXXXXXXXXXXXXXXXXXXXXXXXXXXXXXXXXXXXXXXSCTREEFFVYRRAGILEXXXDRARELLRRGXXXXXXXXXXXXXXXXXXXXXXXXXXXXXXXXXXXXXXXXXXXXXXXXXXXXXXXXXXGGKGHETPRMVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVLADDKVKEQDVQERIRALKEQYXXXXXXDAEHPYRTWXXXXXXXXXXXXXXXXXXXXXXXXXXXXXXXXXXXXXXXXXXXXXXXXXXXXXXXXXXXXXXXXXXXXXXXXXXXXXMLDRLAQKSRPRMCSKEEXXXXXXXXXXXXXXXXXXXXXXXXXXAVEDPAFWKLVDEEXXXXLTGRCAHCVXXXXXXXXXXXXXXXXXXXXXXXXXXXXXXXXXXXXXXXXXXXXXWASRGSSGAGVEGXXXNYLGWHLKRLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFRVERWLRDYGEERLGRXXXXXXXXXVRGIDDRFSGALYFLNDXXXXXXXXXXXXXXXXXXSVEEVPFCSXXXXXXXXXXXXXXXXXXXXXXXXXXXXXXXXXXXXXXXXXXXXXXXXXXXXXXXXXXXXXLRTLGLAISSAVPXXXXXXXXXXXXXXXXXXXXXXXXXXXXXXXXXXXXNPFMQNKGKXXXXXXIPYLPKAQDXXXXXXXXXXXXXXXXXXXXXAVEKVRKMVGXXXXXXXXXXXXXXXXXXXXXXXXXXX

SEQ ID NO: 265827 - protein, 3414 aa, Tick-borne encephalitis virus
  MOD_RES (99)..(113): Any amino acid
  MOD_RES (246)..(253): Any amino acid
  MOD_RES (266)..(268): Any amino acid
  MOD_RES (1063)..(1063): Any amino acid
  MOD_RES (1251)..(1255): Any amino acid
  MOD_RES (1294)..(1313): Any amino acid
  MOD_RES (1353)..(1353): Any amino acid
  MOD_RES (1486)..(1486): Any amino acid
  MOD_RES (1615)..(1615): Any amino acid
  MOD_RES (1673)..(1673): Any amino acid
  MOD_RES (2279)..(2281): Any amino acid
  MOD_RES (2806)..(2806): Any amino acid
  MOD_RES (3342)..(3343): Any amino acid
  MOD_RES (3388)..(3389): Any amino acid
MAGKAILKGKGGGPPRRVSKETAKKTRQSRVQMPNGLVLMRMMGILWHAVAGTARSPVLKSFWNSVPLKQATAALRKIKKAVSTLMVGLQRRGKRRSAXXXXXXXXXXXXXXXTLAATVRKERDGTTVIRAEGKDAATQVRVENGTCVILATDMGSWCDDSLTYECVTIDQGEEPVDVDCFCRNVDGVYLEYGRCGKQEGSRTRRSVLIPSHAQGDLTGRGHKWLEGDSLRTHLTRVEGWVWKNKXXXXXXXXVVWLTVESVVTRXXXVVVLLCLAPVYASRCTHLENRDFVTGTQGTTRVTLVLELGGCVTITAEGKPSMDVWLDSIYQENPAKTREYCLHAKLSDTKVAARCPTMGPATLAEEHQSGTVCKRDQSDRGWGNHCGLFGKGSIVTCVKASCEAKKKATGHVYDANKIVYTVKVEPHTGDYVAANETHSGRKTASFTVSSEKTILTMGDYGDVSLLCRVASGVDLAQTVILELDKTSEHLPTAWQVHRDWFNDLALPWKHEGAQNWNNAERLVEFGAPHAVKMDVYNLGDQTGVLLKSLAGVPVAHIDGTKYHLKSGHVTCEVGLEKLKMKGLTYTMCDKTKFTWKRIPTDSGHDTVVMEVAFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSLFGGVGFLPKILVGVALAWLGLNMRNPTMSMSFLLAGGLVLAMTLGVGADVGCAVDTERMELRCGEGLVVWREVSEWYDNYAYYPETPGALASAIKETFEEGTCGIVPQNRLEMAMWRSSATELNLALAEGDANLTVVVDKLDPTDYRGGIPGLLKKGKDIKVSWKSWGHSMIWSVPEAPRRFMVGTEGGSECPLERRKTGVFTVAEFGVGLRTKVFLDFRQESTHECDTGVMGAAVKNGMAVHTDQSLWMKSVRNDTGTYIVELLVTDLRNCSWPASHTIDNAEVVDSELFLPASLAGPRSWYNRIPGYSEQVKGPWKYSPIRVTREECPGTRVXINADCDKRGASVRSTTESGKVIPEWCCRTCTLPPVTFRTGTDCWYAMEIRPVHDQGGLVRSMVVADNGELLSEGGVPGIVALFVVLEYVIRRRPATGTTAMWGGIVVLALLVTGLVRIESLVRYVVAVGITFHLELGPEIVALTLLQAVFELRVGLLSAFALRSNLTVREMVTIYFLLLVLELGLPSXXXXXLWKWGDALAMGALIFRACTAEEKTGVGLLLMALMTQQDXXXXXXXXXXXXXXXXXXXXWKLIRGHREQKGLTWIVPLAGLLGGEGSGVRLLAFWELAXHGRRRSFSEPLTVVGVMLTLASGMMRHTSQEALCALAVASFLLLMLVLGTRKMQLVAEWSGCVEWHPELMNEGGEVSLRVRQDSMGNFHLTELEKEERVMAFWLLAGLAASAFHWSGILGVMGLWTLSEMLRXARRSDLVFSGQGGRERGDRPFEVKDGVYRIFSPGLLWGQRQVGVGYGSKGVLHTMWHVTRGAALSIDDAVAGPYWADVKEDVVCYGGAWSLEEKWKGETVQVHAFPPGRAHEVHQCQPGELLLDTGRRXGAVPIDLAKGTSGSPILNSQGVVVGLYGNGLKTNETYVSSIAQGEAEKSRPNLPPAVXGTGWTAKGQITVLDMHPGSGKTHRVLPELIRQCIDRRLRTLVLAPTRVVLKEMERALNGKRVRFHSPAVGDQQVGGAIVDVMCHATYVNRRLLPQGRQNWEVAIMDEAHWTDPHSIAARGHLYTLAKENKCALVLMTATPPGKSEPFPESNGAISSEEKQIPDGEWRDGFDWITEYEGRTAWFVPSIAKGGIIARTLRQKGKSVICLNSKTFEKDYSRVRDEKPDFVVTTDISEMGANLDVSRVIDGRTNIKPEEVDGRVELTGTRRVTTASAAQRRGRVGRQEGRTDEYIYSGQCDDDDSGLVQWKEAQILLDNITTLRGPVATFYGPEQDKMPEVAGHFRLTEEKRKHFRHLLTHCDFTPWLAWHVAANVSSVTSRNWTWEGPEENTVDEANGDLVTFRSPNGAERTLRPVWRDARMFREGRDIREFVAYASGRRSFGDVLSGMSGVPELLRHRCVSAMDVFYTLMHEEPGSRAMRMAERDAPEAFLTVVEMMVLGLATLGVVWCFVVRTSISRMMLGTLVLLASLALLWAGGVSYGNMAGVALIFYTLLTVLQPEAGKQRSSDDNKLAYFLLTLCSLAGLVAANEMGFLEKTKADLSTVLWSXXXELRSWEEWTNIDIQPARSWGTYVLVVSLFTPYIIHQLQTKIQQLVNSAVATGAQAMRDLGGGAPFFGVAGHVMALGVVSLVGATPTSLVVGVGLAAFHLAIVVSGLEAELTQRAHKVFFSAMVRNPMVDGDVINPFGEGEAKPALYERKMSLVLAIVLCLMSVVMNRTVPSITEASAVGLAAAGQLLRPEADTLWTMPVACGLSGVVRGSLWGFLPLGHRLWLRASGSRRGGSEGDTLGDLWKRKLNGCTKEEFFAYRRTGILETERDKARELLRRGETNMGLAVSRGTAKLAWLEERGYATLKGEVVDLGCGRGGWSYYAASRPAVMSVKAYTIGGKGHETPKMVTSLGWNLIKFRAGMDVFSMQPHRADTIMCDIGESNPDAVVEGERTRKVILLMEQWKNRNPTATCVFKVLAPYRPEVIEALHRFQLQWGGGLVRTPFSRNSTHEMYYSTAVTGNIVNSVNIQSRKLLARFGDQRGPTRVPELDLGVGTRCVVLAEDKVKEKDVQERISALREQYGETWHXDREHPYRTWQYWGSYRTAPTGSAASLINGVVKLLSWPWNAREDVVRMAMTDTTAFGQQRVFKEKVDTKAQEPQPGTKVIMRAVNDWILERLARKSKPRMCSREEFIAKVKSNAALGAWSDEQNRWSSAKEAVEDPAFWQLVDEERERHLAGRCAHCVYNMMGKREKKLGEFGVAKGSRAIWYMWLGSRFLEFEALGFLNEDHWASRGSSGSGVEGISLNYLGWYLKGLSTLEGGLFYADDTAGWDTKVTNADLEDEEQLLRYMEGEHKQLAATIMQKAYHAKVVKVARPSRDGGCIMDVITRRDQRGSGQVVTYALNTLTNIKVQLIRMMEGEGVIEASDAHNPRLLRVERWLRDHGEERLGRMLVSGDDCVVRPVDDRFGKALYFLNDMAKTRKDIGEWEHSVGFSNWEEVPFCSHHFHELVMKDGRALIVPCRDQDELVGRARVSPGCGWSVRETACLSKAYGQMWLLSYFHRRDLRTLGLAICSAVPVDWVPTGRTTWSIHASGAWMTTEDMLDVWNRVWILDNPFMHSKEKXXEWRDVPYLPKSHDMLCSSLVGRKERAEWAKNIWGAVEKVRKMIGXXKFKDYLSCMDRHDLHWELKLESSII

SEQ ID NO: 265828 - protein, 3414 aa, Tick-borne encephalitis virus
  MOD_RES (99)..(113): Any amino acid
  MOD_RES (173)..(177): Any amino acid
  MOD_RES (199)..(200): Any amino acid
  MOD_RES (232)..(235): Any amino acid
  MOD_RES (246)..(253): Any amino acid
  MOD_RES (266)..(268): Any amino acid
  MOD_RES (283)..(317): Any amino acid
  MOD_RES (378)..(385): Any amino acid
  MOD_RES (536)..(537): Any amino acid
  MOD_RES (569)..(570): Any amino acid
  MOD_RES (656)..(660): Any amino acid
  MOD_RES (790)..(800): Any amino acid
  MOD_RES (994)..(1001): Any amino acid
  MOD_RES (1028)..(1028): Any amino acid
  MOD_RES (1063)..(1063): Any amino acid
  MOD_RES (1080)..(1082): Any amino acid
  MOD_RES (1110)..(1112): Any amino acid
  MOD_RES (1217)..(1217): Any amino acid
  MOD_RES (1251)..(1255): Any amino acid
  MOD_RES (1294)..(1313): Any amino acid
  MOD_RES (1353)..(1353): Any amino acid
  MOD_RES (1392)..(1409): Any amino acid
  MOD_RES (1486)..(1486): Any amino acid
  MOD_RES (1615)..(1615): Any amino acid
  MOD_RES (1673)..(1673): Any amino acid
  MOD_RES (1689)..(1697): Any amino acid
  MOD_RES (1717)..(1721): Any amino acid
  MOD_RES (1788)..(1790): Any amino acid
  MOD_RES (1879)..(1880): Any amino acid
  MOD_RES (1900)..(1922): Any amino acid
  MOD_RES (2024)..(2037): Any amino acid
  MOD_RES (2220)..(2222): Any amino acid
  MOD_RES (2242)..(2243): Any amino acid
  MOD_RES (2279)..(2281): Any amino acid
  MOD_RES (2302)..(2304): Any amino acid
  MOD_RES (2388)..(2399): Any amino acid
  MOD_RES (2499)..(2499): Any amino acid
  MOD_RES (2572)..(2597): Any amino acid
  MOD_RES (2806)..(2806): Any amino acid
  MOD_RES (2818)..(2823): Any amino acid
  MOD_RES (2843)..(2848): Any amino acid
  MOD_RES (3048)..(3055): Any amino acid
  MOD_RES (3270)..(3279): Any amino acid
  MOD_RES (3342)..(3343): Any amino acid
  MOD_RES (3388)..(3389): Any amino acid
MVKKAILKGKGGGPPRRVSKETAKKTRQSRVRMPNGLVLMRMMGILWHAVAGTARNPVLKAFWNSVPLRQATAALRKIKRTVSALMVGLQKRGKRRSAXXXXXXXXXXXXXXXTLAATVRKERDGSTVIRAEGRDAATQVRVENGTCVILVTDMGSWCDDSLSYECVTIDQGXXXXXVDCFCRNVDGVHLEYGRCGKQXXSRTRRSVLIPSHAQGELTGRGRKWLEGDSLRXXXXRVEGWVWKNRXXXXXXXXVVWLTLESVVTRXXXLAALFCLAPVYASRXXXXXXXXXXXXXXXXXXXXXXXXXXXXXXXXXXXKPSMDVWLDAIYQESPAKTREYCLHVKLSDTKVAARCPTTGPATLAEEHQGGTVCKRDQSXXXXXXXXGLFGKGSIVACVKAACEAKKKATGHVYDANKIVYPIKVEPHTGDYVAPHETHSGRKTASFTISSEKTILTMGEYGDVSLLCKVPSGVDLAQTVILELDKTVEHLPTAWQVRRDWFNDLALPWRHEGAQQWNNAERLVEFGVPHAVKMDVYXXGDQTGVLLKALAGVPVAHIEGAKYHLKSGHVXXEVGLEKLKMKGLTYTMCDKTKFTWKRTPTDSGHDTVVMEVTFSGTKPCRIPVRAVAHGFPDVNVAMLITPNPTIETNGGGFIEMQXXXXXNIIYVGELSYQWFQKGSSIGRVFQKTKRGIERLTVIGEHAWDFGSAGGFLSSIGKAVHTVLGGAFNSIFGGVGFLPKLLLGVVLAWLGLNMRNPTMSMGFLLAGVLVLAMTLGVGADVGGAVDTERMELXXXXXXXXXXXVSEWYDNYAFYPETPGALASAIKETFEEGSCGVLPQNRLEMAMWRSSVTELNLALAEGEANLTVVVDKFDPTDYRGGVPGLLRKGKDIKVSWKSWGQSMIWSIPEAPRRFMVGTEGSNECPLERRKTGIFTVAEFGVGLRTKVFLDFRQEPTHECDTGVMGAAVKNGMAIHTDQSLWMRSMKNETGTYIVELLXXXXXXXXWPASHTIDNADVVDSESFLPASLAGPXSWYNRIPGYAEQVKGPWKHTPIRVIREECPGTTVXINAKCDRRGASVRSTTXXXKVIPEWCCRACTMPPVTIRTGTDCWYAXXXRPVHDQGGLIRSTVVADNGELLSEGGIPGIVALFVVLEYIIRRRPSTGTTVVWGGVVVLALLVTGMVKVESLVRYVVAVGITFHFELGPEIVALMLLQAVFELRXGLLSAFALRRSLTVREMVTTYFLLLVLELGLPGXXXXXFWRWGDALAMGALIFRACTAEGKTGAGLLLMALMTQRDXXXXXXXXXXXXXXXXXXXXWRLLKGHREQKGLTWVVPLARLLGGEGSGIRLLAFWELSXHRGRRSFSEPLTVVGVMLTLAGGMMRHTPQEALCALAVXXXXXXXXXXXXXXXXXXAEWSGCVEWHPELVNEGGEVSLRVRQDAMGNFHLTELEKEERMMAFWLIAGLAASAIHWSGILGVMGLWTLTEMLRXSRRSDLAFSGQGGRERGDKPFEVRDGVYRIFSPGLFWGQRQVGVGYGFRGVLHTMWHVTRGAALSINDAVAGPYWADVREDVVCYGGAWSLEEKWRGETVQVHAFPPGKAHEVHQCQPGELILDTGRKXGAIPIDLVKGTSGSPILNAQGAVVGLYGNGLKTNGTYVSSIAQGEAEKSRPNLPQAVXGTGWTSKGQITVLDMXXXXXXXXXVLPELIRQCTDRRLRTLVLXXXXXVLKEMERALSGKRVRFHSPAVSDQQAGGSIVDVMCHTTYVSRRLLPQGRQNWEVATIDEAHWTDPHXXXARGHLYTLAQENKCALVLMTATRPGKSEPFPESNGAITSEERQIPEGEWRDGFDWITEYEGRTAWFVPSIAKGGAIARALRQKGKSVIXXNSKTFEKDYTRVRDEKPDFXXXXXXXXXXXXXXXXXXXXXXXNIKPEEVDGKVELIGTRRVTTASAAQRRGRVGRQDGRIDEYIYSGQCDEYDSVLVQWKEGQILLDDIITLRGPVATFYGPEQDKMPEVAGHYRLTEEKRKHXXXXXXXXXXXXXXAWHVAANVSSVTDRSWTWEGPEENAVDEASGDLVTFKSPNGAERTLRPVWKDARMFKEGRDIKEFVAYASGRRSFGDVLTGMSGVPELLRHRCVSALDVFYTLMHEEPGSRAMKMAERDAPEAFLTMAEVLVLGLATLGVIWCFVVRASISRMMLGTLVLLASLLLLWAGGVGYGNMAGVALXXXTLLTVLQPEVGKQRSSDDNXXAYFLLTLCSVAGLVAANEMGFLERTKADLSTALWSXXXEPRPWSEWTNVDIQPARSWGXXXLVVSLFTPYMIHQLQTKIQQLVNSAVASGAQAMRDLGGGTPFFGVAGHVMTLGVVSLIGATPTSLMVGVGLAALHLAIVVSGLXXXXXXXXXXXXFSAMVRNPMLDGDVINPFGEGETKPALYERKMSLVLAIALCLMSVVMNRTVASITEASAVGLAAVGQLLRPEVDTLWTMPVACGMSSVVTGSLWGFLPLXHRLWLRASGGRRGGADGDTLGDLWKRRLNNCTREEFFVYRRAGIMETERDKARELLRKGETNTGLAVSRGTAXXXXXXXXXXXXXXXXXXXXXXXXXXWSYYAASRPAVMSVRAYTIGGRGHEAPRMVTSLGWNLIKFRSGVDVFSMQPHRADTVMCDIGESSPDAAVEGERTRRVILLMEQWKNRNPTAACVFKVLAPYRPEVIEALHRFQLRWGGGLVRTPFSRNSTHEVYYSTAITGNIVNSVNVQSRKLLARFGDQRGPTRVPELDLGIGTRCVVLAEDKVKEQDVQERIRALREQYSETWHXDEEHPYRTWQYXXXXXXAPTGSAASLTNGVVKLLSWXXXXXXDVVRMAMTDPTAFGQQRVFKDNADTKAQEPQPGTRVIMRAVNDWILERLAQKSKPRMCSKEEFIAKVRSNAALGAWSDEQNRWASAREAVEDPAFWHLVDEERERHLMGRCAHCVHNIMGKREKKLGEFGVSKGSRAMWYMWLGSRFQEFEALGFLNEDHWASRESSGAGVEGISLNYLGWHLKKLSTLNGGLFYADDTXXXXXXXXNADLEDEEQILRYMEGEHKQLATTVMQKAYHAKVVKVARPSRDGGCVMDVITRRDQRGSVQVVTYALNTHTNIKVQLIRMMEGEGVIEAADAHNPRLLRVERWLKEHGGERLGRMLVSGDDCVVRPLDDRFSRALYFLNDMAKTRKDVGEWEHSAGFSSWEAVPFCSHHFHELVMKDGRSLVVPCRDQDELVGRARISPGCGWSIRETACLSKAXXXXXXXXXXHRRDLRTLGLAINSAVPIDWVPTGRTTWSIHASGSWITTENMLDVWNRVWILDNPFMQNKEKXXEWRDVPYLPKAQDMLCSSLVGRRERAEWARNIWGAVEKVRRMIGXXKFRDYPSCMDRHDLHWELRLESSII

SEQ ID NO: 265829 - protein, 3414 aa, Tick-borne encephalitis virus
  MOD_RES (99)..(113): Any amino acid
  MOD_RES (136)..(141): Any amino acid
  MOD_RES (166)..(179): Any amino acid
  MOD_RES (197)..(206): Any amino acid
  MOD_RES (226)..(253): Any amino acid
  MOD_RES (266)..(268): Any amino acid
  MOD_RES (281)..(322): Any amino acid
  MOD_RES (345)..(353): Any amino acid
  MOD_RES (375)..(389): Any amino acid
  MOD_RES (468)..(476): Any amino acid
  MOD_RES (496)..(502): Any amino acid
  MOD_RES (524)..(549): Any amino acid
  MOD_RES (567)..(576): Any amino acid
  MOD_RES (621)..(678): Any amino acid
  MOD_RES (697)..(699): Any amino acid
  MOD_RES (723)..(725): Any amino acid
  MOD_RES (752)..(755): Any amino acid
  MOD_RES (769)..(815): Any amino acid
  MOD_RES (932)..(941): Any amino acid
  MOD_RES (961)..(969): Any amino acid
  MOD_RES (992)..(1002): Any amino acid
  MOD_RES (1022)..(1037): Any amino acid
  MOD_RES (1063)..(1063): Any amino acid
  MOD_RES (1077)..(1090): Any amino acid
  MOD_RES (1105)..(1115): Any amino acid
  MOD_RES (1132)..(1151): Any amino acid
  MOD_RES (1204)..(1218): Any amino acid
  MOD_RES (1251)..(1255): Any amino acid
  MOD_RES (1266)..(1267): Any amino acid
  MOD_RES (1294)..(1313): Any amino acid
  MOD_RES (1353)..(1353): Any amino acid
  MOD_RES (1366)..(1372): Any amino acid
  MOD_RES (1385)..(1413): Any amino acid
  MOD_RES (1429)..(1448): Any amino acid
  MOD_RES (1486)..(1486): Any amino acid
  MOD_RES (1515)..(1516): Any amino acid
  MOD_RES (1584)..(1603): Any amino acid
  MOD_RES (1615)..(1615): Any amino acid
  MOD_RES (1644)..(1653): Any amino acid
  MOD_RES (1673)..(1673): Any amino acid
  MOD_RES (1685)..(1721): Any amino acid
  MOD_RES (1768)..(1818): Any amino acid
  MOD_RES (1846)..(1851): Any amino acid
  MOD_RES (1875)..(1926): Any amino acid
  MOD_RES (1942)..(1946): Any amino acid
  MOD_RES (2016)..(2040): Any amino acid
  MOD_RES (2122)..(2133): Any amino acid
  MOD_RES (2212)..(2257): Any amino acid
  MOD_RES (2279)..(2281): Any amino acid
  MOD_RES (2297)..(2322): Any amino acid
  MOD_RES (2365)..(2368): Any amino acid
  MOD_RES (2380)..(2412): Any amino acid
  MOD_RES (2496)..(2504): Any amino acid
  MOD_RES (2572)..(2600): Any amino acid
  MOD_RES (2649)..(2652): Any amino acid
  MOD_RES (2723)..(2727): Any amino acid
  MOD_RES (2741)..(2754): Any amino acid
  MOD_RES (2806)..(2806): Any amino acid
  MOD_RES (2818)..(2859): Any amino acid
  MOD_RES (2879)..(2889): Any amino acid
  MOD_RES (2974)..(3004): Any amino acid
  MOD_RES (3047)..(3064): Any amino acid
  MOD_RES (3088)..(3092): Any amino acid
  MOD_RES (3108)..(3135): Any amino acid
  MOD_RES (3172)..(3172): Any amino acid
  MOD_RES (3198)..(3200): Any amino acid
  MOD_RES (3225)..(3225): Any amino acid
  MOD_RES (3262)..(3280): Any amino acid
  MOD_RES (3326)..(3328): Any amino acid
  MOD_RES (3342)..(3343): Any amino acid
  MOD_RES (3388)..(3389): Any amino acid
MARKAILKGKGGGPPRRVSKETATKTRQPRVQMPSGLVLMRMLGILWHAIAGTVRSPVLKSFWKSVPLKQAMAALRKIKKAVSALMIGLQRRGKKRSTXXXXXXXXXXXXXXXTFAATVRKEGDDTTVIRAEGRDXXXXXXVENGTCVILATDMGAWCDDSLSYEXXXXXXXXXXXXXXCFCRNVDRVYLEYGRCGXXXXXXXXXXVLIRSHAQGELTGRGRKWLXXXXXXXXXXXXXXXXXXXXXXXXXXXXIVWLTLESVVARXXXVVVLFCLAPVYAXXXXXXXXXXXXXXXXXXXXXXXXXXXXXXXXXXXXXXXXXXVWLDAIYQENPAQTREYCLHAKXXXXXXXXXCPTMGPATLAEQHQSGTVCKRXXXXXXXXXXXXXXXKGSIVTCVKVACEAKKKATGHVYDPNRIVYTIKVEPHTGDYVAVNETHSGRKTPSFTVSSEKTILNMGDYGDVSLLCKXXXXXXXXXTVILELDKTLEHLPTAWQVXXXXXXXLALPWRHEGAQHWNNAERLVEXXXXXXXXXXXXXXXXXXXXXXXXXXGVPVAHIDGAKYHLKSGXXXXXXXXXXLKMNGLTYTVCDKTKFAWKRAPTDSGHDTVVMEVSFSGTKPCRIXXXXXXXXXXXXXXXXXXXXXXXXXXXXXXXXXXXXXXXXXXXXXXXXXXXXXXXXXXIGRVFQKTRRGIERLTVIXXXAWDFGSTGGFLASIGKALHTVLGXXXNSLFGGVGFLPKILMGAALAWLGLNMXXXXMSMSFLLAGVLVLXXXXXXXXXXXXXXXXXXXXXXXXXXXXXXXXXXXXXXXXXXXXXXXGALASAIKETFEEGNCGILPQNRLEMAMWRSASTELNLALAEGEANLTVMVDKLDPTDYRGGVSGLLKKGKDIKVSWKSWGQAIIWSIPEASRRFMVGTEGQSECPPERRKTGVFTXXXXXXXXXXKVFVDFRQEATHECDTGVMXXXXXXXXXIHTDQSLWMKSVRNETGTYIVEXXXXXXXXXXXPASHTIDNADVVDSESFLPXXXXXXXXXXXXXXXXSEQVKGPWKYTPIRVTREECPGTKVXISADCDRRGASVRXXXXXXXXXXXXXXRTCTLPPVTIRTGTXXXXXXXXXXXHDQGGLVRSTVVADNGXXXXXXXXXXXXXXXXXXXXIIRRRPATGTAVVWGGFVVLALLVTGLVRMESLVRYVVAVGIAFHLELGPEIXXXXXXXXXXXXXXXLLSAFALRRGLTVREMVITYFLLLVLELGLPYXXXXXLWRWGDALAMXXLIFRACTAEGKAGVGLLLMPLLTKRGXXXXXXXXXXXXXXXXXXXXWRLLRGHREQKGLSWIVPLAGLMGGEGSGIRLLAFWELAXHGKRRSFSEPLTXXXXXXXLASGMMRHTPQEXXXXXXXXXXXXXXXXXXXXXXXXXXXXXGCVEWYPELVNEGGEXXXXXXXXXXXXXXXXXXXXEERMMAFWLLAGLAASAVHWSGIIGVMGLWTLSEMMRXARRSDLVFSGQGRGERGDRPFEVRDGVYXXFSPGLFWGQNQVGVGYGFRGVLHTMWHVTRGAALSIDDAVVGPYWAEVKEDVVCYGGTWSLEEKWKGXXXXXXXXXXXXXXXXXXXXPGELLLDTGGRXGAILIDLSKGTSRSPILNAQGAVVGLYGXXXXXXXXXXSSIAQGEVEKSRPSLPPAVXGMGWTAKGQITXXXXXXXXXXXXXXXXXXXXXXXXXXXXXXXXXXXXXVLKEMERALTGKRVRFHSPAVGDQQMGGAIVDLMCHATYVSRRLLPXXXXXXXXXXXXXXXXXXXXXXXXXXXXXXXXXXXXXXXXXXXXXXXXXXXPFPESNGAITSEEKQIPNGEWRDGFDWXXXXXXRSAWFVPSIAKGGVIARTLRQKGXXXXXXXXXXXXXXXXXXXXXXXXXXXXXXXXXXXXXXXXXXXXXXXXXXXXEEVDGRVELIGTRRVXXXXXAQRRGRVGRHEGRIDEYIYSGQCDDDDGGLVQWKEAQILLDNITTLRGPVVTFYGPEQDRMPEVAGHFRXXXXXXXXXXXXXXXXXXXXXXXXXVAANVSGVTSRSWTWEGPEANAVDEANGGLVTFRSPNGAERTLKPVWRDARMFREGRDIREFIAYASGRRSIGDVLTGMSGXXXXXXXXXXXXMDVFYTLMHEEPDSSAMRMAERDAPEAFLTVVEMMVLGLGTLGVVWCFVARTSISRMMLGTLVLLASLALLWAGGVGYXXXXXXXXXXXXXXXXXXXXXXXXXXXXXXXXXXXXXXXXXXXXXXAANEMGLLEKTKADLSTVLWAXXXEPRSWGEWTNIDIQPXXXXXXXXXXXXXXXXXXXXXXXXXXQQLVNSAVVTGAQAMRDLGGGAPFLGVAGHVVSLGVVSLVGAXXXXLMVGVGLAAFHXXXXXXXXXXXXXXXXXXXXXXXXXXXXXXXXXVIYPFGEGEAKPALYERKMSLVLAVVLCLIAVVMNRTVPSITEASAVGLAAAGQLLSPEEDTLWTMPVACGLSGVVTGSLWGFXXXXXXXXXRASGSRRGGSDGDTLGDLWKQRLNSCTKEEFFVYRRTGILETERDRARELLKKGETNVGLAVSRGTAXXXXXXXXXXXXXXXXXXXXXXXXXXXXXYAASRPSVMSVRAYTIGGKGHETPRMVTSLGWNLIKFRAGVDVFSMQPXXXXTIMCDIGESNPDAAVEGEKTRKVILLMEQWKIRNPAAACVFKVLAPYRPKVIEALHRFQLKWGGGLVRTPXXXXXTHKMYYSTAITGNXXXXXXXXXXXXXXRFAGQRGPTKVPELDLGVGTRCVVLAEDRVREKDVQERIRALKEQYGETWHXDGEHPYRTWQYXXXXXXXXXXXXXXXXXXXXXXXXXXXXXXXXXXXXXXXXXXPAWQQRVFKKNADTKAQEPXXXXXXXXXXXNDWILERLARKNRSRIHSKEEFIAKVKSSAALGAWSEEQNRWSNAKEAVEDPVFWRLVDEERERDLAGRSAHCAFNIMGKREKKXXXXXXXXXXXXXXXXXXXXXXXXXXXXXXXNEDHWASREFSGSGVEGISLNYLGWHLKGLSIPEGGLFYADDXXXXXXXXXXXXXXXXXXILRYMEGEHRQLAATVMQKAYHAXXXXXARPSREGGCVMDVITXXXXXXXXXXXXXXXXXXXXXXXXXXXXMEGEGVIEATDAHNPRLFRVERWLRNYGEERLGRMLXSGDDCVVRPIDDRFSGALYFLNDMAXXXKDIGEWEHSAGFASVEEVPFCSHHXHELVMKDGRTLVVPCRDQDELVGRAPVSPGCGWSIRXXXXXXXXXXXXXXXXXXXRRDLRTLGLAISSAVPADWVPTGRTTWSIHASGAWMTTENMLDVWXXXWILDNPFMQNKERXXEWRDIPYLPKAHDMLCSSLVGRKERAEWARNIWGAVEKVRKIVGXXKCKDYLSCMDRHDLHWELKLEGSII

SEQ ID NO: 265830 - protein, 3414 aa, Tick-borne encephalitis virus
  MOD_RES (1)..(14): Any amino acid
  MOD_RES (39)..(40): Any amino acid
  MOD_RES (99)..(113): Any amino acid
  MOD_RES (135)..(146): Any amino acid
  MOD_RES (160)..(253): Any amino acid
  MOD_RES (266)..(268): Any amino acid
  MOD_RES (280)..(322): Any amino acid
  MOD_RES (342)..(358): Any amino acid
  MOD_RES (373)..(390): Any amino acid
  MOD_RES (409)..(411): Any amino acid
  MOD_RES (426)..(503): Any amino acid
  MOD_RES (523)..(585): Any amino acid
  MOD_RES (605)..(701): Any amino acid
  MOD_RES (721)..(730): Any amino acid
  MOD_RES (752)..(820): Any amino acid
  MOD_RES (857)..(868): Any amino acid
  MOD_RES (918)..(941): Any amino acid
  MOD_RES (955)..(972): Any amino acid
  MOD_RES (991)..(1008): Any amino acid
  MOD_RES (1021)..(1038): Any amino acid
  MOD_RES (1063)..(1063): Any amino acid
  MOD_RES (1075)..(1152): Any amino acid
  MOD_RES (1190)..(1218): Any amino acid
  MOD_RES (1238)..(1269): Any amino acid
  MOD_RES (1294)..(1313): Any amino acid
  MOD_RES (1353)..(1353): Any amino acid
  MOD_RES (1364)..(1458): Any amino acid
  MOD_RES (1486)..(1486): Any amino acid
  MOD_RES (1515)..(1516): Any amino acid
  MOD_RES (1536)..(1543): Any amino acid
  MOD_RES (1572)..(1615): Any amino acid
  MOD_RES (1642)..(1657): Any amino acid
  MOD_RES (1673)..(1673): Any amino acid
  MOD_RES (1685)..(1733): Any amino acid
  MOD_RES (1754)..(1822): Any amino acid
  MOD_RES (1842)..(1855): Any amino acid
  MOD_RES (1875)..(1947): Any amino acid
  MOD_RES (1998)..(2042): Any amino acid
  MOD_RES (2057)..(2059): Any amino acid
  MOD_RES (2077)..(2138): Any amino acid
  MOD_RES (2188)..(2200): Any amino acid
  MOD_RES (2212)..(2265): Any amino acid
  MOD_RES (2279)..(2281): Any amino acid
  MOD_RES (2293)..(2337): Any amino acid
  MOD_RES (2364)..(2427): Any amino acid
  MOD_RES (2479)..(2479): Any amino acid
  MOD_RES (2494)..(2505): Any amino acid
  MOD_RES (2519)..(2526): Any amino acid
  MOD_RES (2567)..(2602): Any amino acid
  MOD_RES (2629)..(2652): Any amino acid
  MOD_RES (2676)..(2680): Any amino acid
  MOD_RES (2694)..(2703): Any amino acid
  MOD_RES (2716)..(2771): Any amino acid
  MOD_RES (2801)..(2806): Any amino acid
  MOD_RES (2818)..(2890): Any amino acid
  MOD_RES (2912)..(2916): Any amino acid
  MOD_RES (2973)..(3007): Any amino acid
  MOD_RES (3023)..(3023): Any amino acid
  MOD_RES (3046)..(3064): Any amino acid
  MOD_RES (3084)..(3135): Any amino acid
  MOD_RES (3171)..(3172): Any amino acid
  MOD_RES (3197)..(3202): Any amino acid
  MOD_RES (3224)..(3227): Any amino acid
  MOD_RES (3245)..(3250): Any amino acid
  MOD_RES (3261)..(3282): Any amino acid
  MOD_RES (3307)..(3310): Any amino acid
  MOD_RES (3324)..(3330): Any amino acid
  MOD_RES (3342)..(3344): Any amino acid
  MOD_RES (3358)..(3363): Any amino acid
  MOD_RES (3376)..(3376): Any amino acid
  MOD_RES (3388)..(3389): Any amino acid
  MOD_RES (3400)..(3401): Any amino acid
XXXXXXXXXXXXXXPRRVSKEAARKTRQSRVQMPSGLVXXRMMGFLWHAVAGTVRSPVLKSFWNSVPLKQATTALRKIKMAVSTLMVGLQRREKKRSTXXXXXXXXXXXXXXXAFAATVRRERDGTTVIRAEGRXXXXXXXXXXXXCVIMATDMGSWCDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVWMTVESVVTRXXXVVVLFCLAPVYXXXXXXXXXXXXXXXXXXXXXXXXXXXXXXXXXXXXXXXXXXXVWLDAIYQEKPAKTREYCLXXXXXXXXXXXXXXXXXPATLTEEHQGGTVCXXXXXXXXXXXXXXXXXXGSIVTCVKVSCEAKKKATXXXYDANKIVYPVKVEPXXXXXXXXXXXXXXXXXXXXXXXXXXXXXXXXXXXXXXXXXXXXXXXXXXXXXXXXXXXXXXXXXXXXXXXXXXXXXXALPWKHEGVRNWNNAERLVXXXXXXXXXXXXXXXXXXXXXXXXXXXXXXXXXXXXXXXXXXXXXXXXXXXXXXXXXXXXXXXMCDKTKFTWRRTPTDSGHDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDFGSTGGLLSSIGKALHTVXXXXXXXXXXGVGFIPKLLLGMALAWLGLNMXXXXXXXXXXXXXXXXXXXXXXXXXXXXXXXXXXXXXXXXXXXXXXXXXXXXXXXXXXXXXXXXXXXXXAIKEAFEEGTCGILPQNRLEMAMWRSSSTELNLALAXXXXXXXXXXXXFDPTDYRGGIPGLLRKGKDIKVSWRSWGHSMIWSIPEASRRFMVGIEGSXXXXXXXXXXXXXXXXXXXXXXXXKVFLDFRQEATHEXXXXXXXXXXXXXXXXXXDQSLWMKSVRNETGTYIVXXXXXXXXXXXXXXXXXXDNPEVVDSELFLXXXXXXXXXXXXXXXXXXEQVKGPWKYLPIRVIREECPGTRVXISADCDRRGASXXXXXXXXXXXXXXXXXXXXXXXXXXXXXXXXXXXXXXXXXXXXXXXXXXXXXXXXXXXXXXXXXXXXXXXXXXXXXXIRRRPSTGSTVVWGGIIVLALLVTGMVKVESLVRYVVXXXXXXXXXXXXXXXXXXXXXXXXXXXXXLLSAFALRRSLTVREMVITXXXXXXXXXXXXXXXXXXXXXXXXXXXXXXXXLRACTAEGKAGVGLLLMALMTQQNXXXXXXXXXXXXXXXXXXXXWRLLEGHREQKGLSWTVPMAGLVGGEGSGIRLLSFWELSXSGRRRSFSEPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLAASAIHWSGIIGVMGLWTLSEMLKXARRSDLVFSGQGNRERGDKPFEVRDGVYXXFSPGLFWGQSQVGVGYGSKXXXXXXXXVTRGAALYVDDAVAGPYWSDVREDVVCYXXXXXXXXXXXXXXXXXXXXXXXXXXXXXXXXXXXXXXXXXXXXGAVLIDLAKGTSGSPIINSQGVVVGLXXXXXXXXXXXXXXXXQGEAERSRPNLPQAVXGIGWTAKGQITXXXXXXXXXXXXXXXXXXXXXXXXXXXXXXXXXXXXXXXXXXXXXXXXXRVRFLSPAVSDQQVGGSIVDXXXXXXXXXXXXXXXXXXXXXXXXXXXXXXXXXXXXXXXXXXXXXXXXXXXXXXXXXXXXXXXXXXXXXSNRGITSEVRQIPNGEWRDXXXXXXXXXXXXXXFVPSIVKGGIIARALRQKGXXXXXXXXXXXXXXXXXXXXXXXXXXXXXXXXXXXXXXXXXXXXXXXXXXXXXXXXXXXXXXXXXXXXXXXXXPRRGRVGRQEGRIDEYIYSGQCDDDDSVLVQWKEAQILLDNITTLRGPVVXXXXXXXXXXXXXXXXXXXXXXXXXXXXXXXXXXXXXXXXXXXXXANVSSVTSRSWTWEXXXANAVDEASGGLVTFRSPXXXXXXXXXXXXXXXXXXXXXXXXXXXXXXXXXXXXXXXXXXXXXXXXXXXXXXXXXXXXXXTLMHDKPGSSAMRMAERDAPEAFLTLAEMMVLGLGTLGVVWCFVVRASIXXXXXXXXXXXXXLVLLWAGGVSYXXXXXXXXXXXXXXXXXXXXXXXXXXXXXXXXXXXXXXXXXXXXXXXXXXXXXXEKTKADLSAVLWSXXXEVRSWEEWTNIXXXXXXXXXXXXXXXXXXXXXXXXXXXXXXXXXXXXXXXXXXXXXRDLGGGAPFFGVAGHVMSLGVVSLVGXXXXXXXXXXXXXXXXXXXXXXXXXXXXXXXXXXXXXXXXXXXXXXXXXXXXXXXXXXXXXXXXERRMSLVLATVLCLMSVVMNRTMLSITEAAAVGLAAAGQLLRPEEDTLWTMXVACGLSGVVTGSLWXXXXXXXXXXXXASGSRRGGSDGDTXXXXXXXXLNSCTREEFFIYRRTGIMETERDKARELLKRGETNVGLAVXXXXXXXXXXXXXXXXXXXXXXXXXXXXXXXXXXXXASRPAVMNVKAYTIGGRGHETPKMVTXXXXXXXXXXXXXXXXXXXXXXXXTVMCDIGESNPDAVVEGEKTRKVXXXXXQWKNRNPAAACVFXXXXXXXXXXIETLHRFQLQWGXXXXXXXXXXXXXXXXXXXXXXXXXXXXXXXXXXXXXXXXXXXXXXXXXXXXXXXXVGTRCVFLAEDKVKEQDVRERINALREQYXXXXXXDAEHPYRTWQYXXXXXXXXXXXXXXXXXXXXXXXXXXXXXXXXXXXXXXXXXXXXXXXXXXXXXXXXXXXXXXXXXXXXXXXXXDWMLDRLAQKSRPRMCSREEFXXXXXSNAALGAWSNEQNRWSSAKEAVEDPAFWQLVDEERERHLTGRCAHGVFNIMGKREKXXXXXXXXXXXXXXXXXXXXXXXXXXXXXXXXXXXHWASRGSSGAGVEGIXLNYLGWYLKELSTPEGGLFYADXXXXXXXXXXXXXXXXXXXLLRYMEGEHKQLAATVMQKXXXXXXXXXXXXXXXXXXXXXXXXXXXXXXXXXXXXXXXXXXXXXXXXXXXXMEGEGVVEATDAHNPRLLRVERWLREHGGERLGRMXXSGDDCVVRPVDDRFGRALYFLNDMXXXXXXIGEWEHSAGLSGWEEVPFCSHXXXXLVMKDGRALVVPCRDQDXXXXXXRVSPGCGWSIXXXXXXXXXXXXXXXXXXXXXXDLRTLGFAICSAVPTDWVPTGRTTXXXXASGAWMTTENMLDXXXXXXXLDNPFMQNKGKXXXWRNVPYLPKAHDMXXXXXXGRTERAEWAKNIXGAVEKVRKMMGXXRFKDYLSCMDXXYLHWNLKLESSIF

SEQ ID NO: 265831 - protein, 3414 aa, Tick-borne encephalitis virus
  MOD_RES (1)..(14): Any amino acid
  MOD_RES (28)..(59): Any amino acid
  MOD_RES (99)..(113): Any amino acid
  MOD_RES (131)..(253): Any amino acid
  MOD_RES (264)..(268): Any amino acid
  MOD_RES (279)..(325): Any amino acid
  MOD_RES (337)..(390): Any amino acid
  MOD_RES (405)..(508): Any amino acid
  MOD_RES (522)..(587): Any amino acid
  MOD_RES (603)..(707): Any amino acid
  MOD_RES (719)..(730): Any amino acid
  MOD_RES (742)..(820): Any amino acid
  MOD_RES (835)..(838): Any amino acid
  MOD_RES (857)..(888): Any amino acid
  MOD_RES (909)..(974): Any amino acid
  MOD_RES (989)..(1051): Any amino acid
  MOD_RES (1063)..(1063): Any amino acid
  MOD_RES (1075)..(1154): Any amino acid
  MOD_RES (1181)..(1226): Any amino acid
  MOD_RES (1238)..(1283): Any amino acid
  MOD_RES (1294)..(1313): Any amino acid
  MOD_RES (1344)..(1458): Any amino acid
  MOD_RES (1486)..(1489): Any amino acid
  MOD_RES (1501)..(1525): Any amino acid
  MOD_RES (1536)..(1547): Any amino acid
  MOD_RES (1567)..(1622): Any amino acid
  MOD_RES (1641)..(1660): Any amino acid
  MOD_RES (1671)..(1673): Any amino acid
  MOD_RES (1685)..(1735): Any amino acid
  MOD_RES (1754)..(1828): Any amino acid
  MOD_RES (1841)..(1859): Any amino acid
  MOD_RES (1871)..(2141): Any amino acid
  MOD_RES (2153)..(2155): Any amino acid
  MOD_RES (2175)..(2281): Any amino acid
  MOD_RES (2293)..(2339): Any amino acid
  MOD_RES (2359)..(2430): Any amino acid
  MOD_RES (2442)..(2442): Any amino acid
  MOD_RES (2479)..(2527): Any amino acid
  MOD_RES (2547)..(2547): Any amino acid
  MOD_RES (2560)..(2609): Any amino acid
  MOD_RES (2629)..(2775): Any amino acid
  MOD_RES (2801)..(2806): Any amino acid
  MOD_RES (2817)..(2891): Any amino acid
  MOD_RES (2912)..(2932): Any amino acid
  MOD_RES (2964)..(3007): Any amino acid
  MOD_RES (3023)..(3023): Any amino acid
  MOD_RES (3036)..(3151): Any amino acid
  MOD_RES (3171)..(3177): Any amino acid
  MOD_RES (3197)..(3213): Any amino acid
  MOD_RES (3224)..(3282): Any amino acid
  MOD_RES (3297)..(3331): Any amino acid
  MOD_RES (3342)..(3347): Any amino acid
  MOD_RES (3358)..(3376): Any amino acid
  MOD_RES (3388)..(3414): Any amino acid
XXXXXXXXXXXXXXPRRASKETAKKTRXXXXXXXXXXXXXXXXXXXXXXXXXXXXXXXXKSFWKPVPLKQATAALRKIKRAVSALMVGLQKRGKRRSVXXXXXXXXXXXXXXXTIAATVRKERDDTTVIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIVWMTVESVVXXXXXVVVLFCLAPVXXXXXXXXXXXXXXXXXXXXXXXXXXXXXXXXXXXXXXXXXXXXXXXDAIYQEKPAKTXXXXXXXXXXXXXXXXXXXXXXXXXXXXXXXXXXXXXXXXXXXXXXXXXXXXXXGSIVTCVKVSCEAKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEGARNWNNAERLXXXXXXXXXXXXXXXXXXXXXXXXXXXXXXXXXXXXXXXXXXXXXXXXXXXXXXXXXXXXXXXXXXDKTKFTWRRTPTDSGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGFLSSIGKALHXXXXXXXXXXXXGVGFLPKILIGXXXXXXXXXXXXXXXXXXXXXXXXXXXXXXXXXXXXXXXXXXXXXXXXXXXXXXXXXXXXXXXXXXXXXXXXXXXXXXXAIRETFEEGTCGILXXXXLEMAMWRSAATELNLALAXXXXXXXXXXXXXXXXXXXXXXXXXXXXXXXXRVSWKSWGHSVIWSIPEAPRXXXXXXXXXXXXXXXXXXXXXXXXXXXXXXXXXXXXXXXXXXXXXXXXXXXXXXXXXXXXXXXXXXSLWMKSVRNETGTYXXXXXXXXXXXXXXXXXXXXXXXXXXXXXXXXXXXXXXXXXXXXXXXXXXXXXXXXXXXXXXXVVRGECPGTKVXITADCDKRGASXXXXXXXXXXXXXXXXXXXXXXXXXXXXXXXXXXXXXXXXXXXXXXXXXXXXXXXXXXXXXXXXXXXXXXXXXXXXXXXXRRPATGTTAVWGGLIVFALLVTGLVRXXXXXXXXXXXXXXXXXXXXXXXXXXXXXXXXXXXXXXXXXXXXXXRSLTVREMVTIXXXXXXXXXXXXXXXXXXXXXXXXXXXXXXXXXXXXXXXXXXXXXXLLMALITQQDXXXXXXXXXXXXXXXXXXXXWRLLEGHREQKGLSWIVPLAGLVGGEGSGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLSASALHWSGILGVMGLWTLTKMLRXXXXSGLVFSGQGGRXXXXXXXXXXXXXXXXXXXXXXXXXRQVGVGYGFRXXXXXXXXXXXXAALSIDDAVAGPYWSDVREXXXXXXXXXXXXXXXXXXXXXXXXXXXXXXXXXXXXXXXXXXXXXXXXXXXXXXXXAKGTSGSPTLNSQGVVVGXXXXXXXXXXXXXXXXXXXXAEKSRPSLPPXXXGSGWTAKGQITXXXXXXXXXXXXXXXXXXXXXXXXXXXXXXXXXXXXXXXXXXXXXXXXXXXRFHSPVVGDHQGGGAIVDXXXXXXXXXXXXXXXXXXXXXXXXXXXXXXXXXXXXXXXXXXXXXXXXXXXXXXXXXXXXXXXXXXXXXXXXXXXSEERQIPNGEWRXXXXXXXXXXXXXXXXXXXIAKGGIIARALXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEEPGSSAMRMXXXDAPEAFLTMVEMMVLGLGTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMRSWEEWTNIXXXXXXXXXXXXXXXXXXXXXXXXXXXXXXXXXXXXXXXXXXXXXXXLGGGAPFIGIAGHVMALGVXXXXXXXXXXXXXXXXXXXXXXXXXXXXXXXXXXXXXXXXXXXXXXXXXXXXXXXXXXXXXXXXXXXXXXXXMSLVLAVALCLXSVVMNRTVLSITEASAVGLAALGQLLKPEADTLWTMXXXXXXXXXXXXXXXXXXXXXXXXXXXXXXXXXXXXXXXXXXXXXXXXXNSCTREEFFVYRRTGIMETXRDKARELLKRGEXXXXXXXXXXXXXXXXXXXXXXXXXXXXXXXXXXXXXXXXXXXXXXXXXXSVKAYTIGGKGHETPRMVTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXCVVLADDKVKEQDVRERIKALREQYXXXXXXNGEHPYRTWQXXXXXXXXXXXXXXXXXXXXXXXXXXXXXXXXXXXXXXXXXXXXXXXXXXXXXXXXXXXXXXXXXXXXXXXXXXXWILERLAQRSNSRIHSKEEFXXXXXXXXXXXXXXXXXXXXXGAREAVEDPAFWKLVDEERERHLAGRCAHCAXXXXXXXXXXXXXXXXXXXXXXXXXXXXXXXXXXXXXXXXXXXXHWASRGFSGSGVEGIXLNYLGWHLKRLSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLLRVERWLRDYGEERLGRMXXXXXXXVVRGIDDRFSGALYFLNDMXXXXXXXXXXXXXXXXXSVEEVPFCSHXXXXXXXXXXXXXXXXXXXXXXXXXXXXXXXXXXXXXXXXXXXXXXXXXXXXXXXXXXXDLRTLGLTICSAVPXXXXXXXXXXXXXXXXXXXXXXXXXXXXXXXXXXXDNPFMHGKEKXXXXXXIPYLPKAQDMXXXXXXXXXXXXXXXXXXXGAVEKVRKMVGXXXXXXXXXXXXXXXXXXXXXXXXXXX

SEQ ID NO: 265832 - protein, 3414 aa, Tick-borne encephalitis virus
  MOD_RES (99)..(113): Any amino acid
  MOD_RES (246)..(254): Any amino acid
  MOD_RES (266)..(268): Any amino acid
  MOD_RES (1063)..(1063): Any amino acid
  MOD_RES (1251)..(1255): Any amino acid
  MOD_RES (1294)..(1313): Any amino acid
  MOD_RES (1353)..(1353): Any amino acid
  MOD_RES (1486)..(1486): Any amino acid
  MOD_RES (1615)..(1615): Any amino acid
  MOD_RES (1673)..(1673): Any amino acid
  MOD_RES (1747)..(1747): Any amino acid
  MOD_RES (2279)..(2281): Any amino acid
  MOD_RES (2794)..(2794): Any amino acid
  MOD_RES (2806)..(2806): Any amino acid
  MOD_RES (3342)..(3343): Any amino acid
  MOD_RES (3388)..(3389): Any amino acid
MAGKAILKGKGGGPPRRVSKETAKKTRQSRVQMPNGLVLMRMMGILWHAVAGTARSPVLKSFWNSVPLKQATAALRKIKKAVSTLMVGLQRRGKRRSAXXXXXXXXXXXXXXXTLAATVRKERDGTTVIRAEGKDAATQVRVENGTCVILATDMGSWCDDSLTYECVTIDQGEEPVDVDCFCRNVDGVYLEYGRCGKQEGSRTRRSVLIPSHAQGDLTGRGHKWLEGDSLRTHLTRVEGWVWKNKXXXXXXXXXVWLTVESVVTRXXXVVVLLCLAPVYASRCTHLENRDFVTGTQGTTRVTLVLELGGCVTITAEGKPSMDVWLDSIYQENPAKTREYCLHAKLSDTKVAARCPTMGPATLAEEHQSGTVCKRDQSDRGWGNHCGLFGKGSIVTCVKASCEAKKKATGHVYDANKIVYTVKVEPHTGDYVAANETHSGRKTASFTVSSEKTILTMGDYGDVSLLCRVASGVDLAQTVILELDKTSEHLPTAWQVHRDWFNDLALPWKHEGAQNWNNAERLVEFGAPHAVKMDVYNLGDQTGVLLKSLAGVPVAHIDGTKYHLKSGHVTCEVGLEKLKMKGLTYTMCDKTKFTWKRIPTDSGHDTVVMEVAFSGTKPCRIPVRAVAHGSPDVNVAMLITPNPTIENNGGGFIEMQLPPGDNIIYVGELSHQWFQKGSSIGRVFQKTRKGIERLTVIGEHAWDFGSTGGFLTSVGKALHTVLGGAFNSLFGGVGFLPKILVGVALAWLGLNMRNPTMSMSFLLAGGLVLAMTLGVGADVGCAVDTERMELRCGEGLVVWREVSEWYDNYAYYPETPGALASAIKETFEEGTCGIVPQNRLEMAMWRSSATELNLALAEGDANLTVVVDKLDPTDYRGGIPGLLKKGKDIKVSWKSWGHSMIWSVPEAPRRFMVGTEGGSECPLERRKTGVFTVAEFGVGLRTKVFLDFRQESTHECDTGVMGAAVKNGMAVHTDQSLWMKSVRNDTGTYIVELLVTDLRNCSWPASHTIDNAEVVDSELFLPASLAGPRSWYNRIPGYSEQVKGPWKYSPIRVTREECPGTRVXINADCDKRGASVRSTTESGKVIPEWCCRTCTLPPVTFRTGTDCWYAMEIRPVHDQGGLVRSMVVADNGELLSEGGIPGIVALFVVLEYVIRRRPATGTTAMWGGIVVLALLVTGLVRIESLVRYVVAVGITFHLELGPEIVALTLLQAVFELRVGLLSAFALRSNLTVREMVTIYFLLLVLELGLPSXXXXXLWKWGDALAMGALIFRACTAEEKTGVGLLLMALMTQQDXXXXXXXXXXXXXXXXXXXXWKLIRGHREQKGLTWIVPLAGLLGGEGSGVRLLAFWELAXHRRRRSFSEPLTVVGVMLTLASGMMRHTSQEALCALAVASFLLLMLVLGTRKMQLVAEWSGCVEWHPELMNEGGEVSLRVRQDSMGNFHLTELEKEERVMAFWLLAGLAASAFHWSGILGVMGLWTLSEMLRXARRSDLVFSGQGGRERGDRPFEVKDGVYRIFSPGLLWGQRQVGVGYGSKGVLHTMWHVTRGAALSIDDAVAGPYWADVKEDVVCYGGAWSLEEKWKGETVQVHAFPPGRAHEVHQCQPGELLLDTGRRXGAVPIDLAKGTSGSPILNSQGVVVGLYGNGLKTNETYVSSIAQGEAEKSRPNLPPAVXGTGWTAKGQITVLDMHPGSGKTHRVLPELIRQCIDRRLRTLVLAPTRVVLKEMERALNGKRVRFHSPAVGDQQXGGAIVDVMCHATYVNRRLLPQGRQNWEVAIMDEAHWTDPHSIAARGHLYTLAKENKCALVLMTATPPGKSEPFPESNGAISSEEKQIPDGEWRDGFDWITEYEGRTAWFVPSIAKGGIIARTLRQKGKSVICLNSKTFEKDYSRVRDEKPDFVVTTDISEMGANLDVSRVIDGRTNIKPEEVDGRVELTGTRRVTTASAAQRRGRVGRQEGRTDEYIYSGQCDDDDSGLVQWKEAQILLDNITTLRGPVATFYGPEQDKMPEVAGHFRLTEEKRKHFRHLLTHCDFTPWLAWHVAANVSSVTSRNWTWEGPEENTVDEANGDLVTFRSPNGAERTLRPVWRDARMFREGRDIREFVAYASGRRSFGDVLSGMSGVPELLRHRCVSAMDVFYTLMHEEPGSRAMRMAERDAPEAFLTVVEMMVLGLATLGVVWCFVVRTSISRMMLGTLVLLASLALLWAGGVSYGNMAGVALIFYTLLTVLQPEAGKQRSSDDNKLAYFLLTLCSLAGLVAANEMGFLEKTKADLSTVLWSXXXELRSWEEWTNIDIQPARSWGTYVLVVSLFTPYIIHQLQTKIQQLVNSAVATGAQAMRDLGGGAPFFGVAGHVMALGVVSLVGATPTSLVVGVGLAAFHLAIVVSGLEAELTQRAHKVFFSAMVRNPMVDGDVINPFGEGEAKPALYERKMSLVLAIVLCLMSVVMNRTVPSITEASAVGLAAAGQLLRPEADTLWTMPVACGLSGVVRGSLWGFLPLGHRLWLRASGSRRGGSEGDTLGDLWKRKLNGCTKEEFFAYRRTGILETERDKARELLRRGETNMGLAVSRGTAKLAWLEERGYATLKGEVVDLGCGRGGWSYYAASRPAVMSVKAYTIGGKGHETPKMVTSLGWNLIKFRAGMDVFSMQPHRADTIMCDIGESNPDAVVEGERTRKVILLMEQWKNRNPTATCVFKVLAPYRPEVIEALHRFQLQWGGGLVRTPFSRNSTHEMYYSTAVTGNIVNSVNIQSRKLLARFGDQRGPTRVPELDLGVGTRCVVLAEDKVKEKDVQERIXALREQYGETWHXDREHPYRTWQYWGSYRTAPTGSAASLINGVVKLLSWPWNAREDVVRMAMTDTTAFGQQRVFKEKVDTKAQEPQPGTKVIMRAVNDWILERLARKSKPRMCSREEFIAKVKSNAALGAWSDEQNRWSSAKEAVEDPAFWQLVDEERERHLAGRCAHCVYNMMGKREKKLGEFGVAKGSRAIWYMWLGSRFLEFEALGFLNEDHWASRGSSGSGVEGISLNYLGWYLKGLSTLEGGLFYADDTAGWDTKVTNADLEDEEQLLRYMEGEHKQLAATIMQKAYHAKVVKVARPSRDGGCIMDVITRRDQRGSGQVVTYALNTLTNIKVQLIRMMEGEGVIEASDAHNPRLLRVERWLRDHGEERLGRMLVSGDDCVVRPVDDRFGKALYFLNDMAKTRKDIGEWEHSVGFSNWEEVPFCSHHFHELVMKDGRALIVPCRDQDELVGRARVSPGCGWSVRETACLSKAYGQMWLLSYFHRRDLRTLGLAICSAVPVDWVPTGRTTWSIHASGAWMTTEDMLDVWNRVWILDNPFMHSKEKXXEWRDVPYLPKSHDMLCSSLVGRKERAEWAKNIWGAVEKVRKMIGXXKFKDYLSCMDRHDLHWELKLESSII

SEQ ID NO: 265833 - protein, 3414 aa, Tick-borne encephalitis virus
  MOD_RES (99)..(113): Any amino acid
  MOD_RES (174)..(176): Any amino acid
  MOD_RES (233)..(234): Any amino acid
  MOD_RES (246)..(254): Any amino acid
  MOD_RES (266)..(268): Any amino acid
  MOD_RES (284)..(316): Any amino acid
  MOD_RES (379)..(384): Any amino acid
  MOD_RES (657)..(659): Any amino acid
  MOD_RES (791)..(799): Any amino acid
  MOD_RES (995)..(1000): Any amino acid
  MOD_RES (1063)..(1063): Any amino acid
  MOD_RES (1081)..(1081): Any amino acid
  MOD_RES (1111)..(1111): Any amino acid
  MOD_RES (1251)..(1255): Any amino acid
  MOD_RES (1294)..(1313): Any amino acid
  MOD_RES (1353)..(1353): Any amino acid
  MOD_RES (1393)..(1408): Any amino acid
  MOD_RES (1486)..(1486): Any amino acid
  MOD_RES (1615)..(1615): Any amino acid
  MOD_RES (1673)..(1673): Any amino acid
  MOD_RES (1690)..(1696): Any amino acid
  MOD_RES (1718)..(1720): Any amino acid
  MOD_RES (1747)..(1747): Any amino acid
  MOD_RES (1789)..(1789): Any amino acid
  MOD_RES (1901)..(1921): Any amino acid
  MOD_RES (2025)..(2036): Any amino acid
  MOD_RES (2221)..(2221): Any amino acid
  MOD_RES (2279)..(2281): Any amino acid
  MOD_RES (2303)..(2303): Any amino acid
  MOD_RES (2389)..(2398): Any amino acid
  MOD_RES (2573)..(2596): Any amino acid
  MOD_RES (2794)..(2794): Any amino acid
  MOD_RES (2806)..(2806): Any amino acid
  MOD_RES (2819)..(2822): Any amino acid
  MOD_RES (2844)..(2847): Any amino acid
  MOD_RES (3049)..(3054): Any amino acid
  MOD_RES (3271)..(3278): Any amino acid
  MOD_RES (3342)..(3343): Any amino acid
  MOD_RES (3388)..(3389): Any amino acid
MVKKAILKGKGGGPPRRVSKETAKKTRQSRVRMPNGLVLMRMMGILWHAVAGTARNPVLKAFWNSVPLRQATAALRKIKRTVSALMVGLQKRGKRRSAXXXXXXXXXXXXXXXTLAATVRKERDGSTVIRAEGRDAATQVRVENGTCVILVTDMGSWCDDSLSYECVTIDQGEXXXDVDCFCRNVDGVHLEYGRCGKQEGSRTRRSVLIPSHAQGELTGRGRKWLEGDSLRTXXTRVEGWVWKNRXXXXXXXXXVWLTLESVVTRXXXLVVLFCLAPVYASRCXXXXXXXXXXXXXXXXXXXXXXXXXXXXXXXXXGKPSMDVWLDAIYQESPAKTREYCLHVKLSDTKVAARCPTMGPATLAEEHQGGTVCKRDQSDXXXXXXCGLFGKGSIVACVKAACEAKKKATGHVYDPNRIVYPIKVEPHTGDYVAPHETHSGRKTASFTISSEKTILTMGEYGDVSLLCKVPSGVDLAQTVILELDKTVEHLPTAWQVRRDWFNDLALPWRHEGAQQWNNAERLVEFGVPHAVKMDVYNLGDQTGVLLKALAGVPVAHIEGAKYHLKSGHVTCEVGLEKLKMKGLTYTMCDKTKFTWKRTPTDSGHDTVVMEVTFSGTKPCRIPVRAVAHGFPDVNVAMLITPNPTIETNGGGFIEMQLXXXDNIIYVGELSYQWFQKGSSIGRVFQKTKRGIERLTVIGEHAWDFGSAGGFLSSIGKAVHTVLGGAFNSIFGGVGFLPKLLLGVVLAWLGLNMRNPTMSMGFLLAGVLVLAMTLGVGADVGGAVDTERMELRXXXXXXXXXEVSEWYDNYAFYPETPGALASAIKETFEEGSCGVLPQNRLEMAMWRSSVTELNLALAEGEANLTVVVDKFDPTDYRGGVPGLLRKGKDIKVSWKSWGQSMIWSIPEAPRRFMVGTEGSNECPPERRKTGIFTVAEFGVGLRTKVFLDFRQEPTHECDTGVMGAAVKNGMAIHTDQSLWMRSMKNETGTYIVELLVXXXXXXSWPASHTIDNADVVDSESFLPASLAGPRSWYNRIPGYSEQVKGPWKHTPIRVIREECPGTTVXINAKCDRRGASVRSTTEXGKVIPEWCCRACTMPPVTIRTGTDCWYAMXIRPVHDQGGLIRSTVVADNGELLSEGGVPGIVALFVVLEYIIRRRPSTGTTVVWGGVVVLALLVTGMVKMESLVRYVVAVGITFHLELGPEIVALMLLQAVFELRVGLLSAFALRRSLTVREMVTTYFLLLVLELGLPGXXXXXFWRWGDALAMGALIFRACTAEGKTGAGLLLMALMTQRDXXXXXXXXXXXXXXXXXXXXWRLIRGHREQKGLTWVVPLARLLGGEGSGIRLLAFWELSXHGGRRSFSEPLTVVGVMLTLAGGMMRHTPQEALCALAVAXXXXXXXXXXXXXXXXVAEWSGCVEWHPELVNEGGEVSLRVRQDAMGNFHLTELEKEERMMAFWLIAGLAASAVHWSGILGVMGLWTLTEMLRXSRRSDLVFSGQGGRERGDKPFEVRDGVYRIFSPGLFWGQRQVGVGYGFRGVLHTMWHVTRGAALSINDAVAGPYWADVREDVVCYGGTWSLEEKWRGETVQVHAFPPGKAHEVHQCQPGELILDTGRKXGAIPIDLVKGTSGSPILNAQGAVVGLYGNGLKTNGTYVSSIAQGEAEKSRPNLPQAVXGTGWTSKGQITVLDMHXXXXXXXRVLPELIRQCTDRRLRTLVLAXXXVVLKEMERALSGKRVRFHSPAVSDQQXGGSIVDVMCHATYVSRRLLPQGRQNWEVATIDEAHWTDPHSXAARGHLYTLAQENKCALVLMTATRPGKSEPFPESNGAITSEERQIPEGEWRDGFDWITEYEGRTAWFVPSIAKGGAIARALRQKGKSVICLNSKTFEKDYTRVRDEKPDFVXXXXXXXXXXXXXXXXXXXXXTNIKPEEVDGKVELIGTRRVTTASAAQRRGRVGRQDGRIDEYIYSGQCDEYDGGLVQWKEAQILLDNITTLRGPVATFYGPEQDKMPEVAGHYRLTEEKRKHFXXXXXXXXXXXXLAWHVAANVSSVTDRSWTWEGPEENAVDEASGDLVTFKSPNGAERTLRPVWKDARMFKEGRDIKEFVAYASGRRSFGDVLTGMSGVPELLRHRCVSALDVFYTLMHEEPGSRAMKMAERDAPEAFLTMAEVMVLGLATLGVIWCFVVRASISRMMLGTLVLLASLLLLWAGGVGYGNMAGVALIXYTLLTVLQPEVGKQRSSDDNKLAYFLLTLCSVAGLVAANEMGFLERTKADLSTALWSXXXEPRPWSEWTNVDIQPARSWGTXVLVVSLFTPYMIHQLQTKIQQLVNSAVASGAQAMRDLGGGTPFFGVAGHVMTLGVVSLIGATPTSLMVGVGLAALHLAIVVSGLEXXXXXXXXXXFFSAMVRNPMLDGDVINPFGEGETKPALYERKMSLVLAIALCLMSVVMNRTVASITEASAVGLAAVGQLLRPEVDTLWTMPVACGMSSVVTGSLWGFLPLGHRLWLRASGGRRGGAEGDTLGDLWKRRLNNCTREEFFVYRRTGILETERDKARELLRKGETNTGLAVSRGTAKXXXXXXXXXXXXXXXXXXXXXXXXGWSYYAASRPAVMSVRAYTIGGRGHEAPRMVTSLGWNLIKFRSGVDVFSMQPHRADTVMCDIGESSPDAAVEGERTRRVILLMEQWKNRNPTAACVFKVLAPYRPEVIEALHRFQLRWGGGLVRTPFSRNSTHKVYYSTAVTGNIVNSVNVQSRKLLARFGDQRGPTRVPELDLGIGTRCVVLAEDKVKEQDVQERIXALREQYSETWHXDEEHPYRTWQYWXXXXTAPTGSAASLTNGVVKLLSWPXXXXEDVVRMAMTDPTAFGQQRVFKDNADTKAQEPQPGTRVIMRAVNDWILERLAQKSKPRMCSKEEFIAKVKSNAALGAWSDEQNRWASAREAVEDPAFWHLVDEERERHLMGRCAHCVHNIMGKREKKLGEFGVSKGSRAMWYMWLGSRFQEFEALGFLNEDHWASRESSGAGVEGISLNYLGWHLKKLSTLNGGLFYADDTAXXXXXXTNADLEDEEQILRYMEGEHKQLATTVMQKAYHAKVVKVARPSRDGGCVMDVITRRDQRGSVQVVTYALNTHTNIKVQLIRMMEGEGVIEAADAHNPRLLRVERWLKEYGGERLGRMLVSGDDCVVRPLDDRFSRALYFLNDMAKTRKDVGEWEHSVGFSSVEAVPFCSHHFHELVMKDGRSLVVPCRDQDELVGRARISPGCGWSIRETACLSKAYXXXXXXXXFHRRDLRTLGLAINSAVPIDWVPTGRTTWSIHASGAWMTTENMLDVWNRVWILDNPFMQNKEKXXEWRDVPYLPKAQDMLCSSLVGRRERAEWARNIWGAVEKVRRMIGXXKFRDYPSCMDRHDLHWELRLESSII

SEQ ID NO: 265834 - protein, 3414 aa, Tick-borne encephalitis virus
  MOD_RES (99)..(113): Any amino acid
  MOD_RES (137)..(140): Any amino acid
  MOD_RES (167)..(178): Any amino acid
  MOD_RES (198)..(205): Any amino acid
  MOD_RES (227)..(254): Any amino acid
  MOD_RES (266)..(268): Any amino acid
  MOD_RES (282)..(321): Any amino acid
  MOD_RES (346)..(352): Any amino acid
  MOD_RES (376)..(388): Any amino acid
  MOD_RES (469)..(475): Any amino acid
  MOD_RES (497)..(501): Any amino acid
  MOD_RES (525)..(548): Any amino acid
  MOD_RES (568)..(575): Any amino acid
  MOD_RES (622)..(677): Any amino acid
  MOD_RES (698)..(698): Any amino acid
  MOD_RES (724)..(724): Any amino acid
  MOD_RES (753)..(754): Any amino acid
  MOD_RES (770)..(814): Any amino acid
  MOD_RES (933)..(940): Any amino acid
  MOD_RES (962)..(968): Any amino acid
  MOD_RES (993)..(1001): Any amino acid
  MOD_RES (1023)..(1036): Any amino acid
  MOD_RES (1063)..(1063): Any amino acid
  MOD_RES (1078)..(1089): Any amino acid
  MOD_RES (1106)..(1114): Any amino acid
  MOD_RES (1133)..(1150): Any amino acid
  MOD_RES (1208)..(1217): Any amino acid
  MOD_RES (1251)..(1255): Any amino acid
  MOD_RES (1294)..(1313): Any amino acid
  MOD_RES (1353)..(1353): Any amino acid
  MOD_RES (1367)..(1371): Any amino acid
  MOD_RES (1386)..(1412): Any amino acid
  MOD_RES (1430)..(1447): Any amino acid
  MOD_RES (1486)..(1486): Any amino acid
  MOD_RES (1585)..(1602): Any amino acid
  MOD_RES (1615)..(1615): Any amino acid
  MOD_RES (1645)..(1652): Any amino acid
  MOD_RES (1673)..(1673): Any amino acid
  MOD_RES (1686)..(1720): Any amino acid
  MOD_RES (1747)..(1747): Any amino acid
  MOD_RES (1769)..(1817): Any amino acid
  MOD_RES (1847)..(1850): Any amino acid
  MOD_RES (1876)..(1925): Any amino acid
  MOD_RES (1943)..(1945): Any amino acid
  MOD_RES (2017)..(2039): Any amino acid
  MOD_RES (2123)..(2132): Any amino acid
  MOD_RES (2213)..(2256): Any amino acid
  MOD_RES (2279)..(2281): Any amino acid
  MOD_RES (2298)..(2321): Any amino acid
  MOD_RES (2366)..(2367): Any amino acid
  MOD_RES (2381)..(2411): Any amino acid
  MOD_RES (2497)..(2503): Any amino acid
  MOD_RES (2573)..(2599): Any amino acid
  MOD_RES (2650)..(2651): Any amino acid
  MOD_RES (2724)..(2726): Any amino acid
  MOD_RES (2794)..(2794): Any amino acid
  MOD_RES (2806)..(2806): Any amino acid
  MOD_RES (2819)..(2858): Any amino acid
  MOD_RES (2880)..(2882): Any amino acid
  MOD_RES (2975)..(3003): Any amino acid
  MOD_RES (3048)..(3063): Any amino acid
  MOD_RES (3089)..(3091): Any amino acid
  MOD_RES (3109)..(3134): Any amino acid
  MOD_RES (3199)..(3199): Any amino acid
  MOD_RES (3263)..(3279): Any amino acid
  MOD_RES (3327)..(3327): Any amino acid
  MOD_RES (3342)..(3343): Any amino acid
  MOD_RES (3388)..(3389): Any amino acid
MARKAILKGKGGGPPRRVSKETATKTRQPRVQMPNGLVLMRMLGILWHAIAGTARSPVLKSFWKSVPLKQAMTALRKIKRAVSTLMIGLQRRGKKRSTXXXXXXXXXXXXXXXAFAATVRKEGDDTTVIRAEGRDAXXXXRVENGTCVILATDMGAWCDDSLSYECXXXXXXXXXXXXDCFCRNVDRVYLEYGRCGKXXXXXXXXSVLIRSHAQGELTGRGRKWLEXXXXXXXXXXXXXXXXXXXXXXXXXXXXVWLTLESVVARXXXVVALLCLAPVYASXXXXXXXXXXXXXXXXXXXXXXXXXXXXXXXXXXXXXXXXDVWLDAIYQEKPAQTREYCLHAKLXXXXXXXRCPTTGPATLAEQHQSGTVCKRDXXXXXXXXXXXXXGKGSIVTCVKVACEAKKKATGHVYDANKIVYTIKVEPHTGDYVAVNETHSGRKTPSFTVSSEKTILNMGDYGDVSLLCKVXXXXXXXQTVILELDKTLEHLPTAWQVHXXXXXDLALPWRHEGAQHWNNAERLVEFXXXXXXXXXXXXXXXXXXXXXXXXAGVPVAHIDGAKYHLKSGHXXXXXXXXKLKMNGLTYTVCDKTKFAWKRAPTDSGHDTVVMEVSFSGTKPCRIPXXXXXXXXXXXXXXXXXXXXXXXXXXXXXXXXXXXXXXXXXXXXXXXXXXXXXXXXSIGRVFQKTRRGIERLTVIGXHAWDFGSTGGFLASIGKALHTVLGGXFNSLFGGVGFLPKILMGMALAWLGLNMRXXTMSMSFLLAGVLVLAXXXXXXXXXXXXXXXXXXXXXXXXXXXXXXXXXXXXXXXXXXXXXPGALASAIKETFEEGNCGILPQNRLEMAMWRSASTELNLALAEGDANLTVMVDKLDPTDYRGGIPGLLKKGKDIKVSWKSWGQAVIWSIPEAPRRFMVGTEGQSECPLERRKTGIFTVXXXXXXXXTKVFVDFRQEATHECDTGVMGXXXXXXXAIHTDQSLWMKSVRNETGTYIVELXXXXXXXXXWPASHTIDNADVVDSESFLPAXXXXXXXXXXXXXXYAEQVKGPWKYTPIRVTREECPGTKVXISADCDRRGASVRSXXXXXXXXXXXXCRTCTLPPVTIRTGTDXXXXXXXXXVHDQGGLVRSTVVADNGEXXXXXXXXXXXXXXXXXXYVIRRRPATGTAVVWGGFVVLALLVTGLVRVESLVRYVVAVGIAFHFELGPEIVALTXXXXXXXXXXGLLSAFALRRGLTVREMVITYFLLLVLELGLPYXXXXXLWRWGDALAMGALIFRACTAEGKAGVGLLLMALITQQDXXXXXXXXXXXXXXXXXXXXWRLLKGHREQKGLSWIVPLAGLMGGEGSGIRLLAFWELAXHGKRRSFSEPLTVXXXXXTLASGMMRHTPQEAXXXXXXXXXXXXXXXXXXXXXXXXXXXSGCVEWYPELVNEGGEVXXXXXXXXXXXXXXXXXXKEERMMAFWLLAGLAASAIHWSGIIGVMGLWTLSEMMRXARRSDLAFSGQGRRERGDRPFEVRDGVYRIFSPGLFWGQNQVGVGYGFRGVLHTMWHVTRGAALSVDDAVVGPYWSEVKEDVVCYGGAWSLEEKWRGEXXXXXXXXXXXXXXXXXXQPGELLLDTGGRXGAILIDLSKGTSGSPILNAQGAVVGLYGNXXXXXXXXVSSIAQGEVEKSRPSLPPAVXGMGWTAKGQITVXXXXXXXXXXXXXXXXXXXXXXXXXXXXXXXXXXXVVLKEMERALTGKRVRFHSPVVGDQQXGGAIVDLMCHTTYVNRRLLPQXXXXXXXXXXXXXXXXXXXXXXXXXXXXXXXXXXXXXXXXXXXXXXXXXEPFPESNGAITSEEKQIPNGEWRDGFDWIXXXXGRSAWFVPSIAKGGVIARTLRQKGKXXXXXXXXXXXXXXXXXXXXXXXXXXXXXXXXXXXXXXXXXXXXXXXXXXPEEVDGRVELIGTRRVTXXXAAQRRGRVGRHEGRIDEYIYSGQCDDDDSVLVQWKEGQILLDDIITLRGPVVTFYGPEQDRMPEVAGHFRLXXXXXXXXXXXXXXXXXXXXXXXHVAANVSSVTSRNWTWEGPEANAVDEANGGLVTFRSPNGAERTLKPVWRDARMFREGRDIREFIAYASGRRSIGDVLTGMSGVXXXXXXXXXXALDVFYTLMHEKPGSSAMRMAERDAPEAFLTLVEMMVLGLATLGVVWCFVARTSISRMMLGTLVLLASLALLWAGGVGYGXXXXXXXXXXXXXXXXXXXXXXXXXXXXXXXXXXXXXXXXXXXXVAANEMGFLEKTKADLSAVLWSXXXEPRSWGEWTNIDIQPAXXXXXXXXXXXXXXXXXXXXXXXXIQQLVNSAVVTGAQAMRDLGGGAPFIGVAGHVVSLGVVSLVGATXXSLMVGVGLAAFHLXXXXXXXXXXXXXXXXXXXXXXXXXXXXXXXDVIYPFGEGEAKPALYERKMSLVLAVVLCLIAVVMNRTVPSITEASAVGLAAAGQLLSPEEDTLWTMPVACGLSGVVTGSLWGFLXXXXXXXLRASGSRRGGSDGDTLGDLWKQRLNSCTKEEFFVYRRAGIMETERDKARELLKKGETNVGLAVSRGTAKXXXXXXXXXXXXXXXXXXXXXXXXXXXYYAASRPSVMSVRAYTIGGKGHETPRMVTSLGWNLIKFRAGVDVFSMQPHXXDTIMCDIGESNPDAAVEGEKTRRVILLMEQWKIRNPAAACVFKVLAPYRPKVIEALHRFQLKWGGGLVRTPFXXXSTHEMYYSTAITGNIVNSVNIQSRKLLARFAGQRGPTKVPELDLGVGTRCVVLAEDRVREKDVQERIXALKEQYGETWHXDGEHPYRTWQYWXXXXXXXXXXXXXXXXXXXXXXXXXXXXXXXXXXXXXXXXTPAWQQRVFKKNADTKAQEPQXXXKVIMRAVNDWILERLARKNNSRIHSKEEFIAKVKSSAALGAWSNEQNRWSNAKEAVEDPVFWRLVDEERERDLAGRCAHGVFNIMGKREKKLXXXXXXXXXXXXXXXXXXXXXXXXXXXXXLNEDHWASRGFSGSGVEGISLNYLGWHLKGLSIPEGGLFYADDTXXXXXXXXXXXXXXXXQILRYMEGEHRQLAATVMQKAYHAKXXXVARPSREGGCVMDVITRXXXXXXXXXXXXXXXXXXXXXXXXXXMMEGEGVIEATDAHNPRLLRVERWLRNHGGERLGRMLVSGDDCVVRPIDDRFSGALYFLNDMAKXRKDIGEWEHSAGFSSWEAVPFCSHHFHELVMKDGRTLVVPCRDQDELVGRAPVSPGCGWSIREXXXXXXXXXXXXXXXXXHRRDLRTLGLTICSAVPADWVPTGRTTWSIHASGSWITTEDMLDVWNXVWILDNPFMQNKERXXEWRDIPYLPKAHDMLCSSLVGRKERAEWARNIWGAVEKVRKIVGXXRCKDYLSCMDRHYLHWNLKLESSIF

SEQ ID NO: 265835 - protein, 3414 aa, Tick-borne encephalitis virus
  MOD_RES (1)..(13): Any amino acid
  MOD_RES (99)..(113): Any amino acid
  MOD_RES (136)..(145): Any amino acid
  MOD_RES (161)..(254): Any amino acid
  MOD_RES (266)..(268): Any amino acid
  MOD_RES (281)..(321): Any amino acid
  MOD_RES (343)..(357): Any amino acid
  MOD_RES (374)..(389): Any amino acid
  MOD_RES (410)..(410): Any amino acid
  MOD_RES (427)..(432): Any amino acid
  MOD_RES (444)..(485): Any amino acid
  MOD_RES (497)..(502): Any amino acid
  MOD_RES (524)..(584): Any amino acid
  MOD_RES (606)..(700): Any amino acid
  MOD_RES (722)..(729): Any amino acid
  MOD_RES (753)..(819): Any amino acid
  MOD_RES (858)..(858): Any amino acid
  MOD_RES (918)..(940): Any amino acid
  MOD_RES (956)..(971): Any amino acid
  MOD_RES (992)..(1007): Any amino acid
  MOD_RES (1022)..(1037): Any amino acid
  MOD_RES (1063)..(1063): Any amino acid
  MOD_RES (1076)..(1151): Any amino acid
  MOD_RES (1191)..(1217): Any amino acid
  MOD_RES (1239)..(1268): Any amino acid
  MOD_RES (1294)..(1313): Any amino acid
  MOD_RES (1353)..(1353): Any amino acid
  MOD_RES (1365)..(1451): Any amino acid
  MOD_RES (1486)..(1486): Any amino acid
  MOD_RES (1537)..(1542): Any amino acid
  MOD_RES (1573)..(1615): Any amino acid
  MOD_RES (1643)..(1656): Any amino acid
  MOD_RES (1673)..(1673): Any amino acid
  MOD_RES (1686)..(1730): Any amino acid
  MOD_RES (1747)..(1821): Any amino acid
  MOD_RES (1843)..(1854): Any amino acid
  MOD_RES (1876)..(1946): Any amino acid
  MOD_RES (1999)..(2041): Any amino acid
  MOD_RES (2078)..(2133): Any amino acid
  MOD_RES (2189)..(2199): Any amino acid
  MOD_RES (2213)..(2263): Any amino acid
  MOD_RES (2279)..(2281): Any amino acid
  MOD_RES (2294)..(2336): Any amino acid
  MOD_RES (2365)..(2426): Any amino acid
  MOD_RES (2495)..(2504): Any amino acid
  MOD_RES (2520)..(2526): Any amino acid
  MOD_RES (2568)..(2601): Any amino acid
  MOD_RES (2630)..(2651): Any amino acid
  MOD_RES (2677)..(2679): Any amino acid
  MOD_RES (2695)..(2702): Any amino acid
  MOD_RES (2717)..(2770): Any amino acid
  MOD_RES (2794)..(2806): Any amino acid
  MOD_RES (2819)..(2889): Any amino acid
  MOD_RES (2974)..(3006): Any amino acid
  MOD_RES (3047)..(3063): Any amino acid
  MOD_RES (3085)..(3134): Any amino acid
  MOD_RES (3198)..(3201): Any amino acid
  MOD_RES (3225)..(3226): Any amino acid
  MOD_RES (3246)..(3249): Any amino acid
  MOD_RES (3262)..(3281): Any amino acid
  MOD_RES (3308)..(3309): Any amino acid
  MOD_RES (3325)..(3329): Any amino acid
  MOD_RES (3342)..(3343): Any amino acid
  MOD_RES (3359)..(3362): Any amino acid
  MOD_RES (3388)..(3389): Any amino acid
XXXXXXXXXXXXXPPRRVSKETARKTRQSRVQMPSGLVLMRMMGFLWHAVAGTVRSPVLKSFWNPVPLKQATAALRKIKKAVSALMVGLQKRGKRRSVXXXXXXXXXXXXXXXTFAATVRKERDGTTVIRAEGRDXXXXXXXXXXTCVIMATDMGSWCDDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVWMTVESVVTRXXXVAVLLCLAPVYAXXXXXXXXXXXXXXXXXXXXXXXXXXXXXXXXXXXXXXXXXDVWLDAIYQENPAQTREYCLHXXXXXXXXXXXXXXXGPATLTEEHQGGTVCKXXXXXXXXXXXXXXXXKGSIVTCVKVSCEAKKKATGXVYDANKIVYTIKVEPHXXXXXXANETHSGRKTPXXXXXXXXXXXXXXXXXXXXXXXXXXXXXXXXXXXXXXXXXXLEHLPTAWQVRXXXXXXLALPWKHEGVRNWNNAERLVEXXXXXXXXXXXXXXXXXXXXXXXXXXXXXXXXXXXXXXXXXXXXXXXXXXXXXXXXXXXXXTMCDKTKFTWRRTPTDSGHDTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWDFGSTGGLLSSIGKALHTVLXXXXXXXXGGVGFIPKLLLGAALAWLGLNMRXXXXXXXXXXXXXXXXXXXXXXXXXXXXXXXXXXXXXXXXXXXXXXXXXXXXXXXXXXXXXXXXXXXSAIRETFEEGTCGILPQNRLEMAMWRSAATELNLALAEXEANLTVMVDKFDPTDYRGGVSGLLKKGKDIKVSWRSWGHSMIWSIPEASRRFMVGTEGSXXXXXXXXXXXXXXXXXXXXXXXTKVFLDFRQEATHECXXXXXXXXXXXXXXXXTDQSLWMKSVRNETGTYIVEXXXXXXXXXXXXXXXXIDNPEVVDSELFLPXXXXXXXXXXXXXXXXSEQVKGPWKYLPIRVIREECPGTRVXITADCDKRGASVXXXXXXXXXXXXXXXXXXXXXXXXXXXXXXXXXXXXXXXXXXXXXXXXXXXXXXXXXXXXXXXXXXXXXXXXXXXXIIRRRPSTGSTVVWGGIIVLALLVTGMVKVESLVRYVVAXXXXXXXXXXXXXXXXXXXXXXXXXXXGLLSAFALRRSLTVREMVITYXXXXXXXXXXXXXXXXXXXXXXXXXXXXXXILRACTAEGKTGVGLLLMALMTQQNXXXXXXXXXXXXXXXXXXXXWRLLEGHREQKGLSWTVPMAGLVGGEGSGIRLLSFWELSXSGRRRSFSEPLXXXXXXXXXXXXXXXXXXXXXXXXXXXXXXXXXXXXXXXXXXXXXXXXXXXXXXXXXXXXXXXXXXXXXXXXXXXXXXXXXXXXXXXVMAFWLLAGLSASAIHWSGIIGVMGLWTLSEMLKXARRSGLVFSGQGNRERGDKPFEVRDGVYRIFSPGLFWGQRQVGVGYGFRGXXXXXXHVTRGAALSIDDAVAGPYWAEVKEDVVCYGXXXXXXXXXXXXXXXXXXXXXXXXXXXXXXXXXXXXXXXXXXXGAVLIDLAKGTSGSPTINSQGVVVGLYXXXXXXXXXXXXXXAQGEAERSRPNLPQAVXGSGWTAKGQITVXXXXXXXXXXXXXXXXXXXXXXXXXXXXXXXXXXXXXXXXXXXXXNGKRVRFLSPAVSDQQXXXXXXXXXXXXXXXXXXXXXXXXXXXXXXXXXXXXXXXXXXXXXXXXXXXXXXXXXXXXXXXXXXXXXXXXXXXESNRGITSEVRQIPNGEWRDGXXXXXXXXXXXXWFVPSIVKGGIIARALRQKGKXXXXXXXXXXXXXXXXXXXXXXXXXXXXXXXXXXXXXXXXXXXXXXXXXXXXXXXXXXXXXXXXXXXXXXXAPRRGRVGRQEGRIDEYIYSGQCDDDDSGLVQWKEAQILLDNIITLRGPVATXXXXXXXXXXXXXXXXXXXXXXXXXXXXXXXXXXXXXXXXXXXAANVSGVTSRSWTWEGPEANAVDEASGGLVTFRSPNXXXXXXXXXXXXXXXXXXXXXXXXXXXXXXXXXXXXXXXXXXXXXXXXXXXXXXXXMDVFYTLMHEEPDSRAMRMAERDAPEAFLTVVEMLVLGLGTLGVVWCFVVRASISXXXXXXXXXXXSLVLLWAGGVSYGXXXXXXXXXXXXXXXXXXXXXXXXXXXXXXXXXXXXXXXXXXXXXXXXXXXLLEKTKADLSTVLWAXXXEVRSWEEWTNIDXXXXXXXXXXXXXXXXXXXXXXXXXXXXXXXXXXXXXXXXXXXMRDLGGGAPFLGVAGHVMSLGVVSLVGAXXXXXXXXXXXXXXXXXXXXXXXXXXXXXXXXXXXXXXXXXXXXXXXXXXXXXXXXXXXXXXYERRMSLVLATVLCLMSVVMNRTMLSITEAAAVGLAALGQLLRPEEDTLWTMPVACGLSGVVTGSLWGXXXXXXXXXXRASGSRRGGSDGDTLXXXXXXXLNSCTREEFFIYRRTGILETERDKARELLKRGETNVGLAVSXXXXXXXXXXXXXXXXXXXXXXXXXXXXXXXXXXAASRPAVMNVKAYTIGGRGHETPKMVTSXXXXXXXXXXXXXXXXXXXXXXDTVMCDIGESNPDAVVEGEKTRKVIXXXEQWKNRNPAAACVFKXXXXXXXXVIETLHRFQLQWGGXXXXXXXXXXXXXXXXXXXXXXXXXXXXXXXXXXXXXXXXXXXXXXXXXXXXXXGVGTRCVVLAEDKVREKDVQERIXXXXXXXXXXXXXDAEHPYRTWQYWXXXXXXXXXXXXXXXXXXXXXXXXXXXXXXXXXXXXXXXXXXXXXXXXXXXXXXXXXXXXXXXXXXXXXXXNDWILERLAQRSRPRMCSKEEFIAKVKSNAALGAWSEEQNRWSGAREAVEDPAFWKLVDEERERHLAGRSAHCAYNMMGKREKKXXXXXXXXXXXXXXXXXXXXXXXXXXXXXXXXXDHWASRESSGSGVEGISLNYLGWHLKRLSTPEGGLFYADDXXXXXXXXXXXXXXXXXQLLRYMEGEHKQLAATVMQKAXXXXXXXXXXXXXXXXXXXXXXXXXXXXXXXXXXXXXXXXXXXXXXXXXXMMEGEGVVEATDAHNPRLLRVERWLREHGGERLGRMLVSGDDCVVRPVDDRFGRALYFLNDMAXXXXDIGEWEHSAGLSSVEEVPFCSHHXXELVMKDGRALVVPCRDQDEXXXXARVSPGCGWSIRXXXXXXXXXXXXXXXXXXXXRDLRTLGFAICSAVPTDWVPTGRTTWXXHASGAWITTEDMLDVXXXXXILDNPFMQNKGKXXEWRNVPYLPKAHDMLXXXXVGRTERAEWAKNIWGAVEKVRKMVGXXKCKDYPSCMDRHDLHWELKLEGSII

SEQ ID NO: 265836 - protein, 3414 aa, Tick-borne encephalitis virus
  MOD_RES (1)..(13): Any amino acid
  MOD_RES (33)..(58): Any amino acid
  MOD_RES (99)..(113): Any amino acid
  MOD_RES (132)..(268): Any amino acid
  MOD_RES (280)..(324): Any amino acid
  MOD_RES (338)..(389): Any amino acid
  MOD_RES (406)..(508): Any amino acid
  MOD_RES (523)..(586): Any amino acid
  MOD_RES (604)..(706): Any amino acid
  MOD_RES (720)..(729): Any amino acid
  MOD_RES (742)..(819): Any amino acid
  MOD_RES (836)..(837): Any amino acid
  MOD_RES (858)..(868): Any amino acid
  MOD_RES (880)..(887): Any amino acid
  MOD_RES (918)..(973): Any amino acid
  MOD_RES (990)..(1037): Any amino acid
  MOD_RES (1049)..(1050): Any amino acid
  MOD_RES (1063)..(1063): Any amino acid
  MOD_RES (1076)..(1153): Any amino acid
  MOD_RES (1181)..(1225): Any amino acid
  MOD_RES (1239)..(1276): Any amino acid
  MOD_RES (1294)..(1313): Any amino acid
  MOD_RES (1345)..(1458): Any amino acid
  MOD_RES (1486)..(1488): Any amino acid
  MOD_RES (1511)..(1524): Any amino acid
  MOD_RES (1537)..(1546): Any amino acid
  MOD_RES (1568)..(1621): Any amino acid
  MOD_RES (1642)..(1659): Any amino acid
  MOD_RES (1672)..(1673): Any amino acid
  MOD_RES (1686)..(1734): Any amino acid
  MOD_RES (1747)..(1828): Any amino acid
  MOD_RES (1842)..(1858): Any amino acid
  MOD_RES (1872)..(1971): Any amino acid
  MOD_RES (1983)..(2140): Any amino acid
  MOD_RES (2154)..(2154): Any amino acid
  MOD_RES (2176)..(2281): Any amino acid
  MOD_RES (2294)..(2338): Any amino acid
  MOD_RES (2360)..(2430): Any amino acid
  MOD_RES (2442)..(2442): Any amino acid
  MOD_RES (2480)..(2526): Any amino acid
  MOD_RES (2561)..(2608): Any amino acid
  MOD_RES (2630)..(2774): Any amino acid
  MOD_RES (2794)..(2806): Any amino acid
  MOD_RES (2818)..(2890): Any amino acid
  MOD_RES (2913)..(2915): Any amino acid
  MOD_RES (2927)..(2932): Any amino acid
  MOD_RES (2964)..(3006): Any amino acid
  MOD_RES (3036)..(3150): Any amino acid
  MOD_RES (3172)..(3176): Any amino acid
  MOD_RES (3198)..(3202): Any amino acid
  MOD_RES (3225)..(3281): Any amino acid
  MOD_RES (3297)..(3330): Any amino acid
  MOD_RES (3342)..(3347): Any amino acid
  MOD_RES (3359)..(3375): Any amino acid
  MOD_RES (3388)..(3414): Any amino acid
XXXXXXXXXXXXXPPRRASKEAAKKTRQSRVQXXXXXXXXXXXXXXXXXXXXXXXXXXLKSFWKSVPLKQATAALRKIKMAVSALMVGLQRREKKRSTXXXXXXXXXXXXXXXTIAATVRREGDGTTVIRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVVALLCLAPVYXXXXXXXXXXXXXXXXXXXXXXXXXXXXXXXXXXXXXXXXXXXXXLDAIYQEKPAKTRXXXXXXXXXXXXXXXXXXXXXXXXXXXXXXXXXXXXXXXXXXXXXXXXXXXXKGSIVTCVKVSCEAKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXHEGARNWNNAERLVXXXXXXXXXXXXXXXXXXXXXXXXXXXXXXXXXXXXXXXXXXXXXXXXXXXXXXXXXXXXXXXXCDKTKFTWRRTPTDSGHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGGFLSSIGKALHTXXXXXXXXXXGGVGFLPKILIGXXXXXXXXXXXXXXXXXXXXXXXXXXXXXXXXXXXXXXXXXXXXXXXXXXXXXXXXXXXXXXXXXXXXXXXXXXXXXXSAIKEAFEEGTCGIVPXXRLEMAMWRSSSTELNLALAEXXXXXXXXXXXFDPTDYRGGIPXXXXXXXXIRVSWKSWGHSIIWSIPEAPRRFMVGIEGSXXXXXXXXXXXXXXXXXXXXXXXXXXXXXXXXXXXXXXXXXXXXXXXXXXXXXXXXQSLWMKSVRNETGTYIXXXXXXXXXXXXXXXXXXXXXXXXXXXXXXXXXXXXXXXXXXXXXXXXSEQVKGPWKYLXXRVVRGECPGTKVXISADCDRRGASVXXXXXXXXXXXXXXXXXXXXXXXXXXXXXXXXXXXXXXXXXXXXXXXXXXXXXXXXXXXXXXXXXXXXXXXXXXXXXXRRRPATGTTAVWGGLIVFALLVTGLVRXXXXXXXXXXXXXXXXXXXXXXXXXXXXXXXXXXXXXXXXXXXXXRRSLTVREMVTIYXXXXXXXXXXXXXXXXXXXXXXXXXXXXXXXXXXXXXXGKAGVGLLLMPLLTKRGXXXXXXXXXXXXXXXXXXXXWRLLEGHREQKGLSWIVPLAGLVGGEGSGIRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAGLAASALHWSGILGVMGLWTLTKMLRXXXRSDLAFSGQGGGERGDKPFEVKXXXXXXXXXXXXXXQSQVGVGYGSKGXXXXXXXXXXGAALYIDDAVAGPYWSDVREDXXXXXXXXXXXXXXXXXXXXXXXXXXXXXXXXXXXXXXXXXXXXXXXXXXXXXXLAKGTSRSPIINSQGVVVGLXXXXXXXXXXXXXXXXXXEAEKSRPSLPPAXXGIGWTAKGQITVXXXXXXXXXXXXXXXXXXXXXXXXXXXXXXXXXXXXXXXXXXXXXXXXXVRFHSPAVGDHQXXXXXXXXXXXXXXXXXXXXXXXXXXXXXXXXXXXXXXXXXXXXXXXXXXXXXXXXXXXXXXXXXXXXXXXXXXXXXXXXXXSEERQIPNGEWRDXXXXXXXXXXXXXXXXXSIAKGGIIARALRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDDGGLVQWKEAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMHDEPGSRAMKMAXRDAPEAFLTMAEMLVLGLATLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEMRSWEEWTNIDXXXXXXXXXXXXXXXXXXXXXXXXXXXXXXXXXXXXXXXXXXXXXDLGGGAPFFGIAGHVMALGVVXXXXXXXXXXXXXXXXXXXXXXXXXXXXXXXXXXXXXXXXXXXXXXXXXXXXXXXXXXXXXXXXXXXXXXXMSLVLAVALCLXSVVMNRTVLSITEASAVGLAAAGQLLKPEADTLWTMPXXXXXXXXXXXXXXXXXXXXXXXXXXXXXXXXXXXXXXXXXXXXXXXLNSCTREEFFVYRRAGILETERDRARELLRRGETXXXXXXXXXXXXXXXXXXXXXXXXXXXXXXXXXXXXXXXXXXXXXXXXMSVKAYTIGGKGHETPRMVTSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRCVFLADDKVKEQDVRERIXXXXXXXXXXXXXNGEHPYRTWQYXXXXXXXXXXXXXXXXXXXXXXXXXXXXXXXXXXXXXXXXXXXXXXXXXXXXXXXXXXXXXXXXXXXXXXXXXDWMLDRLAQKSRPRMCSREEFIXXXRSNAALGAWSDXXXXXXSAKEAVEDPAFWQLVDEERERHLTGRCAHCVXXXXXXXXXXXXXXXXXXXXXXXXXXXXXXXXXXXXXXXXXXXDHWASRGFSGSGVEGISLNYLGWYLKELSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRLFRVERWLRDYGEERLGRMLXXXXXCVVRGIDDRFSGALYFLNDMAXXXXXIGEWEHSAGFAGWEEVPFCSHHXXXXXXXXXXXXXXXXXXXXXXXXXXXXXXXXXXXXXXXXXXXXXXXXXXXXXXXXXRDLRTLGLAISSAVPXXXXXXXXXXXXXXXXXXXXXXXXXXXXXXXXXXLDNPFMHGKEKXXXXXXIPYLPKAQDMLXXXXXXXXXXXXXXXXXWGAVEKVRKMMGXXXXXXXXXXXXXXXXXXXXXXXXXXX

SEQ ID NO: 265837 - protein, 3436 aa, Japanese encephalitis virus
  MOD_RES (111)..(111): Any amino acid
  MOD_RES (120)..(124): Any amino acid
  MOD_RES (683)..(683): Any amino acid
  MOD_RES (1147)..(1147): Any amino acid
  MOD_RES (1853)..(1858): Any amino acid
MTKKPGGPGKNRAINMLKRGLPRVFPLVGVKRVVMSLLDGRGPVRFVLALITFFKFTALAPTKALLGRWKAVEKSVAMKHLTSFKRELGTLIDAVNKRGRKQNKRGGNEGXIMWLASLAXXXXXAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRTIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTEKFSFAKNPADTGHGTVVIELSYSGSDGPCKIPIVSVASLNDMTPVGRLVTVNPFVATSSANSKVLVEMEPPFGDSYIVVGRGXKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDGVEESELIIPHTIAGPKSKHNRREGYKTQNQGPWDENGIVLDFDYCPGTKVTITEDCGKRGPSVRTTTDSGKLITDWCCRSCSLPPLRFRTENGCWYGMEIRPVRHDETTLVRSQVDAXNGEMVDPFQLGLLVMFLATQEVLRKRWTARLTIPAVLGALLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLQERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWEMDAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIMSGEGKLTPYWGSVKEDRIAYGGPWRFDRKWNGTDDVQVIVVEPGKAAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGXXXXXXWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQITLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAHLSREKRPRLCTKEEFIKKVNSNAALGAVFAEQNQWSTAREAVDDPRFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 265838 - protein, 3436 aa, Japanese encephalitis virus
  MOD_RES (111)..(111): Any amino acid
  MOD_RES (120)..(124): Any amino acid
  MOD_RES (149)..(162): Any amino acid
  MOD_RES (317)..(322): Any amino acid
  MOD_RES (387)..(388): Any amino acid
  MOD_RES (683)..(683): Any amino acid
  MOD_RES (749)..(752): Any amino acid
  MOD_RES (814)..(826): Any amino acid
  MOD_RES (880)..(886): Any amino acid
  MOD_RES (955)..(961): Any amino acid
  MOD_RES (1147)..(1147): Any amino acid
  MOD_RES (1224)..(1229): Any amino acid
  MOD_RES (1353)..(1353): Any amino acid
  MOD_RES (1418)..(1420): Any amino acid
  MOD_RES (1446)..(1446): Any amino acid
  MOD_RES (1489)..(1510): Any amino acid
  MOD_RES (1637)..(1637): Any amino acid
  MOD_RES (1730)..(1731): Any amino acid
  MOD_RES (1783)..(1790): Any amino acid
  MOD_RES (1806)..(1815): Any amino acid
  MOD_RES (1853)..(1858): Any amino acid
  MOD_RES (1903)..(1914): Any amino acid
  MOD_RES (1930)..(1931): Any amino acid
  MOD_RES (2038)..(2050): Any amino acid
  MOD_RES (2114)..(2116): Any amino acid
  MOD_RES (2152)..(2154): Any amino acid
  MOD_RES (2265)..(2265): Any amino acid
  MOD_RES (2416)..(2432): Any amino acid
  MOD_RES (2501)..(2504): Any amino acid
  MOD_RES (2588)..(2595): Any amino acid
  MOD_RES (2694)..(2700): Any amino acid
  MOD_RES (2716)..(2718): Any amino acid
  MOD_RES (2745)..(2748): Any amino acid
  MOD_RES (2764)..(2768): Any amino acid
  MOD_RES (2794)..(2795): Any amino acid
  MOD_RES (2883)..(2885): Any amino acid
  MOD_RES (2952)..(2952): Any amino acid
  MOD_RES (2994)..(3016): Any amino acid
  MOD_RES (3086)..(3088): Any amino acid
  MOD_RES (3139)..(3145): Any amino acid
  MOD_RES (3375)..(3377): Any amino acid
MTKKPGGPGRSRAIYMLKRGLPRVFPLVGVKRVVISLLDGRGPARFVLALTSFFKFTALAPTKALLGRWRAVERSVAMKHLTSFKGELGTLIDAVNKRGKKRNKRGGNESXIMWLTSLAXXXXXVGAMRLSNFQGKLLMTVNNTDIADXXXXXXXXXXXXXXVRAIDVGHLCEDTITYECPKLAVGNDPQDVDCWCDNQQVYVQYGPCTRTRHSKRTRRSVSVHPHGESSLVNKKEAWLDSTKATRYLTKTENWIVRNPGYAFLAVALGWMLGSNSGHRLGFTILPLLVAPAYSFTCLGMGNRDFVQGVSGATWVDXXXXXXSCLTIMASDRPTLDVRMINIEAVQLAEVRSYCYRASVTDISTVARCPMTGEAHNEKGADSSYVCXXGFTDRGWGNGCGFSGKGSIDTCAKFSCTRKAIGRMIQPENIKYKVGIFVHGATTSENHGNYSAQVGTSQAAKFTVTPNAPSTALKLGDFGEVTLDCEPKSGLNTEAFYVMTVGSRSLLVHREWFHDLSLPWTPSSNTAWRNRELLMEFEGAHATKQSVVALGSQEGGLHHALAGAIVVEYSSSVMLTSGHVKRRLRMDKLALKGTTYGMCTGNFSFAKNPVDTGHGTVVIELTYSGRDGSCKIPIVSVASLNDLTPAGRLVTVNPFVATSSSNSKVLLEIEPPFGDSYIVVGREXKQINHHWHRPGSTLGKAFLTTLKGAQRLVALGDTAWDFGSIGGVFNSIGRAVHQVFGDAFRTLFGXXXXITQGLMGALLLWMGINARDRSIAMAFLVTGGTLLFLATNVHADTGCAIDITRRQMRCGSGIXXXXXXXXXXXXXKYLPETPRALAKIVHKAHQEGICGIRSVTRLEHQMWESVRDELNVPLKENAVDXXXXXXXPVGRYRSAPKRLFMTQEKVEMGWKAWGKSMLFAPEMANSSFVVDGPETKECPDERRAWNSTQIEDFGFXXXXXXXWLKIREENTDECDGPIIGTAVKGNVALHSDLSYWIESRLNDTWKRERAVFGEIKSCTWPETHTLWGDDVEESELIIPHTIAGPRSKHNRREGYRTQNQGPWDEKGLVPGLDYCPGTTVTITEDCGKRGPSIRTTTDIGKLITDWCCRSCSLPPLGFRTGSGCWYGMEIRPLRHDEATLVRSQVHAXNGEMIDPFQLGLLVVFLATQEVLGKRWTARLTIPAVLGVLLVLMLGGITYIDLARYVVLVAAAFAEANNGGDVLHLXXXXXXKIQPAFLVMNMLSAKWTNQENVALVLGAAFFQLASADLQIGVHGMLNAAAIAWMIIRAITFPTTSTVAMPILALLAPGMRAFCLDTYRIILLVIGICSLLQERRKAMAKKKGAVLMGLALTSTXWFSPTTITAGLMACNPNKKRGWPATEFLSAIGLMFAIVGGLAEMDIESMSIPFMLAVLMAVSYVXXXKATDMWLDRAADISWEMEAAITGSSXRLDVKLDEDGDFHLIDDPGVPWKVWLLRMSCICLVALTPWAIXXXXXXXXXXXXXXXXXXXXXXTPSPKPCLKGDTTTGVYRIMARGILGTHQSGVGVMYESVFHTLWHTTRGAAIVSGGGKLTPYWGSVKEDRISYGGPWRFDRKWNGTNDVQVIVVEPGKPAVNIQTKPGIFPPPFGEIGTVSLDYPRXTSGSPILNSNGDVIGCYGNGGELGDRSYVSAIVQGERQEEPVPDAYTPSMLKKRQLTVLDLHPGSGKTKKILPQIIKDAIQQRLKTAVLAPTXXVAAEMAEALKGLPVRYQTSAVQRSHQGNAIVDVMCHATLTHRLTSPNRVPNXXXXXXXXAHFTDPAGIAARGYIXXXXXXXXXXAIFMTATSPGTTDPFPDSDAPIHDLQDEIPDWAWSSGXXXXXXWITDYSGKTVWFVASVRMGNEIAVCLQRAGKKVIQLSRKSYDTEXXXXXXXXXXXXITTDISEVGANFGASXXIDCRKSVEPTILEEEEGRVFLGNPSPITNASAAQRRGRVSRNPSQVGDEYEYGGATSEGDGNLAHWTEAKILLDNIHMPNGLVVQLYGPEREKASTMDVEYRLRGEXXXXXXXXXXXXXLPVWLAYKVAPNGIQYTDRRWCFDGPRTNAILEDNIEVEIVTRTGERKILKPRWLYARVYADHXXXKWFKDFAAGKRSAISFIEERGRMPEHFAGKTREALXXXYLVATAERGGKTHRMALEELPDALETITLIAAITAMTGGFFLLMMQRKGIGRMGLGALVLVLATFFLWAAEVSGTKIAGTLLVALLLMVVLIPEPGKQRSQTGNQLAVFLXCVLTVVGVAAANEYGMLERTKADLKSMFGGRTQAPGLTGLPSMTLDLRPATAWAWYGGSTVVLTPLLKHIITSEYVTTSLASISSQAGSLFVLPRGVPSTDLDLTVGLVFLGCWGQVTLTTFLTAMVLVILHYGFMLPGWQAQALRAAQRXXXXXXXXXXXXXXXXXTDVPELEKTTPLMQKKIGQVLLIGVSVAALLVNPNVTTVRKAGVLVTARTLSLWDNGASAAWNSTTATXXXXVMRGSYLRGGSIAWTLIKNADKPSLKRGRSGGRTLGDQWKEKLNAMSRDEFFQYRREGIIEVDRTEACRARRENNVVGGHPVSXXXXXXXXLVEKGFVSPIGKVIDLGCGRGSWNYCAATLKKVQEVKGYTKGGAGHEEPMLMQSYGRNLVSLKSGVHVFYRPSEPSDTLLCDIGESSPSPDVEEQRTLXXXXXXXDWLHRGPIEFCIKVLXXXMPKVIEKNEVLQRRFGGGVVRLPLSRXXXXEMYWVSGPAGNVVHAXXXXXQVLLGRMNRTVWRGPRYKEDVNLGSXXRAVGKGEIHSNQEKIRKRIQKLREEFATTWHRDPEHPYRNWTYHGSYEVKANGSASSLVNGVVELMSKPWDTISYVTTMPMTDTTPFXXXRVFKEKVGTMAPEPPAGVREVLNETTNWLWAYLSRKKRPRLCTKEEFIRKVNSNASLGTVFAEQNQXSTAREAVGDPLFWEMVNVERENHLRGECHTCVYHMMGKREKXXXXXXXXXXXXXXXXXXXXXXXLEFEALGSLNEDHWLSRRNSGGGVEGSSVQKLGYISGDIASKEIGKMYADDPAGWDTRITRADLENEAKXXXLLDGEHRKLARAIIELTYKHQVVKVMRPAAGGKTGMVVYSRENQRGSGQVXXXXXXXFTNIAVQFVRLMKVEGVIGPQHLEQLPRKTKIAVRTWLFENGEERVSRMAISGDDCAVKPLDDRFATSLYFLNAMSKVRKDILQWKPSHGWHDWLHVPFCSNHFHEIVMKDGRSLVDPCRGQDELIDRARISPGAGCNVKDTACLAKAYAQMRVLLYFHRRYLCLMANAICSAVPVNWVPTGRTSWSKHSKGEWMTTENMLQVWNKVWIEENEWMVDKTPVASWTDVPYXXXREDIWCGSLIGTRTKATWAENVYAAINQVRAIIGKETYVDYMDFLRRYEDVLVQEDRVI

SEQ ID NO: 265839 - protein, 3436 aa, Japanese encephalitis virus
  MOD_RES (1)..(2): Any amino acid
  MOD_RES (19)..(24): Any amino acid
  MOD_RES (80)..(82): Any amino acid
  MOD_RES (111)..(111): Any amino acid
  MOD_RES (120)..(124): Any amino acid
  MOD_RES (148)..(163): Any amino acid
  MOD_RES (178)..(184): Any amino acid
  MOD_RES (257)..(258): Any amino acid
  MOD_RES (289)..(299): Any amino acid
  MOD_RES (316)..(324): Any amino acid
  MOD_RES (348)..(348): Any amino acid
  MOD_RES (362)..(369): Any amino acid
  MOD_RES (387)..(389): Any amino acid
  MOD_RES (409)..(409): Any amino acid
  MOD_RES (437)..(447): Any amino acid
  MOD_RES (494)..(495): Any amino acid
  MOD_RES (511)..(512): Any amino acid
  MOD_RES (529)..(530): Any amino acid
  MOD_RES (546)..(546): Any amino acid
  MOD_RES (589)..(592): Any amino acid
  MOD_RES (613)..(613): Any amino acid
  MOD_RES (650)..(652): Any amino acid
  MOD_RES (672)..(673): Any amino acid
  MOD_RES (683)..(683): Any amino acid
  MOD_RES (700)..(719): Any amino acid
  MOD_RES (735)..(759): Any amino acid
  MOD_RES (779)..(794): Any amino acid
  MOD_RES (813)..(827): Any amino acid
  MOD_RES (856)..(891): Any amino acid
  MOD_RES (930)..(933): Any amino acid
  MOD_RES (949)..(961): Any amino acid
  MOD_RES (1020)..(1021): Any amino acid
  MOD_RES (1079)..(1081): Any amino acid
  MOD_RES (1100)..(1103): Any amino acid
  MOD_RES (1147)..(1147): Any amino acid
  MOD_RES (1178)..(1178): Any amino acid
  MOD_RES (1200)..(1202): Any amino acid
  MOD_RES (1218)..(1230): Any amino acid
  MOD_RES (1342)..(1358): Any amino acid
  MOD_RES (1369)..(1376): Any amino acid
  MOD_RES (1388)..(1421): Any amino acid
  MOD_RES (1446)..(1452): Any amino acid
  MOD_RES (1487)..(1510): Any amino acid
  MOD_RES (1526)..(1527): Any amino acid
  MOD_RES (1574)..(1574): Any amino acid
  MOD_RES (1585)..(1601): Any amino acid
  MOD_RES (1635)..(1638): Any amino acid
  MOD_RES (1666)..(1671): Any amino acid
  MOD_RES (1728)..(1733): Any amino acid
  MOD_RES (1747)..(1752): Any amino acid
  MOD_RES (1763)..(1836): Any amino acid
  MOD_RES (1852)..(1858): Any amino acid
  MOD_RES (1870)..(1874): Any amino acid
  MOD_RES (1883)..(1887): Any amino acid
  MOD_RES (1898)..(1933): Any amino acid
  MOD_RES (1954)..(1967): Any amino acid
  MOD_RES (1998)..(2018): Any amino acid
  MOD_RES (2034)..(2053): Any amino acid
  MOD_RES (2066)..(2078): Any amino acid
  MOD_RES (2093)..(2098): Any amino acid
  MOD_RES (2107)..(2122): Any amino acid
  MOD_RES (2144)..(2155): Any amino acid
  MOD_RES (2171)..(2176): Any amino acid
  MOD_RES (2213)..(2245): Any amino acid
  MOD_RES (2262)..(2266): Any amino acid
  MOD_RES (2281)..(2281): Any amino acid
  MOD_RES (2316)..(2341): Any amino acid
  MOD_RES (2351)..(2374): Any amino acid
  MOD_RES (2403)..(2454): Any amino acid
  MOD_RES (2489)..(2518): Any amino acid
  MOD_RES (2565)..(2568): Any amino acid
  MOD_RES (2588)..(2601): Any amino acid
  MOD_RES (2639)..(2644): Any amino acid
  MOD_RES (2670)..(2718): Any amino acid
  MOD_RES (2734)..(2770): Any amino acid
  MOD_RES (2792)..(2798): Any amino acid
  MOD_RES (2837)..(2839): Any amino acid
  MOD_RES (2853)..(2861): Any amino acid
  MOD_RES (2875)..(2887): Any amino acid
  MOD_RES (2911)..(2913): Any amino acid
  MOD_RES (2925)..(2926): Any amino acid
  MOD_RES (2949)..(2952): Any amino acid
  MOD_RES (2992)..(3019): Any amino acid
  MOD_RES (3067)..(3070): Any amino acid
  MOD_RES (3085)..(3101): Any amino acid
  MOD_RES (3135)..(3149): Any amino acid
  MOD_RES (3182)..(3184): Any amino acid
  MOD_RES (3196)..(3207): Any amino acid
  MOD_RES (3245)..(3254): Any amino acid
  MOD_RES (3269)..(3277): Any amino acid
  MOD_RES (3329)..(3332): Any amino acid
  MOD_RES (3349)..(3353): Any amino acid
  MOD_RES (3374)..(3383): Any amino acid
  MOD_RES (3400)..(3402): Any amino acid
XXKKPRGPGINRAIYMLKXXXXXXFPLVGVKKVVMSLLDGIGPVRFVLAFVSFFKFTALSPTKALSGRWKALEKSVAMKXXXSFKRELGILIDVVNKRGRKQNKRGGNGGXIMWLACLAXXXXXAGALKLSNFQGKLLMAVNNTDIAXXXXXXXXXXXXXXXXRAIDVGYLCEDTITXXXXXXXAGNDPEDVDCWCDHQEVYIQYGRCTRTSHSQRSKRSVSVQTNGESSLENKKKAWLNSTRATRYLMKTENWIVXXPGYAFLAGILGWMLGSTTGQRVVFTILPLLXXXXXXXXXXXMGNRDFIERASGATWVXXXXXXXXXLTIMANDKPTLDRRMTNIEASQLXEVRSYYYHASVTDXXXXXXXXTTGEAHNKKQADSSYVCXXXFTDRGWGNGCGLSGKGSIDXCAKFSCTNKATGKTIQPENSKYEVGIFXXXXXXXXXXXNYSAQIGVSQAARFTITPNAPSVTLELGDYGEVTLDCEARSGLNTEXXYVMTVGPKSLLVHREXXHDLALPWSSSSNTAWRXXELLMEFEQAHATKQSXVALGSREGALHQALAGAIVVEYPNSVKLTSGHLKCRLRMDKLXXXXTTYGMCTKKSSFRKNPADTGXGTVVIELSYSGSDGSCKIPIVSVANLNDMTPAGRLVXXXPFVAASSANSKALVEMEPPXXDSYIVVGRKXKQINHHWYKPGSTLGKXXXXXXXXXXXXXXXXXXXXDFGSIGGAFNSIGKAXXXXXXXXXXXXXXXXXXXXXXXXXVLLLWMGVNARNRSIALAFXXXXXXXXXXXXXXXXDTGCAIDTARNQMRCGSGXXXXXXXXXXXXXXXYLPETPKSLAKIVHKAHMEGVCGIRSVTXXXXXXXXXXXXXXXXXXXXXXXXXXXXXXXXXXXXRSTPKRLSMTREKFEMGWKAWGKSILFAPELANSSFVVXXXXTKECPVEQRAWNSMQXXXXXXXXXXXXXWLKIREESTDECDGTIIGTAVKGHVTVHSDVSYWIESRFNDTRKLERAVFEEVKSCTWXXTHSLWGDDAEESELIIPHTLAGPKSKHNQREGYMTQNQGPWDESGIVLDFDYCPGTTXXXTEDCSKRAPWVRTTTDIGXXXXDWCCRNCTLPPLRFRTDNGCWYGMEIRPAMHDEATLVRSRVDAXKGEMVDPFQMGLLVMFLATQEVFRKRWTARXTVPAVLGALLVLMFGGITYTDXXXYVVLVAASFAEANSGXXXXXXXXXXXXXIQPAFLVANMLSAKWTNQENMVLVLGAALFQLASMDLQIGVHGILNAAAMAWMIVKAITFPTASSVTMPVLALLTPGMRALDLDTYRIILLIIGVCSLLHERKRTMAKKKGXXXXXXXXXXXXXXXXXTIAAGLMACNXXXXXXXXATEVLSAVGLMXXXXXXXXXXXXXXXXXXXXXXXXXXXXXXXXXXATDMWLEQAADISWDMGAAITGSSXXXXXXXDDDGDFHFIDVPGVPWKIWVLRTSCIGLVALTPWXXXXXXXXXXXXXXXXXXXXXXXXTPSPKPCAKGDTTTGXXRIMACGIFGTYQAGVGVIYQNVLHTLWHTTRGAAVMSGKGKLTPYWXSVREDRIAYGXXXXXXXXXXXXXXXXXIVVEPGKGAANFQTKPGVFCTPFGKVGTVSLDYXXXXSGSPILDFNGDIVGLLGNGVELGDRSYXXXXXXGDRQEEPVPEAYTPNMLRKKQMTVLDLPPGLGKTRKILPQTIRDAIQQHLRTAVLAXXXXXXAEMAEVLRGLPVRXXXXXXQREHQGNAIVXXXXXXXXXXXXXXXXXXXXXXXXXXXXXXXXXXXXXXXXXXXXXXXXXXXXXXXXXXXXXXXXXXXXXXXXXXIHDLQDEVPDRAWSSXXXXXXXWSTEYSGKTVWXXXXXKMGNEIAVXXXXXGKRVIQLNRKXXXXXXXXXXXXXXXXXXXXXXXXXXXXXXXXXXXXCRKSVKPIILEKGEGRVFLGXXXXXXXXXXXXXXGRVGRNPNQVGDEYHYGGATSEDDGNLAHWXXXXXXXXXXXXXXXXXXXXXGPEREKAFTMDVEYRXXXXXXXXXXXXXXXXXXXXWLAYRVASNGIQXXXXXXXXXXXXXNAILEDSTEVEIVTXXXXXXVLKPRWLDXXXXXXXXXXXXXXXXASGKRSAVSFIEVPGRMPEHFXXXXXXXXXXXXLVATAEKSGKAHRMAXXXXXXALETVTLIVAIAVMTRGFFLLMKQRKGIEKMGLGALXXXXXXXXXXXXXXXXXXXXXXXXXXXXXXXXXIPEPEKQKLQTDNQLAXXXXXVLTVVGMVAANEYGXLEKTKADLKSMFAGKAQALGMTGLPSVALDLRPAXXXXXXXXXXXXXXXXXXXXXXXXXXTPSLASISSXXXXXXXXXXXXXXXXXXXXXXXXLLGCWGQITLTTSLTAVVLTTLHYGFMLXXXXXXXXXXXXXXXXXXXXXXXXXXXXXXXXXXXXXXXXXXXXXXXXXXXXIGGSVAAFLVNPKISTVKKPGVLVTAATLSLWDNXXXXXXXXXXXXXXXXXXXXXXXXXXXXXXTLIKNANKPSLKKGGPGGRTLWEQWKEKLNAMGREEFFKYRREGIIXXXXTEARRARSENNKVGGHPVSXXXXXXXXXXXXXXVPPIGKVVDLGCGCGGWSYYAATLKRVQEFRGYTKGGXXXXXXMPMQSYGWNLVSMKSGVDVFYRPSEXXXXXXXXXXXXXXXXXXXXXXXXXXXXXXXXXXXXXXXXXXXXXXXXXMPKVIEKIEVLQRRFXXXXXXXXXXXXXXXXXXXXXXXXXXXXXXXXXXXXXLLGRMDRAVWRGPKYKEDVNLXXXXXXXGKGEVHSDQGKIRRRIQKLREGFGTTWHKDHEHPYRTWXXXGSYEVRATGSASSXXXXXXXXXSKPWDAISYVTTMXXXXXXXXXXXXXFKEKVGTKAPEPPVGVREVLNETXXXLWAHLSRKKRPXXCTKEEFIKKVNSSASLGTVFAEXXXXSTAREAVNDPRFWEMVDVERENHLRGECHTCVYHMMGKRXXXXXXXXXXXXXXXXXXXXXXXXXXXXEALGFLNLNHWLSRENSGGGEEGLGVQKLGYIFRDITRRAIGKMYADXXXXWDTRITKTDLENEAXXXXXXXXXXXXXXXXXIELTYRHQVVKVMRPSTEGKTVMAVISRENQRGXXXXXXXXXXXXXXXAVQLVRLVEAEGVIGPQHLEQLPKENKIAVRTXXXENGGERVTRMAXXXXXXXXXXXXDRFATALYFLNAMSKVTKDIQQWKPSHGWLDWQQVPFXXXXXXXXXXKDGRSILVPCRGQDXXXXXXXXXPGAGWNVRDTACLPKAYAQMWVLLYFHRRDQRLMANAICSTVPLDWVPTGRXXXXIHSKGEWIPTEDMLQVXXXXXIEENEWMEDMTPIASWTDVPXXXXXXXXXXGSLIGTRSRATWAENVXXXINQVRAILGKEDYVDYMLSPQRIEDVSIQEDRVI

SEQ ID NO: 265840 - protein, 3436 aa, Japanese encephalitis virus
  MOD_RES (1)..(3): Any amino acid
  MOD_RES (18)..(27): Any amino acid
  MOD_RES (37)..(42): Any amino acid
  MOD_RES (58)..(64): Any amino acid
  MOD_RES (78)..(86): Any amino acid
  MOD_RES (102)..(102): Any amino acid
  MOD_RES (111)..(111): Any amino acid
  MOD_RES (120)..(124): Any amino acid
  MOD_RES (136)..(184): Any amino acid
  MOD_RES (193)..(195): Any amino acid
  MOD_RES (206)..(210): Any amino acid
  MOD_RES (226)..(228): Any amino acid
  MOD_RES (257)..(266): Any amino acid
  MOD_RES (286)..(300): Any amino acid
  MOD_RES (315)..(329): Any amino acid
  MOD_RES (338)..(371): Any amino acid
  MOD_RES (385)..(393): Any amino acid
  MOD_RES (405)..(412): Any amino acid
  MOD_RES (434)..(447): Any amino acid
  MOD_RES (479)..(497): Any amino acid
  MOD_RES (510)..(513): Any amino acid
  MOD_RES (528)..(547): Any amino acid
  MOD_RES (563)..(565): Any amino acid
  MOD_RES (577)..(592): Any amino acid
  MOD_RES (608)..(617): Any amino acid
  MOD_RES (629)..(634): Any amino acid
  MOD_RES (646)..(655): Any amino acid
  MOD_RES (671)..(674): Any amino acid
  MOD_RES (683)..(683): Any amino acid
  MOD_RES (699)..(719): Any amino acid
  MOD_RES (735)..(794): Any amino acid
  MOD_RES (811)..(837): Any amino acid
  MOD_RES (853)..(914): Any amino acid
  MOD_RES (924)..(933): Any amino acid
  MOD_RES (949)..(968): Any amino acid
  MOD_RES (977)..(979): Any amino acid
  MOD_RES (1017)..(1022): Any amino acid
  MOD_RES (1047)..(1047): Any amino acid
  MOD_RES (1073)..(1084): Any amino acid
  MOD_RES (1100)..(1108): Any amino acid
  MOD_RES (1124)..(1124): Any amino acid
  MOD_RES (1147)..(1147): Any amino acid
  MOD_RES (1158)..(1208): Any amino acid
  MOD_RES (1218)..(1231): Any amino acid
  MOD_RES (1267)..(1288): Any amino acid
  MOD_RES (1317)..(1321): Any amino acid
  MOD_RES (1341)..(1425): Any amino acid
  MOD_RES (1444)..(1467): Any amino acid
  MOD_RES (1486)..(1540): Any amino acid
  MOD_RES (1555)..(1555): Any amino acid
  MOD_RES (1571)..(1601): Any amino acid
  MOD_RES (1634)..(1678): Any amino acid
  MOD_RES (1697)..(1698): Any amino acid
  MOD_RES (1707)..(1839): Any amino acid
  MOD_RES (1852)..(1858): Any amino acid
  MOD_RES (1868)..(1937): Any amino acid
  MOD_RES (1947)..(1984): Any amino acid
  MOD_RES (1994)..(2022): Any amino acid
  MOD_RES (2034)..(2122): Any amino acid
  MOD_RES (2138)..(2158): Any amino acid
  MOD_RES (2170)..(2177): Any amino acid
  MOD_RES (2196)..(2198): Any amino acid
  MOD_RES (2207)..(2246): Any amino acid
  MOD_RES (2261)..(2286): Any amino acid
  MOD_RES (2315)..(2379): Any amino acid
  MOD_RES (2402)..(2461): Any amino acid
  MOD_RES (2476)..(2521): Any amino acid
  MOD_RES (2559)..(2572): Any amino acid
  MOD_RES (2584)..(2613): Any amino acid
  MOD_RES (2623)..(2624): Any amino acid
  MOD_RES (2635)..(2798): Any amino acid
  MOD_RES (2830)..(2893): Any amino acid
  MOD_RES (2904)..(2931): Any amino acid
  MOD_RES (2947)..(2952): Any amino acid
  MOD_RES (2975)..(2978): Any amino acid
  MOD_RES (2991)..(3020): Any amino acid
  MOD_RES (3065)..(3110): Any amino acid
  MOD_RES (3127)..(3165): Any amino acid
  MOD_RES (3181)..(3220): Any amino acid
  MOD_RES (3233)..(3277): Any amino acid
  MOD_RES (3293)..(3301): Any amino acid
  MOD_RES (3326)..(3353): Any amino acid
  MOD_RES (3371)..(3383): Any amino acid
  MOD_RES (3399)..(3406): Any amino acid
  MOD_RES (3422)..(3422): Any amino acid
XXXKPGGPGKSRAINMLXXXXXXXXXXVRVKRVVMSXXXXXXPLRFVLALVSFFKFTXXXXXXXLLGRWRALEKSVAXXXXXXXXXELGTLIDGVNKRGRKXNKRGGNERXIMWLASVAXXXXXVGAIKLSNFQGXXXXXXXXXXXXXXXXXXXXXXXXXXXXXXXXXXXXXXXXXXXXXXXXXTGNDPEDVXXXCDNQEVYIQYXXXXXTRHSKTSRRSVSVQPXXXRSLVNKKEAWLDSTKATRYLVKTENWIVXXXXXXXXXXTLGWMLGSTNGPRVVFTILXXXXXXXXXXXXXXXGNRDFIERASGATWXXXXXXXXXXXXXXXNDKPTLDRXXXXXXXXXXXXXXXXXXXXXXXXXXXXXXXXXXGEAHNEKGADSSYXXXXXXXXXGWGKGCGLFGKXXXXXXXXFSCTSKAIERAIQSENIKYEVXXXXXXXXXXXXXXNYTAQVGASQAARFTVTPNAPSVTLELGDYGXXXXXXXXXXXXXXXXXXXMTVGSKSLLVHRXXXXDLALPWTSSSNTAWXXXXXXXXXXXXXXXXXXXXALGSQERSLHQALAGXXXVEYSNSVKLTSXXXXXXXXXXXXXXXXTTYGVCTENSSFRKNXXXXXXXXXXIELLYSGSDGPXXXXXXSVVSLNDMTPAXXXXXXXXXXATSSSNSQVLVEMEPXXXXSYIVVGMGXKQISHHRHKPGSTLGXXXXXXXXXXXXXXXXXXXXXDFGSIGGIFNSIGKAXXXXXXXXXXXXXXXXXXXXXXXXXXXXXXXXXXXXXXXXXXXXXXXXXXXXXXXXXXXXDTGCAIDVTRNQMRCGXXXXXXXXXXXXXXXXXXXXXXXXXXXKIVHKAHKEGVCGIRXXXXXXXXXXXXXXXXXXXXXXXXXXXXXXXXXXXXXXXXXXXXXXXXXXXXXXXXXXXXXXSLLFAPELAXXXXXXXXXXTKECPDVRRAWNSTQXXXXXXXXXXXXXXXXXXXXTTDECDGAXXXTAVKGHVTVHSDLSYWIGSRYNDTWKRERLVFGEVKSXXXXXXHTLWGDGVEESDLVIPDTIAGPKSXHNRREGYMTQNQGPWDENGLVPGLDXXXXXXXXXXXXCGKRGPSLRTTTDSGXXXXXXXXXSCTLPPLRFRTGSGCXYGMEVRPVGHDETTLVRSQADAXSGGMVDPFQLXXXXXXXXXXXXXXXXXXXXXXXXXXXXXXXXXXXXXXXXXXXXXXXXXXXAVFAEANSGXXXXXXXXXXXXXXQPAFLAMNTLSTRWTNQENVILVLGAAFFQLASMDXXXXXXXXXXXXXXXXXXXXXXTFPTTSTVTMPLLTLLTPGMKALYLDTYXXXXXVIGICSLQQERRRTMAKKKXXXXXXXXXXXXXXXXXXXXXXXXXXXXXXXXXXXXXXXXXXXXXXXXXXXXXXXXXXXXXXXXXXXXXXXXXXXXXXXXXXXXXWLERAADVSWEMGAAITGXXXXXXXXXXXXXXXXXXXXXXXXWKVWVLRMSCSGLAALTPXXXXXXXXXXXXXXXXXXXXXXXXXXXXXXXXXXXXXXXXXXXXXXXXXXXXXXXGVGVMYESVFHTLWXPTRGAAIMSGKGKLTXXXXXXXXXXXXXXXXXXXXXXXXXXXXXXXIVVEQGKPATSIQTKPGVFRTPFGKVGAVSLDXXXXXXXXXXXXXXXXXXXXXXXXXXXXXXXXXXXXXXXXXXXXXIPEAYTPTMLKKKQMTVLXXHPGLGKTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLQDETPDRAWSSXXXXXXXWITEYSGKTXXXXXXXXXXXXXXXXXXXXXXXXXXXXXXXXXXXXXXXXXXXXXXXXXXXXXXXXXXXXXXXXXXXXXXVKPIILEEGXXXXXXXXXXXXXXXXXXXXXXXXXXXXXXXXXXXXXXGPTSEDDSNXXXXXXXXXXXXXXXXXXXXXXXXXXXXXEKALTMDGEYRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAAGKRSAISFIEVRGXXXXXXXXXXXXXXXXXXXXXTAEKSGKAHRMXXXXXXXXLETITLTVAITVMTRGFFXXXMQRKGIEKXXXXXXXXXXXXXXXXXXXXXXXXXXXXXXXXXXXXXXXXPEPEKQRSQTGNQLXXXXXXXXXXXXXXXXXXXXXXXXXXADLKSMFVGKTPVSGLTGLPGMALDLRPXXXXXXXXXXXXXXXXXXXXXXXXXXXXXXXXXXXXXXXXXXXXXXXXXXXXXXXXXXXXXXXXXGQITLTTVLTAMVLAILHYGYMXXXXXXXXXXXXXXXXXXXXXXXXXXXXXXXXXXXXXXXXXXXXXXXXXXXXXXXXXXXXFLVNPNVSTVRKAGXXXXXXXXXXXXXXXXXXXXXXXXXXXXXXXXXXXXXXXXXXXXXXKNADNPSFKRGGPGGRTLGEQWKERLNAMSREEFFQYXXXXXXXXXXXXXXRARRENNKVGGXXXXXXXXXXXXXXXXXXXXXXXXXXXXXXGRGGWSYCAXXLKKVQEFRGYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGKGEVHSTQDKIRKRIQKLREEFATTWHRDPXXXXXXXXXXXXXXXXXXXXXXXXXXXXXXXXXXXXXXXXXXXXXXXXXXXXXXXXXXXXXXXXTKAPEPPPGVXXXXXXXXXXXXXXXXXXXXXXXXXXXXFIKKVNSNASLGTVFXXXXXXSTAREAVSDSLLWEIVDEERENXXXXECHTRIYNMMGKXXXXXXXXXXXXXXXXXXXXXXXXXXXXXXALGFLNEDHWLSRENSGGGVEGLGVQKLGYIIRDIAVKQGGKMYXXXXXXXXXXXXXXXXXXXXXXXXXXXXXXXXXXXXXXXXXXXXXXFKVMRPASKGKTGMAVXXXXXXXXXXXXXXXXXXXXXXXXXXXXXXXXXXXXXXXQHVEQLPRENKIAVRXXXXXXXXXXXXXXXXXXXXXXXXXXXXXXXXXXXXXXXXSKVRRDIQEWKPXXXXXXXXXXXXXXXXXXXXXXXXXXXXXXXXXXXXXXXXXXXXXPGAGWNVMDTACLAKXXXXXXXXXYFHRRDQRLMANAICSAVPLDWVPXXXXXXXXXXXXXXXXXXXXXXXXXXXXIEENEWMTDKTPIASWTXXXXXXXXXXXXXGSLIGTRARATWAENXXXXXXXXRAIIGKENYVDYMDFXRRYEDVLTQEDRVI

SEQ ID NO: 265841 - protein, 3434 aa, Japanese encephalitis virus
  MOD_RES (1)..(43): Any amino acid
  MOD_RES (52)..(86): Any amino acid
  MOD_RES (102)..(111): Any amino acid
  MOD_RES (120)..(124): Any amino acid
  MOD_RES (133)..(184): Any amino acid
  MOD_RES (193)..(301): Any amino acid
  MOD_RES (314)..(394): Any amino acid
  MOD_RES (404)..(413): Any amino acid
  MOD_RES (431)..(452): Any amino acid
  MOD_RES (461)..(465): Any amino acid
  MOD_RES (477)..(514): Any amino acid
  MOD_RES (524)..(550): Any amino acid
  MOD_RES (560)..(593): Any amino acid
  MOD_RES (605)..(620): Any amino acid
  MOD_RES (629)..(656): Any amino acid
  MOD_RES (668)..(674): Any amino acid
  MOD_RES (683)..(684): Any amino acid
  MOD_RES (698)..(725): Any amino acid
  MOD_RES (734)..(795): Any amino acid
  MOD_RES (805)..(840): Any amino acid
  MOD_RES (853)..(939): Any amino acid
  MOD_RES (948)..(968): Any amino acid
  MOD_RES (977)..(980): Any amino acid
  MOD_RES (990)..(992): Any amino acid
  MOD_RES (1011)..(1059): Any amino acid
  MOD_RES (1073)..(1084): Any amino acid
  MOD_RES (1094)..(1132): Any amino acid
  MOD_RES (1147)..(1147): Any amino acid
  MOD_RES (1156)..(1235): Any amino acid
  MOD_RES (1247)..(1289): Any amino acid
  MOD_RES (1300)..(1304): Any amino acid
  MOD_RES (1313)..(1325): Any amino acid
  MOD_RES (1341)..(1428): Any amino acid
  MOD_RES (1444)..(1471): Any amino acid
  MOD_RES (1483)..(1542): Any amino acid
  MOD_RES (1553)..(1558): Any amino acid
  MOD_RES (1570)..(1601): Any amino acid
  MOD_RES (1632)..(1678): Any amino acid
  MOD_RES (1693)..(2128): Any amino acid
  MOD_RES (2138)..(2177): Any amino acid
  MOD_RES (2188)..(2249): Any amino acid
  MOD_RES (2258)..(2288): Any amino acid
  MOD_RES (2300)..(2387): Any amino acid
  MOD_RES (2402)..(2523): Any amino acid
  MOD_RES (2537)..(2538): Any amino acid
  MOD_RES (2558)..(2806): Any amino acid
  MOD_RES (2825)..(2893): Any amino acid
  MOD_RES (2904)..(2931): Any amino acid
  MOD_RES (2947)..(2954): Any amino acid
  MOD_RES (2972)..(3036): Any amino acid
  MOD_RES (3045)..(3111): Any amino acid
  MOD_RES (3127)..(3166): Any amino acid
  MOD_RES (3178)..(3355): Any amino acid
  MOD_RES (3366)..(3384): Any amino acid
  MOD_RES (3393)..(3406): Any amino acid
  MOD_RES (3422)..(3422): Any amino acid
  MOD_RES (3433)..(3434): Any amino acid
XXXXXXXXXXXXXXXXXXXXXXXXXXXXXXXXXXXXXXXXXXXVRFVLAFIXXXXXXXXXXXXXXXXXXXXXXXXXXXXXXXXXXXELGTLIDTVNKRGRKXXXXXXXXXXTLWFMSLTXXXXXAGAIKLSNXXXXXXXXXXXXXXXXXXXXXXXXXXXXXXXXXXXXXXXXXXXXXXXXXXXXPGNDPQDVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRDFIQGASGATXXXXXXXXXXXXXXXXXXXXXXXXXXXXXXXXXXXXXXXXXXXXXXXXXXXXXXXXXXXXXXXXXXXXXXXXXXXXXXXXXWRNGCGLFGXXXXXXXXXXSCTSKAIGRMIQSENIKXXXXXXXXXXXXXXXXXXXXXXVGASQAARXXXXXNAPSVTLKLGDXXXXXXXXXXXXXXXXXXXXXXXXXXXXXXXXXXXXXXLALPWTSSSXXXXXXXXXXXXXXXXXXXXXXXXXXXSQERALHQAXXXXXXXXXXXXXXXXXXXXXXXXXXXXXXXXXXTYGMCTENSSFXXXXXXXXXXXXXXXXSYSGRDGPXXXXXXXXXXXXXXXXXXXXXXXXXXXXTSSSNSQVLVEXXXXXXXSYIVIGRGXXQINHHWHKPGSTLXXXXXXXXXXXXXXXXXXXXXXXXXXXXRVFNSIGKXXXXXXXXXXXXXXXXXXXXXXXXXXXXXXXXXXXXXXXXXXXXXXXXXXXXXXXXXXXXXXTGSAIDITRXXXXXXXXXXXXXXXXXXXXXXXXXXXXXXXXXXXXHKAYMEGVCGVRXXXXXXXXXXXXXXXXXXXXXXXXXXXXXXXXXXXXXXXXXXXXXXXXXXXXXXXXXXXXXXXXXXXXXXXXXXXXXXXXXXXXXXXERRAWNSTXXXXXXXXXXXXXXXXXXXXXNTDECDGTXXXXAIKGHVAVHXXXSYWIESHLNDSWKLERAVXXXXXXXXXXXXXXXXXXXXXXXXXXXXXXXXXXXXXXXXXXXXXXXXXGPWDEDGIVLDFDXXXXXXXXXXXXCGKRGPSLRXXXXXXXXXXXXXXXXXXXXXXXXXXXXXXXXXXXXXXXKHDETTLVRWQVDAXNGGMVDPFXXXXXXXXXXXXXXXXXXXXXXXXXXXXXXXXXXXXXXXXXXXXXXXXXXXXXXXXXXXXXXXXXXXXXXXXXXXXXXXXLAMKMLSTRWTXXXXXXXXXXXXXXXXXXXXXXXXXXXXXXXXXXXXXXXXXXXFPTTSTITMPXXXXXTPGMRAFDXXXXXXXXXXXXXCSLLQEREKTMAKKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAADISWGMDAAITGXXXXXXXXXXXXXXXXXXXXXXXXXXXXVLRMSCSGLAAXXXXXXXXXXXXXXXXXXXXXXXXXXXXXXXXXXXXXXXXXXXXXXXXXXXXXXXXXXXXGVMYESVFHTXXXXXXGAAIMSGGGKLXXXXXXXXXXXXXXXXXXXXXXXXXXXXXXXXIVVEPGKVAVNFQTKPGIFPTPLGEVGAVSXXXXXXXXXXXXXXXXXXXXXXXXXXXXXXXXXXXXXXXXXXXXXXXVPEAYNPSMLKKKQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXATSFIEVLGXXXXXXXXXXXXXXXXXXXXXXXXXXXXXXXXXXXXXXXXLETITLIIAIXXXXXXXXXXXXXXXXXXXXXXXXXXXXXXXXXXXXXXXXXXXXXXXXXXXXXXXXXXXXXXEKQKSQTDXXXXXXXXXXXXXXXXXXXXXXXXXXXXXXXIKSMFGGKAPVXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTAVVLATLHYGFMXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXADNPSLKRGGPGGXXLGDQWKRKLNALSREEFFKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQKKIKKRIQKQKEEFATTXXXXXXXXXXXXXXXXXXXXXXXXXXXXXXXXXXXXXXXXXXXXXXXXXXXXXXXXXXXXXXXXXXXXXTKAPEPPTGAXXXXXXXXXXXXXXXXXXXXXXXXXXXXFINKVNSDAALGAVFXXXXXXXXAREAVGDPRFWEIVDEEXXXXXXXXXXXXXXXXXXXXXXXXXXXXXXXXXXXXXXXXXXXXXXXXXXXXXXXXXXXXXXXXXRGGVEGSSXXXXXXXXXXXXXXXXXXXXXXXXXXXXXXXXXXXXXXXXXXXXXXXXXXXXXXXXXXXXXXXXXXXKVMRPAADGKTVMDVXXXXXXXXXXXXXXXXXXXXXXXXXXXXXXXXXXXXXXXXHLEHLPRKNKIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXENEWMMDMTPXXXXXXXXXXXXXXXXXXXNLIGTRSRXXXXXXXXXXXXXXRAIIGKENYVDYMLSXRRYEDVLTQEXX

SEQ ID NO: 265842 - protein, 3436 aa, Japanese encephalitis virus
  MOD_RES (111)..(124): Any amino acid
  MOD_RES (683)..(683): Any amino acid
  MOD_RES (1147)..(1147): Any amino acid
  MOD_RES (1853)..(1858): Any amino acid
  MOD_RES (2963)..(2963): Any amino acid
MTKKPGGPGKNRAINMLKRGLPRVFPLVGVKRVVMSLLDGRGPVRFVLALITFFKFTALAPTKALLGRWKAVEKSVAMKHLTSFKRELGTLIDAVNKRGRKQNKRGGNEGXXXXXXXXXXXXXXAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAVLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRTIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTEKFSFAKNPADTGHGTVVIELSYSGSDGPCKIPIVSVASLNDMTPVGRLVTVNPFVATSSANSKVLVEMEPPFGDSYIVVGRGXKQINHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDGVEESELIIPHTIAGPKSKHNRREGYKTQNQGPWDENGIVLDFDYCPGTKVTITEDCGKRGPSVRTTTDSGKLITDWCCRSCSLPPLRFRTENGCWYGMEIRPVRHDETTLVRSQVDAXNGEMVDPFQLGLLVMFLATQEVLRKRWTARLTIPAVLGALLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLQERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWEMDAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIMSGEGKLTPYWGSVKEDRIAYGGPWRFDRKWNGTDDVQVIVVEPGKAAVNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGXXXXXXWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQITLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPAGAKEVLNETTNWLWAHLSREKRPRLCTKEEFIKKVNSNAALGAVFAEQNQWSTAREAVDDPXFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 265843 - protein, 3436 aa, Japanese encephalitis virus
  MOD_RES (111)..(124): Any amino acid
  MOD_RES (150)..(161): Any amino acid
  MOD_RES (318)..(321): Any amino acid
  MOD_RES (683)..(683): Any amino acid
  MOD_RES (750)..(751): Any amino acid
  MOD_RES (815)..(825): Any amino acid
  MOD_RES (881)..(885): Any amino acid
  MOD_RES (956)..(960): Any amino acid
  MOD_RES (1147)..(1147): Any amino acid
  MOD_RES (1225)..(1228): Any amino acid
  MOD_RES (1419)..(1419): Any amino acid
  MOD_RES (1490)..(1509): Any amino acid
  MOD_RES (1784)..(1789): Any amino acid
  MOD_RES (1807)..(1814): Any amino acid
  MOD_RES (1853)..(1858): Any amino acid
  MOD_RES (1904)..(1913): Any amino acid
  MOD_RES (2039)..(2049): Any amino acid
  MOD_RES (2115)..(2115): Any amino acid
  MOD_RES (2153)..(2153): Any amino acid
  MOD_RES (2417)..(2431): Any amino acid
  MOD_RES (2502)..(2503): Any amino acid
  MOD_RES (2589)..(2594): Any amino acid
  MOD_RES (2695)..(2699): Any amino acid
  MOD_RES (2717)..(2717): Any amino acid
  MOD_RES (2746)..(2747): Any amino acid
  MOD_RES (2765)..(2767): Any amino acid
  MOD_RES (2884)..(2884): Any amino acid
  MOD_RES (2963)..(2963): Any amino acid
  MOD_RES (2995)..(3015): Any amino acid
  MOD_RES (3087)..(3087): Any amino acid
  MOD_RES (3140)..(3144): Any amino acid
  MOD_RES (3376)..(3376): Any amino acid
MTKKPGGPGRNRAIYMLKRGLPRVFPLVGVKKVVISLLDGRGPARFVLALTSFFKFTALAPTKALLGRWRAVERSVAMKHLTSFKRELGTLIDAVNKRGKKQNKRGGNESXXXXXXXXXXXXXXVGAMRLSNFQGKLLMTVNNTDIADVXXXXXXXXXXXXWVRAIDVGHLCEDTITYECPKLAVGNDPQDVDCWCDNQQVYVQYGPCTRTRHSKRTRRSVSVHPHGERSLVNKKKAWLDSTKATRYLMKTENWIVRNPGYAFLAVALGWMLGSNSGHRLVFTILPLLVAPAYSFTCLGMGNRDFVEGVSGATWVDLXXXXDSCLTIMASDKPTLDVRMINIEAVQLAEVRSYYYRASVTDISTVARCPMTGEAHNKKGADSSYVCKQGFTDRGWGNGCGFSGKGSIDTCAKFSCTRKAIGRMIQPENIKYKVGIFVHGATTSENHGNYSAQVGASQAAKFTVTPNAPSTALELGDFGEVTLDCEPKSGLNTEAFYVMTVGSRSLLVHREWFHDLSLPWTPSSNTAWRNRELLMEFEGAHATKQSVVALGSQEGGLHHALAGAIVVEYSSSVMLTSGHVKCRLRMDKLALKGTTYGMCTGKFSFAKNPVDTGHGTVVIELTYSGSDGSCKIPIVSVASLNDLTPAGRLVTVNPFVATSSSNSQVLLEIEPPFGDSYIVVGRKXKQINHHWHRPGSTLGKAFLTTLKGAQRLVALGDTAWDFGSIGGVFNSIGRAVHQVFGDAFRTLFGGXXWITQGLMGALLLWMGINARNRSIAMAFLVTGGTLLFLATNVHADTGCAIDITRRQMRCGSGIFXXXXXXXXXXXYKYLPETPRALAKIVHKAHQEGICGIRSVTRLEHQMWESVRDELNVPLKENAVDLXXXXXKPVGRYRSAPKRLFMTREKVEMGWKAWGKSILFAPEMANSSFVVDGPETKECPDERRAWNSTQIEDFGFGXXXXXVWLKIREENTDECDGPIIGTAVKGNVAVHSDLSYWIESRLNDTRKLERAVFGEIKSCTWPETHTLWGDDVEESELIIPHTIAGPRSKHNRREGYRTQNQGPWDENGLVPDLDYCPGTKVTITEDCGKRGPSIRTTTDIGKLITDWCCRSCSLPPLGFRTGSGCWYGMEIRPLRHDEATLVRSQVHAXNGEMIDPFQLGLLVVFLATQEVFGKRWTARLTIPAVLGVLLVLMLGGITYIDLARYVVLVAAAFAEANNGGDVLHLAXXXXFKIQPAFLVMNMLSARWTNQENVALVLGAAFFQLASADLQIGVHGILNAAAMAWMIVRAITFPTTSTVAMPILALLTPGMRALCLDTYRIILLVIGICSLLHERRKAMAKKKGAVLMGLALTSTGWFSPTTITAGLMACNPNKKRGWPATEFLSAIGLMFAIVGGLAEMDIESMSIPFMLAVLMAVSYVVXGKATDMWLDRAADISWEMEAAITGSSRRLDVKLDEDGDFHLIDVPGVPWKVWLLRMSCICLVALTPWAIVXXXXXXXXXXXXXXXXXXXXDTPSPKPCLKGDTTTGVYRIMARGILGTYQSGVGVMYENVLHTLWHTTRGAAIVSGKGKLTPYWGSVKEDRISYGGPWRFDRKWNGTNDVQVIVVEPGKPAVNIQTKPGVFRTPFGEIGTVSLDYPRGTSGSPILNFNGDVVGCLGNGVELGDRSYVSAIVQGDRQEEPVPDAYTPSMLKKRQLTVLDLHPGSGKTKKILPQIIKDAIQQHLKTAVLAPTRVVAAEMAEALKGLPVRYQTSAVQRSHQGNAIVDVMCHATLTHRLTSPNRVPNYXXXXXXEAHFTDPAGIAARGYIAXXXXXXXXAAIFMTATSPGTTDPFPDSDAPIHDLQDEVPDRAWSSGXXXXXXWITDYSGKTVWFVASVRMGNEIAMCLQRAGKKVIQLSRKSYDTEYXXXXXXXXXXVITTDISEVGANFGASRVIDCRKSVKPIILEEGEGRVFLGNPSPITNASAAQRRGRVSRNPSQVGDEYHYGGATSEGDGNLAHWTEAKILLDNIHMPNGLVVQLYGPEREKASTMDVEYRLRGEEXXXXXXXXXXXDLPVWLAYKVAPNGIQYTDRRWCFDGPRTNAILEDNIEVEIVTRTGERKILKPRWLYARVYADHQXLKWFKDFAAGKRSAISFIEERGRMPEHFAGKTREALDXMYLVATAERSGKTHRMALEELPDALETITLIAAITAMTGGFFLLMMQRKGIGRMGLGALVLVLATFFLWAAEVSGTKIAGTLLVALLLMVVLIPEPGKQRSQTGNQLAVFLICVLTVVGVAAANEYGMLERTKADLKSMFGGRTQAPGLTGLPSVTLDLRPATAWAWYGGSTVVLTPLLKHIITSEYVTTSLASISSQAGSLFVLPRGVPSTDLDLTVGLVFLGCWGQVTLTTFLTAMVLVTLHYGFMLPGWQAQALRAAQRRXXXXXXXXXXXXXXXATDVPELEKTTPLMQKKIGQVLLIGVSVAALLVNPNISTVKEAGVLVTARTLSLWDNGASAAWNSTTATGXXHVMRGSYLRGGSIAWTLIKNADKPSLKKGRSGGRTLGEQWKEKLNAMSRDEFFKYRREGIIEVDRTEARRARRENNVVGGHPVSRXXXXXXWLVEKGFVSPIGKVIDLGCGRGSWNYCAATLKKVQEVKGYTKGGAGHEEPMLMQSYGRNLVSLKSGVHVFYRPSEPSDTLLCDIGESSPSPDVEEQRTLRXXXXXSDWLHRGPIEFCIKVLCXYMPKVIEKIEVLQRRFGGGVVRLPLSRNXXHEMYWVSGPAGNVVHAVXXXSQVLLGRMDRTVWRGPKYKEDVNLGSGTRAVGKGEIHSNQEKIRKRIQKLREGFGTTWHKDHEHPYRNWTYHGSYEVKANGSASSLVNGVVKLMSKPWDTISYVTTMPMTDTTPFGXQRVFKEKVGTKAPEPPTGVREVLNETTNWLWAYLSRKKRPRLCTKEEFIRKVNSNASLGTVFAEQNQWSTAREAVGDPXFWEMVNVERENHLRGECHTCVYHMMGKREKKXXXXXXXXXXXXXXXXXXXXXYLEFEALGFLNENHWLSRENSGGGVEGSSVQKLGYIFRDITVKAIGKMYADDPAGWDTRITRADLENEAKVXELLDGEHRKLARAIIELTYKHQVFKVMRPAAGGKTVMVVYSRENQRGSGQVVXXXXXTFTNIAVQLVRLMKVEGVIGPQHLEQLPRKTKIAVRTWLFENGEERVSRMAISGDDCAVKPLDDRFATSLYFLNAMSKVTRDIQQWKPSHGWLDWLHVPFCSNHFHEIVMKDGRSLVDPCRGQDELIDRARISPGAGCNVMDTACLAKAYAQMRLLLYFHRRYLCLMANAICSAVPLNWVPTGRTSWSKHSKGEWMTTENMLQVWNKVWIEENEWMVDKTPVASWTDVPYVXKREDIWCGSLIGTRTKATWAENVYAAINQVRAIIGKENYVDYMLSLRRYEDVLVQEDRVI

SEQ ID NO: 265844 - protein, 3436 aa, Japanese encephalitis virus
  MOD_RES (1)..(1): Any amino acid
  MOD_RES (20)..(23): Any amino acid
  MOD_RES (81)..(81): Any amino acid
  MOD_RES (111)..(124): Any amino acid
  MOD_RES (149)..(162): Any amino acid
  MOD_RES (179)..(184): Any amino acid
  MOD_RES (290)..(298): Any amino acid
  MOD_RES (317)..(323): Any amino acid
  MOD_RES (363)..(368): Any amino acid
  MOD_RES (388)..(388): Any amino acid
  MOD_RES (441)..(446): Any amino acid
  MOD_RES (590)..(591): Any amino acid
  MOD_RES (651)..(651): Any amino acid
  MOD_RES (683)..(683): Any amino acid
  MOD_RES (701)..(718): Any amino acid
  MOD_RES (742)..(758): Any amino acid
  MOD_RES (780)..(793): Any amino acid
  MOD_RES (814)..(826): Any amino acid
  MOD_RES (857)..(863): Any amino acid
  MOD_RES (873)..(890): Any amino acid
  MOD_RES (931)..(932): Any amino acid
  MOD_RES (950)..(960): Any amino acid
  MOD_RES (1101)..(1102): Any amino acid
  MOD_RES (1147)..(1147): Any amino acid
  MOD_RES (1201)..(1201): Any amino acid
  MOD_RES (1219)..(1229): Any amino acid
  MOD_RES (1343)..(1357): Any amino acid
  MOD_RES (1370)..(1375): Any amino acid
  MOD_RES (1389)..(1420): Any amino acid
  MOD_RES (1447)..(1451): Any amino acid
  MOD_RES (1488)..(1509): Any amino acid
  MOD_RES (1586)..(1600): Any amino acid
  MOD_RES (1636)..(1637): Any amino acid
  MOD_RES (1667)..(1670): Any amino acid
  MOD_RES (1729)..(1732): Any amino acid
  MOD_RES (1748)..(1751): Any amino acid
  MOD_RES (1764)..(1835): Any amino acid
  MOD_RES (1853)..(1858): Any amino acid
  MOD_RES (1871)..(1873): Any amino acid
  MOD_RES (1899)..(1932): Any amino acid
  MOD_RES (1955)..(1966): Any amino acid
  MOD_RES (1999)..(2017): Any amino acid
  MOD_RES (2035)..(2052): Any amino acid
  MOD_RES (2067)..(2077): Any amino acid
  MOD_RES (2095)..(2097): Any amino acid
  MOD_RES (2108)..(2121): Any amino acid
  MOD_RES (2145)..(2154): Any amino acid
  MOD_RES (2172)..(2175): Any amino acid
  MOD_RES (2214)..(2244): Any amino acid
  MOD_RES (2263)..(2265): Any amino acid
  MOD_RES (2317)..(2334): Any amino acid
  MOD_RES (2352)..(2373): Any amino acid
  MOD_RES (2404)..(2453): Any amino acid
  MOD_RES (2490)..(2517): Any amino acid
  MOD_RES (2566)..(2567): Any amino acid
  MOD_RES (2589)..(2600): Any amino acid
  MOD_RES (2640)..(2643): Any amino acid
  MOD_RES (2671)..(2717): Any amino acid
  MOD_RES (2735)..(2769): Any amino acid
  MOD_RES (2793)..(2797): Any amino acid
  MOD_RES (2838)..(2838): Any amino acid
  MOD_RES (2854)..(2858): Any amino acid
  MOD_RES (2876)..(2886): Any amino acid
  MOD_RES (2912)..(2912): Any amino acid
  MOD_RES (2950)..(2951): Any amino acid
  MOD_RES (2963)..(2963): Any amino acid
  MOD_RES (2993)..(3018): Any amino acid
  MOD_RES (3069)..(3069): Any amino acid
  MOD_RES (3086)..(3100): Any amino acid
  MOD_RES (3136)..(3148): Any amino acid
  MOD_RES (3183)..(3183): Any amino acid
  MOD_RES (3197)..(3206): Any amino acid
  MOD_RES (3246)..(3253): Any amino acid
  MOD_RES (3270)..(3276): Any amino acid
  MOD_RES (3330)..(3331): Any amino acid
  MOD_RES (3350)..(3352): Any amino acid
  MOD_RES (3375)..(3382): Any amino acid
  MOD_RES (3401)..(3401): Any amino acid
XTKKPGGPGISRAINMLKRXXXXVFPLVGVKRVVISLLDGIGPVRFVLALVSFFKFTALSPTKALSGRWKALEKSVAMKHXTSFKGELGTLIDVVNKRGRKQNKRGGNGGXXXXXXXXXXXXXXAGALKLSNFQGKLLMAVNNTDIADXXXXXXXXXXXXXXVRAIDVGYLCEDTITYXXXXXXAGNDPEDVDCWCDNQEVYIQYGRCTRTRHSQRSRRSVSVQTNGESSLENKKEAWLNSTRATRYLTKTENWIIRNPGYAFLAGILGWMLGSTTGQRVGFTILLLLVXXXXXXXXXGMGNRDFIQRASGATWVDXXXXXXXCLTIMANDRPTLDRRMTNIEASQLAEVRSYCYRASVTDIXXXXXXPTTGEAHNEKQADSSYVCKXGFTDRGWRKGCGLSGKGSIDTCAKFSCTNKAIGRMIQSENSKYEVGIFVHGAXXXXXXGNYTAQVGTSQAARFTITPNAPSVTLKLGDFGEVTLDCEARSGLNTEAFYVMTVGSKSLLVHREWFHDLALPWTSSSNTAWRNRELLMEFEQAHATKQSVVALGSREGALHQALAGAIVVEYSNSVKLTSGHLKRRLKMDKLAXXGTTYGMCTKNSSFRKNPADTGHGTVVIELSYSGRDGPCKIPIVSVASLNDMTPAGRLVTXNPFVAASSANSKALVEMEPPFGDSYIVVGREXKQISHHWYKPGSTLGKAXXXXXXXXXXXXXXXXXXWDFGSIGGIFNSIGRAVHQVFGDXXXXXXXXXXXXXXXXXGVLLLWMGVNARDRSIAMAFLXXXXXXXXXXXXXXADTGCAIDTARNQMRCGSGIXXXXXXXXXXXXXKYLPETPKSLAKIVHKAHKEGVCGIRSVTRXXXXXXXAVRDELNVPXXXXXXXXXXXXXXXXXXYRSAPKRLSMTQEKVEMGWKAWGKSMLFAPELANSSFVVDXXETKECPVVRRAWNSTQIXXXXXXXXXXXVWLKIREESTDECDGTIIGTAIKGHVTLHSDLSYWIESRFNDTWKRERLVFEEVKSCTWPETHSLWGDGAEESDLVIPHTLAGPKSKHNQREGYMTQNQGPWDEKGIVLGFDYCPGTTVTITEDCSKRGPSLRTTTDSGKXXTDWCCRNCTLPPLRFRTDNGCWYGMEIRPAMHDETTLVRSQADAXKGGMVDPFQMGLLVMFLATQEVLGKRWTARLTVPAVLGALLVLMFGGITYTDLXRYVVLVAASFAEANSGGXXXXXXXXXXXKIQPAFLVANTLSARWTNQENVVLVLGAALFQLASMDLQIGVHGMLNAAAIAWMIIKAITFPTASSVTMPLLALLTPGMKAFDLDTYRIILLVIGVCSLLQERKRTMAKKKGAXXXXXXXXXXXXXXXTTIAAGLMACNPXXXXXXPATEVLSAVGLMFXXXXXXXXXXXXXXXXXXXXXXXXXXXXXXXXKATDMWLEQAADISWDMGAAITGSSRXXXXXLDDDGDFHFIDDPGVPWKIWVLRTSCIGLVALTPWAXXXXXXXXXXXXXXXXXXXXXXDTPSPKPCAKGDTTTGVYRIMACGIFGTHQAGVGVMYQNVFHTLWHTTRGAAVMSGGGKLTPYWGSVREDRIAYGGXXXXXXXXXXXXXXXVIVVEPGKGAANIQTKPGVFCTPFGKVGTVSLDYPXXTSGSPILDSNGDIIGLYGNGGELGDGSYVXXXXQGERQEEPVPEAYNPSMLRKKQMTVLDLHPGLGKTRKILPQIIKDAIQQRLKTAVLAPXXXXAAEMAEVLRGLPVRYXXXXVQREHQGNAIVDXXXXXXXXXXXXXXXXXXXXXXXXXXXXXXXXXXXXXXXXXXXXXXXXXXXXXXXXXXXXXXXXXXXXXXXXPIHDLQDETPDRAWSSGXXXXXXWSTEYSGKTVWFXXXVKMGNEIAVCLQRAGKRVIQLNRKSXXXXXXXXXXXXXXXXXXXXXXXXXXXXXXXXXXDCRKSVEPTILEKEEGRVILGNXXXXXXXXXXXXRGRVGRNPNQVGDEYEYGGATSEDDGNLAHWTXXXXXXXXXXXXXXXXXXXYGPEREKALTMDGEYRLXXXXXXXXXXXXXXXXXXVWLAYRVASNGIQYXXXXXXXXXXXTNAILEDSTEVEIVTRTXXXKVLKPRWLDAXXXXXXXXXXXXXXFAAGKRSAISFIEVPGRMPEHFMXXXXXXXXXXYLVATAEKGGKTHRMALXXXXDALETITLTVAIAVMTRGFFLLMMQRKGIEKMGLGALVXXXXXXXXXXXXXXXXXXXXXXXXXXXXXXXLIPEPEKQKLQTDNQLAVXXXCVLTVVGMVAANEYGMLEKTKADLKSMFAGKAPASGMTGLPSMTLDLRPATXXXXXXXXXXXXXXXXXXLITSEYVTPSLASISSQXXXXXXXXXXXXXXXXXXXXXXVLLGCWGQITLTTSLTAVVLAILHYGYMLPXXXXXXXXXXXXXXXXXXXXXXXXXXXXXXXXXXXXXXXXXXXXXXXXXXLIGGSVAAFLVNPNVTTVRKPGVLVTAATLSLWDNGXXXXXXXXXXXXXXXXXXXXXXXXXXXXWTLIKNADKPSLKRGRPGGRTLWEQWKEKLNAMGREEFFQYRREAIIEXXRTEACRARSENNKVGGHPVSRXXXXXXXXXXXXFVPPIGKVIDLGCGRGGWSYYAATLKKVQEFRGYTKGGAXXXXPMPMQSYGWNLVSMKSGVDVFYRPSEPXXXXXXXXXXXXXXXXXXXXXXXXXXXXXXXXXXXXXXXXXXXXXXXYMPKVIEKNEVLQRRFGXXXXXXXXXXXXXXXXXXXXXXXXXXXXXXXXXXXVLLGRMDRTVWRGPRYEEDVNLGXXXXXVGKGEVHSDQKKIRKRIQKQREEFATTWHKDPEHPYRNWTXHGSYEVRATGSASSLXXXXXELMSKPWDAISYVTTMPXXXXXXXXXXXVFKEKVGTKAPEPPVGVREVLNETTXWLWAHLSRKKRPRLCTKEEFIKKVNSNASLGTVFAEQXXWSTAREAVNDPXLWEMVDVERENHLRGECHTRVYHMMGKREXXXXXXXXXXXXXXXXXXXXXXXXXXFEALGSLNEDHWLSRENSGGGEEGLGVQKLGYISRDIASREGGKMYADDPXGWDTRITKTDLENEAKXXXXXXXXXXXXXXXIIELTYRHKVVKVMRPASDGKTGMAVISRENQRGSXXXXXXXXXXXXXIAVQFVRLVEAEGVIGPQHLEQLPRENKIAVRTWXFENGGERVTRMAIXXXXXXXXXXDDRFATALYFLNAMSKVRKDILEWKPSHGWHDWLHVPFCXXXXXXXXMKDGRSILVPCRGQDEXXXXXXXSPGAGWNVKDTACLPKAYAQMWVLLYFHRRDQRLMANAICSTVPVNWVPTGRTXXSIHSKGEWIPTEDMLQVWXXXWIEENEWMMDKTPIASWTDVPYXXXXXXXXCGSLIGTRSRATWAENVYXAINQVRAIIGKEDYVDYMDFLQRYEDVLTQEDRVI

SEQ ID NO: 265845 - protein, 3436 aa, Japanese encephalitis virus
  MOD_RES (1)..(2): Any amino acid
  MOD_RES (19)..(26): Any amino acid
  MOD_RES (38)..(41): Any amino acid
  MOD_RES (59)..(63): Any amino acid
  MOD_RES (79)..(85): Any amino acid
  MOD_RES (111)..(124): Any amino acid
  MOD_RES (137)..(184): Any amino acid
  MOD_RES (194)..(194): Any amino acid
  MOD_RES (207)..(209): Any amino acid
  MOD_RES (258)..(266): Any amino acid
  MOD_RES (287)..(299): Any amino acid
  MOD_RES (316)..(328): Any amino acid
  MOD_RES (346)..(370): Any amino acid
  MOD_RES (386)..(392): Any amino acid
  MOD_RES (406)..(411): Any amino acid
  MOD_RES (441)..(446): Any amino acid
  MOD_RES (480)..(496): Any amino acid
  MOD_RES (511)..(512): Any amino acid
  MOD_RES (529)..(546): Any amino acid
  MOD_RES (564)..(564): Any amino acid
  MOD_RES (578)..(591): Any amino acid
  MOD_RES (609)..(616): Any amino acid
  MOD_RES (630)..(633): Any amino acid
  MOD_RES (647)..(654): Any amino acid
  MOD_RES (672)..(673): Any amino acid
  MOD_RES (683)..(683): Any amino acid
  MOD_RES (700)..(718): Any amino acid
  MOD_RES (736)..(793): Any amino acid
  MOD_RES (812)..(836): Any amino acid
  MOD_RES (854)..(893): Any amino acid
  MOD_RES (903)..(913): Any amino acid
  MOD_RES (925)..(932): Any amino acid
  MOD_RES (950)..(967): Any amino acid
  MOD_RES (978)..(978): Any amino acid
  MOD_RES (1018)..(1021): Any amino acid
  MOD_RES (1074)..(1083): Any amino acid
  MOD_RES (1101)..(1107): Any amino acid
  MOD_RES (1147)..(1147): Any amino acid
  MOD_RES (1159)..(1207): Any amino acid
  MOD_RES (1219)..(1230): Any amino acid
  MOD_RES (1268)..(1287): Any amino acid
  MOD_RES (1318)..(1320): Any amino acid
  MOD_RES (1342)..(1424): Any amino acid
  MOD_RES (1445)..(1466): Any amino acid
  MOD_RES (1487)..(1539): Any amino acid
  MOD_RES (1572)..(1600): Any amino acid
  MOD_RES (1635)..(1672): Any amino acid
  MOD_RES (1723)..(1838): Any amino acid
  MOD_RES (1853)..(1858): Any amino acid
  MOD_RES (1869)..(1936): Any amino acid
  MOD_RES (1948)..(1981): Any amino acid
  MOD_RES (1995)..(2021): Any amino acid
  MOD_RES (2035)..(2121): Any amino acid
  MOD_RES (2145)..(2157): Any amino acid
  MOD_RES (2171)..(2176): Any amino acid
  MOD_RES (2197)..(2197): Any amino acid
  MOD_RES (2208)..(2245): Any amino acid
  MOD_RES (2262)..(2285): Any amino acid
  MOD_RES (2316)..(2378): Any amino acid
  MOD_RES (2403)..(2460): Any amino acid
  MOD_RES (2482)..(2520): Any amino acid
  MOD_RES (2560)..(2571): Any amino acid
  MOD_RES (2585)..(2608): Any amino acid
  MOD_RES (2636)..(2775): Any amino acid
  MOD_RES (2787)..(2797): Any amino acid
  MOD_RES (2836)..(2893): Any amino acid
  MOD_RES (2903)..(2930): Any amino acid
  MOD_RES (2948)..(2951): Any amino acid
  MOD_RES (2963)..(2963): Any amino acid
  MOD_RES (2976)..(2977): Any amino acid
  MOD_RES (2992)..(3019): Any amino acid
  MOD_RES (3066)..(3109): Any amino acid
  MOD_RES (3128)..(3164): Any amino acid
  MOD_RES (3182)..(3219): Any amino acid
  MOD_RES (3234)..(3276): Any amino acid
  MOD_RES (3294)..(3300): Any amino acid
  MOD_RES (3327)..(3352): Any amino acid
  MOD_RES (3372)..(3382): Any amino acid
  MOD_RES (3400)..(3405): Any amino acid
XXKKPRGPGKSRAINMLKXXXXXXXXLVRVKRVVMSLXXXXGPLRFVLAFITFFKFTAXXXXXALLGRWRALEKSVAMXXXXXXXRELGILIDTVNKRGRKQNKRGGNERXXXXXXXXXXXXXXVGAIKLSNFQGKXXXXXXXXXXXXXXXXXXXXXXXXXXXXXXXXXXXXXXXXXXXXXXXXTGNDPEDVDXWCDHQEVYVQYGXXXRTSHSKTSKRSVSVQTHGESSLVNKKEAWLDSTKATRYLVKTENWIVRXXXXXXXXXVLGWMLGSTNGQRLGFTILLXXXXXXXXXXXXXMGNRDFIERASGATWVXXXXXXXXXXXXXANDKPTLDVRMTNIEASXXXXXXXXXXXXXXXXXXXXXXXXXTGEAHNEKQADSSYVXXXXXXXRGWGNGCGLSGKGXXXXXXKFSCTSKATGKTIQPENSKYKVGIFVHGAXXXXXXGNYSAQIGVSQAAKFTVTPNAPSVTLKLGDFGEXXXXXXXXXXXXXXXXXVMTVGPKSFLVHREXXHDLALPWSSPSSTAWRXXXXXXXXXXXXXXXXXXVALGSQERSLHQALAGAXVVEYPSSVKLTSGXXXXXXXXXXXXXXGTTYGMCTENSSFRKNPXXXXXXXXVIELSYSGRDGPCXXXXVSVANLNDMTPVGXXXXXXXXVATSSSNSKALVEMEPPXXDSYIVVGMGXKQINHHWHKPGSTLGKXXXXXXXXXXXXXXXXXXXWDFGSIGGAFNSIGKAVXXXXXXXXXXXXXXXXXXXXXXXXXXXXXXXXXXXXXXXXXXXXXXXXXXXXXXXXXXADTGCAIDVTRNQMRCGSXXXXXXXXXXXXXXXXXXXXXXXXXAKIVHKAYMEGICGVRSXXXXXXXXXXXXXXXXXXXXXXXXXXXXXXXXXXXXXXXXTPKRLSMTQXXXXXXXXXXXKSLLFAPELANXXXXXXXXETKECPDEQRAWNSMQIXXXXXXXXXXXXXXXXXXENTDECDGTIXGTAVKGHVALHSDVSYWIESHLNDSWKLERAVFEEVKSCXXXXTHTLWGDDAEESELIIPDTIAGPKSKHNRREGYMTQNQGPWDESGIVLDFDYXXXXXXXXXXDCGKRAPWVRTTTDIGKXXXXXXXRSCTLPPLRFRTGSGCWYGMEVRPVKHDETTLVRSRVDAXSGEMVDPFQMGXXXXXXXXXXXXXXXXXXXXXXXXXXXXXXXXXXXXXXXXXXXXXXXXXAAVFAEANSGGXXXXXXXXXXXXIQPAFLAMKMLSAKWTNQENVILVLGAAFFQLASMDLXXXXXXXXXXXXXXXXXXXXITFPTTSTITMPVLTLLAPGMRALCLDTYRXXXLIIGICSLQQEREKTMAKKKGXXXXXXXXXXXXXXXXXXXXXXXXXXXXXXXXXXXXXXXXXXXXXXXXXXXXXXXXXXXXXXXXXXXXXXXXXXXXXXXXXXXMWLERAADVSWEMGAAITGSXXXXXXXXXXXXXXXXXXXXXXPWKVWVLRMSCSGLAALTPWXXXXXXXXXXXXXXXXXXXXXXXXXXXXXXXXXXXXXXXXXXXXXXXXXXXXXAGVGVMYESVFHTLWHPTRGAAIMSGKGKLTPXXXXXXXXXXXXXXXXXXXXXXXXXXXXXVIVVEPGKVAVSFQTKPGIFPTPLGKVGTVSLDYXXXXXXXXXXXXXXXXXXXXXXXXXXXXXXXXXXXXXXDRQEEPVPEAYTPTMLKKKQMTVLDLPPGSGKTRKILPQTIRDAIQQRLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDLQDEIPDWAWSSGXXXXXXWITEYSGKTVXXXXXXXXXXXXXXXXXXXXXXXXXXXXXXXXXXXXXXXXXXXXXXXXXXXXXXXXXXXXXXXXXXXXSVKPIILEEGEXXXXXXXXXXXXXXXXXXXXXXXXXXXXXXXXXXHYGGPTSEDDSNLXXXXXXXXXXXXXXXXXXXXXXXXXXXREKAFTMDVEYRLXXXXXXXXXXXXXXXXXXXXXXXXXXXXXXXXXXXXXXXXXXXXXXXXXXXXXXXXXXXXXXXXXXXXXXXXXXXXXXXXXXXXXXXFASGKRSAVSFIEELGRMPEHFAXXXXXXXXXXXXXATAEKGGKTHRMAXXXXXXALETVTLIVAITAMTGGFFLXMKQRKGIGKMXXXXXXXXXXXXXXXXXXXXXXXXXXXXXXXXXXXXXXIPEPEKQRSQTGNQLAXXXXXXXXXXXXXXXXXXXXXXXXKADLKSMFVGKTQVSGLTGLPGMALDLRPAXXXXXXXXXXXXXXXXXXXXXXXXXXXXXXXXXXXXXXXXXXXXXXXXXXXXXXXXXXXXXXXWGQITLTTVLTAVVLATLHYGFMLXXXXXXXXXXXXXXXXXXXXXXXXXXXXXXXXXXXXXXXXXXXXXXXXXXXXXXXXXXAFLVNPKVTTVKKPGVLVTAAXXXXXXXXXXXXXXXXXXXXXXXXXXXXXXXXXXXXXXXIKNANNPSFKRGGPGGRTLGDQWKRKLNALSREEFFQYRXXXXXXXXXXXXRRARRENNKVGGHXXXXXXXXXXXXXXXXXXXXXXXXVDLGCGCGGWSYCAATLKRVQEVRGYTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNRAVWRGPKYEXXXXXXXXXXXVGKGEVHSTQDKIKKRIQKLREEFATTWHRDPEHPYRTXXXXXXXXXXXXXXXXXXXXXXXXXXXXXXXXXXXXXXXXXXXXXXXXXXXXXXXXXXTKAPEPPPGXXXXXXXXXXXXXXXXXXXXXXXXXXXXEFIKKVNSDAALGAVFAXXXXWSTAREAVSDPXFWEIVDEERENHXXGECHTCVYHMMGKRXXXXXXXXXXXXXXXXXXXXXXXXXXXXEALGFLNLDHWLSRRNSRGGVEGLGVQKLGYIIGDIARKEGGKMYAXXXXXXXXXXXXXXXXXXXXXXXXXXXXXXXXXXXXXXXXXXXXVVKVMRPSTKGKTGMAVIXXXXXXXXXXXXXXXXXXXXXXXXXXXXXXXXXXXXXPQHLEHLPKKNKIAVRTXXXXXXXXXXXXXXXXXXXXXXXXXXXXXXXXXXXXXXMSKVRKDILEWKPSXXXXXXXXXXXXXXXXXXXXXXXXXXXXXXXXXXXXXXXXXXXSPGAGWNVRDTACLAKAXXXXXXXLYFHRRDQRLMANAICSAVPLDWVPTXXXXXXXXXXXXXXXXXXXXXXXXXXWIEENEWMTDMTPITSWTDXXXXXXXXXXXCGNLIGTRSRATWAENVXXXXXXVRAILGKETYVDYMTSLRRYEDVSIQEDRVI

SEQ ID NO: 265846 - protein, 3435 aa, Japanese encephalitis virus
  MOD_RES (1)..(42): Any amino acid
  MOD_RES (53)..(65): Any amino acid
  MOD_RES (75)..(85): Any amino acid
  MOD_RES (111)..(124): Any amino acid
  MOD_RES (134)..(184): Any amino acid
  MOD_RES (194)..(216): Any amino acid
  MOD_RES (226)..(266): Any amino acid
  MOD_RES (276)..(277): Any amino acid
  MOD_RES (287)..(300): Any amino acid
  MOD_RES (315)..(393): Any amino acid
  MOD_RES (405)..(412): Any amino acid
  MOD_RES (432)..(451): Any amino acid
  MOD_RES (477)..(513): Any amino acid
  MOD_RES (525)..(549): Any amino acid
  MOD_RES (561)..(592): Any amino acid
  MOD_RES (606)..(619): Any amino acid
  MOD_RES (630)..(636): Any amino acid
  MOD_RES (646)..(655): Any amino acid
  MOD_RES (669)..(673): Any amino acid
  MOD_RES (683)..(683): Any amino acid
  MOD_RES (699)..(724): Any amino acid
  MOD_RES (735)..(794): Any amino acid
  MOD_RES (805)..(839): Any amino acid
  MOD_RES (854)..(938): Any amino acid
  MOD_RES (949)..(967): Any amino acid
  MOD_RES (978)..(979): Any amino acid
  MOD_RES (991)..(992): Any amino acid
  MOD_RES (1012)..(1058): Any amino acid
  MOD_RES (1074)..(1083): Any amino acid
  MOD_RES (1095)..(1132): Any amino acid
  MOD_RES (1147)..(1147): Any amino acid
  MOD_RES (1157)..(1234): Any amino acid
  MOD_RES (1248)..(1250): Any amino acid
  MOD_RES (1260)..(1288): Any amino acid
  MOD_RES (1300)..(1303): Any amino acid
  MOD_RES (1314)..(1321): Any amino acid
  MOD_RES (1342)..(1428): Any amino acid
  MOD_RES (1445)..(1469): Any amino acid
  MOD_RES (1484)..(1541): Any amino acid
  MOD_RES (1554)..(1557): Any amino acid
  MOD_RES (1571)..(1600): Any amino acid
  MOD_RES (1633)..(1677): Any amino acid
  MOD_RES (1691)..(2127): Any amino acid
  MOD_RES (2139)..(2176): Any amino acid
  MOD_RES (2188)..(2248): Any amino acid
  MOD_RES (2259)..(2287): Any amino acid
  MOD_RES (2309)..(2387): Any amino acid
  MOD_RES (2403)..(2522): Any amino acid
  MOD_RES (2559)..(2571): Any amino acid
  MOD_RES (2581)..(2806): Any amino acid
  MOD_RES (2826)..(2893): Any amino acid
  MOD_RES (2903)..(2930): Any amino acid
  MOD_RES (2948)..(2953): Any amino acid
  MOD_RES (2963)..(2963): Any amino acid
  MOD_RES (2973)..(3035): Any amino acid
  MOD_RES (3053)..(3111): Any amino acid
  MOD_RES (3128)..(3165): Any amino acid
  MOD_RES (3179)..(3354): Any amino acid
  MOD_RES (3366)..(3383): Any amino acid
  MOD_RES (3400)..(3405): Any amino acid
  MOD_RES (3434)..(3435): Any amino acid
XXXXXXXXXXXXXXXXXXXXXXXXXXXXXXXXXXXXXXXXXXPVRFVLAFITXXXXXXXXXXXXXSGRWKAVERXXXXXXXXXXXRELGTLIDGVNKRGRKRNKRGGNEGXXXXXXXXXXXXXXAGAIKLSNFXXXXXXXXXXXXXXXXXXXXXXXXXXXXXXXXXXXXXXXXXXXXXXXXXXXPGNDPQDVDXXXXXXXXXXXXXXXXXXXXXXXSKRSVSVQTXXXXXXXXXXXXXXXXXXXXXXXXXXXXXXXXXXXXXXXXXTLGWMLGSNXXPRVVFTILLXXXXXXXXXXXXXXGNRDFIEGVSGATWXXXXXXXXXXXXXXXXXXXXXXXXXXXXXXXXXXXXXXXXXXXXXXXXXXXXXXXXXXXXXXXXXXXXXXXXXXXXXXXGWGKGCGLFGKXXXXXXXXFSCTSKAIERAIQPENIKYXXXXXXXXXXXXXXXXXXXXQVGASQAARFTVTPNAPSVTLKLGDXXXXXXXXXXXXXXXXXXXXXXXXXXXXXXXXXXXXXDLALPWTSSSNXXXXXXXXXXXXXXXXXXXXXXXXXGSQEGSLHQALXXXXXXXXXXXXXXXXXXXXXXXXXXXXXXXXTTYGVCTEKFSFAXXXXXXXXXXXXXXLLYSGSDGPCXXXXXXXVSLNDMTPVXXXXXXXXXXATSSSNSQVLVEMXXXXXDSYIVIGRGXKQINHHRHKAGSTLGXXXXXXXXXXXXXXXXXXXXXXXXXXGRVFNSIGKAXXXXXXXXXXXXXXXXXXXXXXXXXXXXXXXXXXXXXXXXXXXXXXXXXXXXXXXXXXXXDTGSAIDITRXXXXXXXXXXXXXXXXXXXXXXXXXXXXXXXXXXXVHKAHMEGVCGVRSXXXXXXXXXXXXXXXXXXXXXXXXXXXXXXXXXXXXXXXXXXXXXXXXXXXXXXXXXXXXXXXXXXXXXXXXXXXXXXXXXXXXXDEQRAWNSMQXXXXXXXXXXXXXXXXXXXETTDECDGAIXXTAVKGHVTVHSXXSYWIGSRYNDTWKLERLVFXXXXXXXXXXXXXXXXXXXXXXXXXXXXXXXXXXXXXXXXXXXXXXXQGPWDEDGIVLDFDYXXXXXXXXXXDCGKRAPWVRTXXXXXXXXXXXXXXXXXXXXXXXXXXXXXXXXXXXXXXGHDEATLVRWQVDAXNGGMVDPFQXXXXXXXXXXXXXXXXXXXXXXXXXXXXXXXXXXXXXXXXXXXXXXXXXXXXXXXXXXXXXXXXXXXXXXXXXXXXXXFLAMNTLSTRWTNXXXMVLVLGAAFXXXXXXXXXXXXXXXXXXXXXXXXXXXXXTFPTTSTVTMPXXXXLTPGMRAFDLXXXXXXXXVIGICSLQQERRRTMAKKKGXXXXXXXXXXXXXXXXXXXXXXXXXXXXXXXXXXXXXXXXXXXXXXXXXXXXXXXXXXXXXXXXXXXXXXXXXXXXXXXXXXXXXXXRAADISWGMDAAITGSXXXXXXXXXXXXXXXXXXXXXXXXXVWVLRMSCIGLVALXXXXXXXXXXXXXXXXXXXXXXXXXXXXXXXXXXXXXXXXXXXXXXXXXXXXXXXXXXVGVIYENVFHTLXXXXRGAAIMSGGGKLTXXXXXXXXXXXXXXXXXXXXXXXXXXXXXXVIVVEQGKPATNIQTKPGIFPPPFGKVGTVSLXXXXXXXXXXXXXXXXXXXXXXXXXXXXXXXXXXXXXXXXXXXXXPIPEAYTPNMLKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSATSFIEVLGRXXXXXXXXXXXXXXXXXXXXXXXXXXXXXXXXXXXXXXALETITLIIAIXXXXXXXXXXXXXXXXXXXXXXXXXXXXXXXXXXXXXXXXXXXXXXXXXXXXXXXXXXXXXPEKQRLQTDNXXXXXXXXXXXXXXXXXXXXXXXXXXXXXDIKSMFGGKAPVLGLTGLPSMXXXXXXXXXXXXXXXXXXXXXXXXXXXXXXXXXXXXXXXXXXXXXXXXXXXXXXXXXXXXXXXXXXXXXXXXXXXXXXXLTAMVLTTLHYGYMLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNADKPSLKRGGPGGRTLGEQWKERLNAMSREEFFQYXXXXXXXXXXXXXRRARSENNIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQGKIRRRIQKLREEFGTTWXXXXXXXXXXXXXXXXXXXXXXXXXXXXXXXXXXXXXXXXXXXXXXXXXXXXXXXXXXXXXXXXXXXXTMAPEPPAGXXXXXXXXXXXXXXXXXXXXXXXXXXXXEFINKVNSSAALGAVFAXXXXXXTAREAVGDSXFWEMVDVERXXXXXXXXXXXXXXXXXXXXXXXXXXXXXXXXXXXXXXXXXXXXXXXXXXXXXXXXXXXXXXXSGGGVEGLGVQKLGYISXXXXXXXXXXXXXXXXXXXXXXXXXXXXXXXXXXXXXXXXXXXXXXXXXXXXXXXXXXXKVMRPAAEGKTVMVVYXXXXXXXXXXXXXXXXXXXXXXXXXXXXXXXXXXXXXXQHVEQLPRENKIAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEENEWMEDKTPXXXXXXXXXXXXXXXXXXGSLIGTRARATWAENIXXXXXXVRAIIGKENYVDYMDFPRRIEDVLIQEDXX

SEQ ID NO: 265847 - protein, 3436 aa, Japanese encephalitis virus
  MOD_RES (111)..(124): Any amino acid
  MOD_RES (267)..(267): Any amino acid
  MOD_RES (423)..(423): Any amino acid
  MOD_RES (683)..(687): Any amino acid
  MOD_RES (1133)..(1133): Any amino acid
  MOD_RES (1145)..(1148): Any amino acid
  MOD_RES (1611)..(1611): Any amino acid
  MOD_RES (1853)..(1858): Any amino acid
  MOD_RES (2901)..(2901): Any amino acid
  MOD_RES (2963)..(2963): Any amino acid
MTKKPGGPGKNRAINMLKRGLPRVFPLVGVKRVVMSLLDGRGPVRFVLALITFFKFTALAPTKALLGRWKAVEKSVAMKHLTSFKRELGTLIDAVNKRGRKQNKRGGNEGXXXXXXXXXXXXXXAGAMKLSNFQGKLLMTINNTDIADVIVIPTSKGENRCWVRAIDVGYMCEDTITYECPKLTMGNDPEDVDCWCDNQEVYVQYGRCTRTRHSKRSRRSVSVQTHGESSLVNKKEAWLDSTKATRYLMKTENWIIRNPGYAFLAAXLGWMLGSNNGQRVVFTILLLLVAPAYSFNCLGMGNRDFIEGASGATWVDLVLEGDSCLTIMANDKPTLDVRMINIEASQLAEVRSYCYHASVTDISTVARCPTTGEAHNEKRADSSYVCKQGFTDRGWGNGCGLFGKGSIDTCAKFSCTSKAIGRXIQPENIKYEVGIFVHGTTTSENHGNYSAQVGASQAAKFTVTPNAPSITLKLGDYGEVTLDCEPRSGLNTEAFYVMTVGSKSFLVHREWFHDLALPWTSPSSTAWRNRELLMEFEEAHATKQSVVALGSQEGGLHQALAGAIVVEYSSSVKLTSGHLKCRLKMDKLALKGTTYGMCTEKFSFAKNPADTGHGTVVIELSYSGSDGPCKIPIVSVASLNDMTPVGRLVTVNPFVATSSANSKVLVEMEPPFGDSYIVVGRGXXXXXHHWHKAGSTLGKAFSTTLKGAQRLAALGDTAWDFGSIGGVFNSIGKAVHQVFGGAFRTLFGGMSWITQGLMGALLLWMGVNARDRSIALAFLATGGVLVFLATNVHADTGCAIDITRKEMRCGSGIFVHNDVEAWVDRYKYLPETPRSLAKIVHKAHKEGVCGVRSVTRLEHQMWEAVRDELNVLLKENAVDLSVVVNKPVGRYRSAPKRLSMTQEKFEMGWKAWGKSILFAPELANSTFVVDGPETKECPDEHRAWNSMQIEDFGFGITSTRVWLKIREESTDECDGAIIGTAVKGHVAVHSDLSYWIESRYNDTWKLERAVFGEVKSCTWPETHTLWGDGVEESELIIPHTIAGPKSKHNRREGYKTQNQGPWDENGIVLDFDYCPGTKVTITEDCGKRGPSVRTTTDSGKLITDWCCRSCSLPPLRFRTENGCWYGMEIRPVXHDETTLVRSQVXXXXGEMVDPFQLGLLVMFLATQEVLRKRWTARLTIPAVLGALLVLMLGGITYTDLARYVVLVAAAFAEANSGGDVLHLALIAVFKIQPAFLVMNMLSTRWTNQENVVLVLGAAFFQLASVDLQIGVHGILNAAAIAWMIVRAITFPTTSSVTMPVLALLTPGMRALYLDTYRIILLVIGICSLLQERKKTMAKKKGAVLLGLALTSTGWFSPTTIAAGLMVCNPNKKRGWPATEFLSAVGLMFAIVGGLAELDIESMSIPFMLAGLMAVSYVVSGKATDMWLERAADISWEMDAAITGSSRRLDVKLDDDGDFHLIDDPGVPWKVWVLRMSCIGLAALTPWAIVPAAFGYWLTLKTTKRGGVFWDTPSPKPCSKGDTTTGVYRIMARGILGTYQAGVGVMYENVFHTLWHTTRGAAIMSGEGKLTPYWGSVKEDRIAYGGPWRFDRKWNGTDDVQVIVVEPGKAAXNIQTKPGVFRTPFGEVGAVSLDYPRGTSGSPILDSNGDIIGLYGNGVELGDGSYVSAIVQGDRQEEPVPEAYTPNMLRKRQMTVLDLHPGSGKTRKILPQIIKDAIQQRLRTAVLAPTRVVAAEMAEALRGLPVRYQTSAVQREHQGNEIVDVMCHATLTHRLMSPNRVPNYNLFVMDEAHFTDPASIAARGYIATKVELGEAAAIFMTATPPGTTDPFPDSNAPIHDLQDEIPDRAWSSGXXXXXXWITEYAGKTVWFVASVKMGNEIAMCLQRAGKKVIQLNRKSYDTEYPKCKNGDWDFVITTDISEMGANFGASRVIDCRKSVKPTILEEGEGRVILGNPSPITSASAAQRRGRVGRNPNQVGDEYHYGGATSEDDSNLAHWTEAKIMLDNIHMPNGLVAQLYGPEREKAFTMDGEYRLRGEEKKNFLELLRTADLPVWLAYKVASNGIQYTDRKWCFDGPRTNAILEDNTEVEIVTRMGERKILKPRWLDARVYADHQALKWFKDFAAGKRSAVSFIEVLGRMPEHFMGKTREALDTMYLVATAEKGGKAHRMALEELPDALETITLIVAITVMTGGFFLLMMQRKGIGKMGLGALVLTLATFFLWAAEVPGTKIAGTLLIALLLMVVLIPEPEKQRSQTDNQLAVFLICVLTVVGVVAANEYGMLEKTKADLKSMFGGKTQASGLTGLPSMALDLRPATAWALYGGSTVVLTPLLKHLITSEYVTTSLASINSQAGSLFVLPRGVPFTDLDLTVGLVFLGCWGQITLTTFLTAMVLATLHYGYMLPGWQAEALRAAQRRTAAGIMKNAVVDGMVATDVPELERTTPLMQKKVGQVLLIGVSVAAFLVNPNVTTVREAGVLVTAATLTLWDNGASAVWNSTTATGLCHVMRGSYLAGGSIAWTLIKNADKPSLKRGRPGGRTLGEQWKEKLNAMSREEFFKYRREAIIEVDRTEARRARRENNIVGGHPVSRGSAKLRWLVEKGFVSPIGKVIDLGCGRGGWSYYAATLKKVQEVRGYTKGGAGHEEPMLMQSYGWNLVSLKSGVDVFYKPSEPSDTLFCDIGESSPSPEVEEQRTLRVLEMTSDWLHRGPREFCIKVLCPYMPKVIEKMEVLQRRFGGGLVRLPLSRNSNHEMYWVSGAAGNVVHAVNMTSQVLLGRMDRTVWRGPKYEEDVNLGSGTRAVGKGEVHSNQEKIKKRIQKLKEEFATTWHKDPEHPYRTWTYHGSYEVKATGSASSLVNGVVKLMSKPWDAIANVTTMAMTDTTPFGQQRVFKEKVDTKAPEPPXGAKEVLNETTNWLWAHLSREKRPRLCTKEEFIKKVNSNAALGAVFAEQNQWSTAREAVDDPXFWEMVDEERENHLRGECHTCIYNMMGKREKKPGEFGKAKGSRAIWFMWLGARYLEFEALGFLNEDHWLSRENSGGGVEGSGVQKLGYILRDIAGKQGGKMYADDTAGWDTRITRTDLENEAKVLELLDGEHRMLARAIIELTYRHKVVKVMRPAAEGKTVMDVISREDQRGSGQVVTYALNTFTNIAVQLVRLMEAEGVIGPQHLEQLPRKNKIAVRTWLFENGEERVTRMAISGDDCVVKPLDDRFATALHFLNAMSKVRKDIQEWKPSHGWHDWQQVPFCSNHFQEIVMKDGRSIVVPCRGQDELIGRARISPGAGWNVKDTACLAKAYAQMWLLLYFHRRDLRLMANAICSAVPVDWVPTGRTSWSIHSKGEWMTTEDMLQVWNRVWIEENEWMMDKTPITSWTDVPYVGKREDIWCGSLIGTRSRATWAENIYAAINQVRAVIGKENYVDYMTSLRRYEDVLIQEDRVI

SEQ ID NO: 265848 - protein, 3436 aa, Japanese encephalitis virus
  MOD_RES (111)..(124): Any amino acid
  MOD_RES (151)..(160): Any amino acid
  MOD_RES (267)..(267): Any amino acid
  MOD_RES (319)..(320): Any amino acid
  MOD_RES (423)..(423): Any amino acid
  MOD_RES (683)..(687): Any amino acid
  MOD_RES (816)..(824): Any amino acid
  MOD_RES (882)..(884): Any amino acid
  MOD_RES (957)..(959): Any amino acid
  MOD_RES (1133)..(1133): Any amino acid
  MOD_RES (1145)..(1148): Any amino acid
  MOD_RES (1226)..(1227): Any amino acid
  MOD_RES (1491)..(1508): Any amino acid
  MOD_RES (1611)..(1611): Any amino acid
  MOD_RES (1785)..(1788): Any amino acid
  MOD_RES (1808)..(1813): Any amino acid
  MOD_RES (1853)..(1858): Any amino acid
  MOD_RES (1905)..(1912): Any amino acid
  MOD_RES (2040)..(2048): Any amino acid
  MOD_RES (2418)..(2430): Any amino acid
  MOD_RES (2590)..(2593): Any amino acid
  MOD_RES (2696)..(2698): Any amino acid
  MOD_RES (2766)..(2766): Any amino acid
  MOD_RES (2901)..(2901): Any amino acid
  MOD_RES (2963)..(2963): Any amino acid
  MOD_RES (2996)..(3014): Any amino acid
  MOD_RES (3141)..(3143): Any amino acid
MTKKPGGPGRNRAIYMLKRGLPRVFPLVGVKRVVMSLLDGRGPVRFVLALTSFFKFTALAPTKALLGRWRALERSVAMKHLTSFKRELGTLIDAVNKRGKKQNKRGGNESXXXXXXXXXXXXXXVGAMRLSNFQGKLLMTVNNTDIADVIXXXXXXXXXXCWVRAIDVGYLCEDTITYECPKLAVGNDPQDVDCWCDNQQVYVQYGPCTRTRHSKRTRRSVSVHTNGESSLENKKKAWLDSTKATRYLTKTENWIVRNPGYAFLAGXLGWMLGSNSGQRVVFTILPLLVAPAYSFTCLGMGNRDFIERVSGATWVDLVXXGDSCLTIMASDRPTLDVRMINIEAVQLAEVRSYYYRASVTDISTVARCPMTGEAHNEKQADSSYVCKQGFTDRGWGNGCGFSGKGSIDTCAKFSCTRKAIGRXIQPENIKYKVGIFVHGATTSENHGNYSAQVGASQAAKFTVTPNAPSTALELGDYGEVTLDCEPKSGLNTEAFYVMTVGSRSLLVHREWFHDLSLPWTPSSNTAWRNRELLMEFEGAHATKQSVVALGSQEGGLHHALAGAIVVEYSSSVMLTSGHLKCRLRMDKLALKGTTYGMCTGKFSFAKNPVDTGHGTVVIELTYSGRDGSCKIPIVSVASLNDLTPAGRLVTVNPFVATSSSNSQVLLEIEPPFGDSYIVIGRGXXXXXHHWHRAGSTLGKAFLTTLKGAQRLVALGDTAWDFGSIGGVFNSIGRAVHQVFGDAFRTLFGGMSWITQGLMGALLLWMGINARDRSIAMAFLVTGGTLLFLATNVHADTGCAIDITRRQMRCGSGIFVXXXXXXXXXRYKYLPETPRSLAKIVHKAHQEGVCGIRSVTRLEHQMWESVRDELNVPLKENAVDLSXXXNKPVGRYRSAPKRLFMTQEKVEMGWKAWGKSMLFAPELANSSFVVDGPETKECPDERRAWNSTQIEDFGFGIXXXRVWLKIREENTDECDGPIIGTAVKGNVAVHSDLSYWIESRLNDSWKLERAVFGEIKSCTWPETHTLWGDDAEESELIIPHTIAGPRSKHNRREGYRTQNQGPWDEKGLVLGFDYCPGTKVTITEDCGKRGPSIRTTTDIGKLITDWCCRSCSLPPLGFRTDSGCWYGMEIRPLXHDEATLVRSQVXXXXGEMIDPFQLGLLVVFLATQEVLRKRWTARLTIPAVLGVLLVLMLGGITYIDLARYVVLVAAAFAEANNGGDVLHLALXXVFKIQPAFLVMNMLSARWTNQENVALVLGAAFFQLASADLQIGVHGMLNAAAMAWMIVRAITFPTTSTVAMPILALLTPGMKAFDLDTYRIILLVIGICSLLHERRKAMAKKKGAVLMGLALTSTGWFSPTTITAGLMACNPNKKRGWPATEFLSAIGLMFAIVGGLAEMDIESMSIPFMLAVLMAVSYVVSGKATDMWLDRAADISWEMEAAITGSSRRLDVKLDEDGDFHLIDDPGVPWKVWLLRMSCSCLVALTPWAIVPXXXXXXXXXXXXXXXXXXWDTPSPKPCLKGDTTTGVYRIMARGIFGTHQSGVGVMYQNVFHTLWHTTRGAAIVSGKGKLTPYWGSVKEDRISYGGPWRFDRKWNGTDDVQVIVVEPGKPAXNFQTKPGVFRTPFGEIGTVSLDYPRGTSGSPILNSNGDIIGCLGNGGELGDRSYVSAIVQGDRQEEPVPDAYTPSMLKKRQLTVLDLHPGSGKTKKILPQIIKDAIQQRLKTAVLAPTRVVAAEMAEALKGLPVRYQTSAVQREHQGNAIVDVMCHATLTHRLTSPNRVPNYNXXXXDEAHFTDPAGIAARGYIATXXXXXXAAAIFMTATSPGTTDPFPDSNAPIHDLQDEVPDRAWSSGXXXXXXWITDYSGKTVWFVASVRMGNEIAVCLQRAGKKVIQLSRKSYDTEYPXXXXXXXXFVITTDISEVGANFGASRVIDCRKSVEPIILEKGEGRVFLGNPSPITNASAAQRRGRVGRNPNQVGDEYHYGGPTSEGDGNLAHWTEAKILLDNIHMPNGLVVQLYGPEREKASTMDVEYRLRGEEKXXXXXXXXXADLPVWLAYRVASNGIQYTDRRWCFDGPRTNAILEDNIEVEIVTRTGERKILKPRWLYARVYADHQALKWFKDFAAGKRSAISFIEVRGRMPEHFAGKTREALDTMYLVATAERSGKTHRMALEELPDALETITLIAAITVMTGGFFLLMMQRKGIGRMGLGALVLVLATFFLWAAEVSGTKIAGTLLVALLLMVVLIPEPGKQRSQTGNQLAVFLICVLTVVGMAAANEYGMLEKTKADLKSMFGGRTQAPGMTGLPGMTLDLRPATAWAWYGGSTVVLTPLLKHIITSEYVTTSLASISSQAGSLFVLPRGVPSTDLDLTVGLVFLGCWGQITLTTFLTAMVLVTLHYGFMLPGWQAQALRAAQRRTXXXXXXXXXXXXXVATDVPELEKTTPLMQKKIGQVLLIGVSVAALLVNPKVSTVREAGVLVTARTLTLWDNGASAAWNSTTATGLCHVMRGSYLRGGSIAWTLIKNADKPSLKKGRSGGRTLGEQWKEKLNAMSRDEFFQYRREGIIEVDRTEARRARRENNVVGGHPVSRGXXXXRWLVEKGFVPPIGKVIDLGCGRGSWNYYAATLKKVQEVKGYTKGGAGHEEPMLMQSYGRNLVSLKSGVDVFYRPSEPSDTLLCDIGESSPSPDVEEQRTLRVXXXTSDWLHRGPIEFCIKVLCPYMPKVIEKIEVLQRRFGGGVVRLPLSRNSNHEMYWVSGPAGNVVHAVNXTSQVLLGRMDRTVWRGPKYKEDVNLGSGTRAVGKGEIHSNQEKIRKRIQKLREGFATTWHRDHEHPYRNWTYHGSYEVKANGSASSLVNGVVELMSKPWDAISYVTTMPMTDTTPFGQQRVFKEKVGTMAPEPPXGVREVLNETTNWLWAYLSRKKRPRLCTKEEFIRKVNSDASLGTVFAEQNQWSTAREAVGDPXFWEMVNVERENHLRGECHTCVYHMMGKREKKPXXXXXXXXXXXXXXXXXXXRYLEFEALGFLNENHWLSRRNSGGGVEGSSVQKLGYIFRDIARREIGKMYADDTAGWDTRITRADLENEAKVLELLDGEHRKLARAIIELTYKHKVVKVMRPAAGGKTGMVVISRENQRGSGQVVTXXXNTFTNIAVQFVRLMKAEGVIGPQHLEQLPRKTKIAVRTWLFENGEERVSRMAISGDDCAVKPLDDRFATALYFLNAMSKVTKDIQEWKPSHGWHDWLHVPFCSNHFHEIVMKDGRSILDPCRGQDELIDRARISPGAGCNVRDTACLAKAYAQMRLLLYFHRRYLCLMANAICSTVPLNWVPTGRTSWSKHSKGEWMTTENMLQVWNKVWIEENEWMVDKTPVASWTDVPYVGKREDIWCGSLIGTRTKATWAENVYAAINQVRAIIGKENYVDYMTSLRRYEDVLVQEDRVI
